United States Patent 6,812,339 (POLYMORPHISMS IN KNOWN GENES ASSOCIATED WITH HUMAN DISEASE, METHODS OF DETECTION AND USES THEREOF) - sequence listing, part 98

SEQ ID NO: 118839 - DNA, 601 bp, Human; identical to SEQ ID NO: 45317

SEQ ID NO: 118840 - DNA, 601 bp, Human; identical to SEQ ID NO: 45318

SEQ ID NO: 118841 - DNA, 601 bp, Human; identical to SEQ ID NO: 45319

SEQ ID NO: 118842 - DNA, 601 bp, Human; identical to SEQ ID NO: 45320

SEQ ID NO: 118843 - DNA, 601 bp, Human; identical to SEQ ID NO: 45321

SEQ ID NO: 118844 - DNA, 601 bp, Human
attctgtgttcgcctgtgcatgatacgctgaagtgtcccctgttcctatcccggcacccccaaattacccgccgactgtgtacttgtacttgggaacgggctgtgttgtggtttgcgccatggcccgggcaaaaaactttcgctgttcgcacactctggtggtacctgcgcccgggcgctctgcggcaagcggtgcggaggacacgcggggaaggtggcggggcctcccgggaaataagcggggcccttggcctgggggagcggggaatcgcttttcgccggcctccgcgtaaccttgttyctgtatgtctttctctctttttccttttgcgctaagcgtttcctcacttctcattcgttcgccaaaccctcccgcctttacagttgaaaaaccagacacacaggtatctggggcgcccggggctgcacacctcagttcggtattctgcacacacacagctcgcctggtcgggggatgggggaaaggggaaacacaacctgctgtaggcaagtccggatcccaaaccacttgggggctggttccaagggggtgggcgtggctgtgtttaaaaaatatgaaataatttttcttcctagcgaa

SEQ ID NO: 118845 - DNA, 601 bp, Human
gggctgggcgcggtggctcacgcctgtaatcctagcactttgggaggccaaggtgggcagatcacctgaggtcaagagttccagaccagcctggccacgtggtgaaaccccatctttactgagaatacaaaaaattagccgggcgtggtggcgggcacctataatcccagctactcaggaggctgaggcaggagaatcgcttgaacccgggaggcagaggttgcagtgagccaagatggcaccattgcactccagcctgggcaacaagagcaaaactccatctcaaaaaatatatatatayacatatattttatattatatatatatcatatataatacaaaatatatataatatgatatatcatataatatatacatatataatatatatcatctataatataaaatacttttttttttccagagaaaagtttgtccactgcagttacttttttttttgagatggagtttcactcttgtcgcccaggctggagtgcaatggcatgatctcagatgactgcaacctctgcctcctgagttcaagtgactctcctgtctcagcctcctagtagctgggattacaggcatgagccaccgtgtc

SEQ ID NO: 118846 - DNA, 601 bp, Human
acgtggtgaaaccccatctttactgagaatacaaaaaattagccgggcgtggtggcgggcacctataatcccagctactcaggaggctgaggcaggagaatcgcttgaacccgggaggcagaggttgcagtgagccaagatggcaccattgcactccagcctgggcaacaagagcaaaactccatctcaaaaaatatatatatacacatatattttatattatatatatatcatatataatacaaaatatatataatatgatatatcatataatatatacatatataatatatatcatctrtaatataaaatacttttttttttccagagaaaagtttgtccactgcagttacttttttttttgagatggagtttcactcttgtcgcccaggctggagtgcaatggcatgatctcagatgactgcaacctctgcctcctgagttcaagtgactctcctgtctcagcctcctagtagctgggattacaggcatgagccaccgtgtccaaccctgcagaagtaatttctagaaatctcagagaagaaagtgacccagatgaccctaactagaatagaaaaggaaattatttcagggaagtaaa

SEQ ID NO: 118847 - DNA, 601 bp, Human
cataataggactaaattgtgatcttaattttaaacagtggtctaagcccctaatttgcatctgaccagcctctctcaagtaaccattatggaaggggactttataacttctttgttatattttgacataacacatttacatttttgcccccatttggtctttctatagagttttcagattgtaacatctgaattcatctcatcaagttttcaaattgaaacatctgattgtaacaactgaaacagattcattagggatctaattttttcaaacaaaggagatttttttcttttttttttttccctagggagtttcaaatttatgacctctgacttcattgcaaaggccagaaaaataaataaatagatagacaatgaccactctccactccagacatgcaggtgtatttcaacactttagcttttactatcaggatttctttaggggaaggtgtagaaatatattggtagtttgataaattatatatcagacatgtaaaatttaaagtatcatttgaaatcaaaacttgtctgaagactagctttttatgtcacaagttcagctaagcaaagtgtcccctaactataaaacctccttactg

SEQ ID NO: 118848 - DNA, 601 bp, Human
acataacacatttacatttttgcccccatttggtctttctatagagttttcagattgtaacatctgaattcatctcatcaagttttcaaattgaaacatctgattgtaacaactgaaacagattcattagggatctaattttttcaaacaaaggagatttttttcttttttttttttccctagggagtttcaaatttatgacctctgacttcattgcaaaggccagaaaaataaataaatagatagacaatgaccactctccactccagacatgcaggtgtatttcaacactttagctttyactatcaggatttctttaggggaaggtgtagaaatatattggtagtttgataaattatatatcagacatgtaaaatttaaagtatcatttgaaatcaaaacttgtctgaagactagctttttatgtcacaagttcagctaagcaaagtgtcccctaactataaaacctccttactgcagaatcctagaaattaccaaaggcaagcttcttgaatgttgattttgaaattttgcctgcgaaagtgcaacatctttccaagcaaatgcttagaagactcagggcagaacccaaaaacaaatg

SEQ ID NO: 118849 - DNA, 601 bp, Human
ccagtgtgggttttaggatggacactcccaggagggctcccctttctgagtgggagtctttggaaatgttcctgatgggatccagtcattctggagcgctcttacgaaatcgttcatcctagggcagtttggtgtttgtgagcttacagcgtttactccttgctgtcttctaccataggtctgatctgatgggggaggcagtgggcagaggagctccagctctttgggagggtcctagaatagtacaaacagcactgggttagaagttgggggttctcattcctgggaccttggttgattrtagaactttattctaggattccatgaatttgccaagctgacatcgggaaaaggctaaagtttgattcttgaaagtattgacaaggccccatttaggaatgattctgccaagtattcctggggtcctgccatggtcaggagagcaccttaaatttgatgagttgtcagggaagaagcagagggtatctctgtgttcagctttatgtatgagaaagtcaagacacaagatgggggcaggacagggacagcttgagaaaggaggcttgagattgagacttggaactcaggtgccagggatgaa

SEQ ID NO: 118850 - DNA, 601 bp, Human
gccccatttaggaatgattctgccaagtattcctggggtcctgccatggtcaggagagcaccttaaatttgatgagttgtcagggaagaagcagagggtatctctgtgttcagctttatgtatgagaaagtcaagacacaagatgggggcaggacagggacagcttgagaaaggaggcttgagattgagacttggaactcaggtgccagggatgaatccaaaaggcttgcaggcatctcagcctcagacttaagctaacatatagcagatagtggacacctctcctgtttctttctttctcttttttttttttttgagatggagtcttgctctgtcacccaggctggagtgaagtggcatgatcttggctcactgcaacctccacctcccaggttcaagcaattctcctgcctcagcttcctgagtagctggtactacaggcgcacgccaccacacatagctaattatgtatttttagtagtgatggggttctccatgttggtcaggctggtctcaaactcccgatctcaggtgatccccctgcctcagcctcccaaagtgctgggattacaggcgtgagccaccgtgccctgccaatatt

SEQ ID NO: 118851 - DNA, 601 bp, Human
aggagagcaccttaaatttgatgagttgtcagggaagaagcagagggtatctctgtgttcagctttatgtatgagaaagtcaagacacaagatgggggcaggacagggacagcttgagaaaggaggcttgagattgagacttggaactcaggtgccagggatgaatccaaaaggcttgcaggcatctcagcctcagacttaagctaacatatagcagatagtggacacctctcctgtttctttctttcttttttttttttttttgagatggagtcttgctctgtcacccaggctggagtgwagtggcatgatcttggctcactgcaacctccacctcccaggttcaagcaattctcctgcctcagcttcctgagtagctggtactacaggcgcacgccaccacacatagctaattatgtatttttagtagtgatggggttctccatgttggtcaggctggtctcaaactcccgatctcaggtgatccccctgcctcagcctcccaaagtgctgggattacaggcgtgagccaccgtgccctgccaatatttgtctttttagtagagatggggtttcaccatgttagccaggctggtctcca

SEQ ID NO: 118852 - DNA, 601 bp, Human
tgagaaaggaggcttgagattgagacttggaactcaggtgccagggatgaatccaaaaggcttgcaggcatctcagcctcagacttaagctaacatatagcagatagtggacacctctcctgtttctttctttcttttttttttttttttgagatggagtcttgctctgtcacccaggctggagtgaagtggcatgatcttggctcactgcaacctccacctcccaggttcaagcaattctcctgcctcagcttcctgagtagctggtactacaggcgcacgccaccacacatagctaatyatgtatttttagtagtgatggggttctccatgttggtcaggctggtctcaaactcccgatctcaggtgatccccctgcctcagcctcccaaagtgctgggattacaggcgtgagccaccgtgccctgccaatatttgtctttttagtagagatggggtttcaccatgttagccaggctggtctccaactcctgacttcagatgatccgcccaccttggcctcccaaagtgctgggattacaggcgtgaaccaccgcagccagctttttttttttttctggccctgcaatcttgattcccc

SEQ ID NO: 118853 - DNA, 601 bp, Human
aatcttgattccccagagttagggtctgatttcagatgttaaggcaggctcaaagtggggcatctgctcgccacaagaaggtgagaggtcagaaagaagaagcaagaccattagggctgccttagttgaagaaagggggctcatctctcattttctcagaagtttcacaatccagaaaggggagaacggaaagcagcctcctaaggagttctcgaatttctttctcacttttcctttgttttctcgctctctcactctcttctaagatttatttttaaatggggttcttattttggggggrctttctgagcaggaactaccttttttttggagggaaataaatgagaacacaaattattcagggctgggaagtggaaacaatgaaagaaagcaaggctactcagaaccggctggcagatggcgctcggcttttacgattgacagcctggctttcaaaaattcacccttgcgccggcgcctaaggcagaacccgcatccccctccctaaatcctccttcccaaggacacggcccctgcccctaaggctgaggaatgtttttaaaaggtttcagttgagcaattgacatctaaggacaaatcc

SEQ ID NO: 118854 - DNA, 601 bp, Human
ggagaagttagcatttaagacaatatggagagatgaagtagaatttgaggtgcatggtcaatgattgtttacagagaagggacttgctagggatacatcattgcttttccattcatgcaagtatcattgtgtttttcaggatctctgagacctcagggctagttttaagttcttcccctcctcaacccctctccacttctcagtgcttcacggcacactggggcattctcactagcgaaggtgtcctctctaaggatgggacccctactgtccatctcaggctcagcactgccttggggcrggccacttctggcttctttaggcctcgtttccacgggaggggaagctgggtccgatggtgtctgggtcaaattccttggttccaagaacaggtaccgttgccattcccttccatttctgccccctgcaccaccccacccagcagctggaaaatgatgaggtcatctatttgagaagggccacacaggcctcccacacaaggacctacaaagtcctccaatgggaatttatttctttctgatcaaatttaccctccataccccattcatatacacattctttctcccctctctcttaagat

SEQ ID NO: 118855 - DNA, 601 bp, Human
gcaggccacttctggcttctttaggcctcgtttccacgggaggggaagctgggtccgatggtgtctgggtcaaattccttggttccaagaacaggtaccgttgccattcccttccatttctgccccctgcaccaccccacccagcagctggaaaatgatgaggtcatctatttgagaagggccacacaggcctcccacacaaggacctacaaagtcctccaatgggaatttatttctttctgatcaaatttaccctccataccccattcatatacacattctttctcccctctctcttaarattgtaaagttaaagaaactgaatacacagggttgatttaaggtaaacgtccctcccacccatctatttaaaaaattttcttttacttgataactttcctacaacatgattctcttatgcccatattcctctgaggattctttaaagcttttcttgcactttctcctcctcacagtccctgacttctagccctgagtggtggctgagggcaggtgaccctgtagaccgtggggaacagaggaggccagggcaggtggctgcctctttccaacctttcctgggccatgggagctcctcccc

SEQ ID NO: 118856 - DNA, 601 bp, Human
ggaaggaagaaggaagggagggaggagggagggggagaaaagaaaagaaaggaaaagaaaaaagagaagaaaagaaaaaagaaaagagtgcctttgccaagtttagctctaagcaccaaatggggtccttgccctctaggaacttctagtccagaacagaggagaggatcaggttgcaagtgattatccttctaccaggcagggggtggagcgctgccaaggagggtgtggctggcacagctgaggggccaggctggctagaccggacaggagtacggggaggagaggcaggttcacaatscaggctggggcatcctctcctccccatctcactgccccatgaggtcccttgttcgttcaagtgccaaccagaagagctgggacagaggcctctcttgtgtgccaagacgggggccaccaccaccctctgagctctgaccactgccctctcacctcttattgctttcccaagtgtttacctcctgattctaaaacgatggtccaatttttgttttattttaaagttaggaacacactgcatgtagcacacttcatggagcacaagtgttttcacatgccttatcccactaagtggttttgt

SEQ ID NO: 118857 - DNA, 601 bp, Human
gttcaagtgccaaccagaagagctgggacagaggcctctcttgtgtgccaagacgggggccaccaccaccctctgagctctgaccactgccctctcacctcttattgctttcccaagtgtttacctcctgattctaaaacgatggtccaatttttgttttattttaaagttaggaacacactgcatgtagcacacttcatggagcacaagtgttttcacatgccttatcccactaagtggttttgttttgttttagaaagtctggcacacagagaaccttctagttctttaaaaaaaaaaatcataaatttttaaatttgataattatccagaacaaaacaaagcaaaccctaaggttaaaagtgagcatcctataagttaagtatagatctttgatgttggggaaacctttgaattttacaaatcgatgtccttgagaattgggttccagccagacccactgtaggcattgttttctttttttctttttccttccttcctcccttccttcctttcttcctcccattccccctccccactttgaaaaacaagttttattctcttgggttatgttcattagagagggaagacaattctgttc

SEQ ID NO: 118858 - DNA, 601 bp, Human
tggggaaacctttgaattttacaaatcgatgtccttgagaattgggttccagccagacccactgtaggcattgttttctttttttctttttccttccttcctcccttccttcctttcttcctcccattccccctccccactttgaaaaacaagttttattctcttgggttatgttcattagagagggaagacaattctgttcagcaaggaaaggtgaggggaagagaaaaggggggaattcagccagaggagaacagggacaaggttgattgctctgtgctggggtgagggtggggggcakagagagaacatcacagccagatgcaaatcacaagagcagaccttcagcttcctggcattggtggggaaaatattccgtcagctgcctttctatgtcctgggcttcattcatcagctcaagagaaaaaaaataaaatcaaaatttcatcctaatttgttgtggttggaccccattctcccacattttggccttcttgtaaagcacaaccacaaaggcagaagtggcttcctgggctgacctgcctctcagttcattctcaaggcgttagcctcatcccatcaggaggagttcagactctcc

SEQ ID NO: 118859 - DNA, 601 bp, Human
tcctcccttccttcctttcttcctcccattccccctccccactttgaaaaacaagttttattctcttgggttatgttcattagagagggaagacaattctgttcagcaaggaaaggtgaggggaagagaaaaggggggaattcagccagaggagaacagggacaaggttgattgctctgtgctggggtgagggtggggggcagagagagaacatcacagccagatgcaaatcacaagagcagaccttcagcttcctggcattggtggggaaaatattccgtcagctgcctttctatgtccygggcttcattcatcagctcaagagaaaaaaaataaaatcaaaatttcatcctaatttgttgtggttggaccccattctcccacattttggccttcttgtaaagcacaaccacaaaggcagaagtggcttcctgggctgacctgcctctcagttcattctcaaggcgttagcctcatcccatcaggaggagttcagactctccccaagcaccaagagttagaaatgtgttgctaattgatttgagctaaatttgtgttgctttgagacttagcaaaatggctgattaggggccagtgttgg

SEQ ID NO: 118860 - DNA, 601 bp, Human
aattaatttttcaaatgtttgactattggcaggtctgaggtttactcatctgtaggttatgtccaacttggcaaaagcatggaatcctgcccagtccttggtacacagggactagcacatgtacccattttttctcactgataagttatttcctaattttttggttaacttgaaggtcgaaatagccttactcctttttgtctgtctagtagcatctctaagcttgcagtagctgctcacgtgtctgccacgccccttagaaggacgaatccttgcctggtcggtgagtttgcctcaattygggcattttcatttgttcattcattcgatatacatgtattgagtgccaaatatgtgcccttccccgtggggaagacaaaagtatgagacactgctactcccttgatggaatcaaaacaaacccaggaagttaacaagagtgggcagtctctgctaagcgattacacagggaataaataaggaaagatggaaagattgtcaaccaaaagacttcaacaacctgctaagagtcttccagcccagttgagcacaccaaatcagaggttacctaaaagtgtcatgagtgctgataattaaactg

SEQ ID NO: 118861 - DNA, 601 bp, Human
accaccaccgttcctcctgatgaaaatggcctcaccagcacctcgctgcaaacagacaccagctcaaaacattgattttctccccaccctcgcagggttaggattctgcttagaactctgctttaagctaaaatttccatcaccaaagggcctgatttcaggcagagaaaggaccactttagcaaatgagagaagcgaagaggagtggaggaggagggtcatttcaacagcagcaaaactcagccatgccattttccctgacagcactttaattatgatgaaagaacaagattttttttttccggtttttacagaggaggctcgtggtggggggaaaggagggggctctgaaagagatgtgagctgccaaggtacagagtgcaaagcggctgtcactgccaaatgacagatgcagttggagagggggagagaagcccttccctgagcctgtgcaccagtggcctattctgtgggggcccaggactagtcagccaggggcaaatggtgaataggatggcccaaaggagccacctgctacatgctagcttccccctttccttccgtgagattttaaccccagggctggttctcctagttgtgc

SEQ ID NO: 118862 - DNA, 601 bp, Human
atgtttttctttaaagtcaggtgctaagtcaggtgtgaggttgaaatggacacttaagggcttcagagcaggataaagggacagagcccaggaagcccaggactgatgctctgatgggcagaagccagccgtgttttaggaatggggaaagagttggagcaccagatgttaagaggctacagtcagctcaagcaagaacgagagaacggcgctgtcactgacttcccacctcccggccttgccggtaatccctgctctgattggaggcatggggtccacaggaggcacctattgtgttgcyacaatgcccaaaagtggcctgagaattctgggctgctagtgtttagaaagagatataagtgaaccctagactctcacagctggaaaaagcctttcttcctgggaatgggaagtaacaaaatgagtccaggttagctgtggagtccttagagatgaagggagcagagagggcggaaaaaaaacaaaaacaaagaaggtgcattattttgtgtttcctttcacctccctccttggttttagggccctttcctggcatgcaacaggaagtgcaggctgtgttgagagcctctggtgcagactt

SEQ ID NO: 118863 - DNA, 601 bp, Human
aacttttcaggctgagaatgacattaaattatcctgttcttgagcgcctcccagaggcgtgggttaaataacaccagaatatgaattgagggtcatttcggcttttctagactttgggatgcctccaatggttatgagtaaaaggagtggtgctttaacttagagattagatgtctctgggtcccaattaagttttatatccatttcctttgtatggttgagctatttggcaccatcttggcagaagacagggatccagggcctttgctaccagtggaagggattgaggaaagcttcctcwgtgataagtcttggcttggcaaaacatagcctagccttcttccttccctctccagaccagggcaccacgtggagatagcgccgtttgcttgggctggccttggacatttcagagttcccctcttactacatgctgacatcatcccgcaactccccatgtgccttccctcactgttgccaagtgctcttgaaagtcaaccaccttcctgggtgactgctgctttctcacctcaggttaaacccatggacccagtgaaagttctcccaggggctcccatacccgggggtaatcataccttcc

SEQ ID NO: 118864 - DNA, 601 bp, Human
atgagtaaaaggagtggtgctttaacttagagattagatgtctctgggtcccaattaagttttatatccatttcctttgtatggttgagctatttggcaccatcttggcagaagacagggatccagggcctttgctaccagtggaagggattgaggaaagcttcctctgtgataagtcttggcttggcaaaacatagcctagccttcttccttccctctccagaccagggcaccacgtggagatagcgccgtttgcttgggctggccttggacatttcagagttcccctcttactacatgmtgacatcatcccgcaactccccatgtgccttccctcactgttgccaagtgctcttgaaagtcaaccaccttcctgggtgactgctgctttctcacctcaggttaaacccatggacccagtgaaagttctcccaggggctcccatacccgggggtaatcataccttccatatgtgaagggctagttttccagagtttttatttcttggtgttaggtcactgcaaccctgggataaaaatagatgtaattagcatgttgcagatcagactctgcacttgtagctttgtgccactttctctaa

SEQ ID NO: 118865 - DNA, 601 bp, Human
gaattgtaggacaaacctgtttgctttagaacctagaagggctttgtcccagttagattgtctcttttccctacctttctagacattgcaggtccatctccattttcttttttgtttgtttgtgtttgttttgttttgttttgagacggagtctgggtttgtcgcccaggctggagtgcagtggcgcgatctcggctcactgcaagctccgcctcccgggttcacgccattctcccgcctcagcctcccgagtagctgggactacaggcgcccgccactgcgcccggctaatttttttgtrtttttagtagagacggggtttcaccatggtctcgatctcctgacctcgtgatccgcctgcctcggcctcccaaagtgctggcgtgagccaccgcgcccggcctcatttttttgtttttattatcagggagcaacggctccattctcccctaaggctgacatttttgttgaaggctgagcacgcatgtcttccgtgcttgtggcaaaaggccctttcctggctggctccagaatcctcaccagttaattgggaaaaaatttgagttaggcatcacaatttcagccgagctgggcaaacaac

SEQ ID NO: 118866 - DNA, 601 bp, Human
tccattttcttttttgtttgtttgtgtttgttttgttttgttttgagacggagtctgggtttgtcgcccaggctggagtgcagtggcgcgatctcggctcactgcaagctccgcctcccgggttcacgccattctcccgcctcagcctcccgagtagctgggactacaggcgcccgccactgcgcccggctaatttttttgtatttttagtagagacggggtttcaccatggtctcgatctcctgacctcgtgatccgcctgcctcggcctcccaaagtgctggcgtgagccaccgcgccsggcctcatttttttgtttttattatcagggagcaacggctccattctcccctaaggctgacatttttgttgaaggctgagcacgcatgtcttccgtgcttgtggcaaaaggccctttcctggctggctccagaatcctcaccagttaattgggaaaaaatttgagttaggcatcacaatttcagccgagctgggcaaacaacgagtacacctgtcactcgagccagtgtccaaaactcagccccatggatcacagctgtagcgttatttcagcatgagcaattcagtatttaatgttcct

SEQ ID NO: 118867 - DNA, 601 bp, Human
gaaggctgagcacgcatgtcttccgtgcttgtggcaaaaggccctttcctggctggctccagaatcctcaccagttaattgggaaaaaatttgagttaggcatcacaatttcagccgagctgggcaaacaacgagtacacctgtcactcgagccagtgtccaaaactcagccccatggatcacagctgtagcgttatttcagcatgagcaattcagtatttaatgttccttagaaaaaaagtaaatcattccaagctgctactgttcacctattaactctttcaggatttcatggtggtgrggtggaggtggggagtaatctataatttgcttggctagcagagataatacccccttcccaagtctgtctttcttacataatggccatttcttacataatggagaagaggggctgcaaaacaatatcctcttgatctgtggcagccactgccttccagaatgagaagttagattttcttctttcgtttcatttatatttttacctgcgcagtacaggtactgcttcctacgatcagcagcttccatttcttccctctttccacggtagcttaaattagcccatcatcatcagcaaatctta

SEQ ID NO: 118868 - DNA, 601 bp, Human
agggggcagccctcctcattgggagctgtgcagactgtgccccgatggttagttcccccctcaaaataaaagccagggaaataggtggagctaagcggtaattacacatttttcaatttcaactaaaacgtgtgggcaaacacaaaacgatgaaaaggtatctacatttctagatgaattaaatgtgtgactaattatgtcacgttaattgcttaattcctggtttaccaacagcagatggaagtgggactggagagggggttttagctctgaaggcgaatgacacctgaggcccagtctraatctcagttttcccaaactgaggctagaccataacggcagggctgtttgaaaatgatcacctacatttggttggcaggtagataaaatctgaagatgtaaaacttctatttagcagtcgtttcatttgtatatgtccacaaagcagcatttaactaaacaaaatgaattgcctgattaatccagtgtttttaactgtctaaactccaattctatggagctaaatttgaagaagtgaataccatgaaaaaaaccctaaaatctttaaaataagaacaattataaagggcttcttttatct

SEQ ID NO: 118869 - DNA, 601 bp, Human
ttcaaagcataaactaggtacttaaaacagtaatgatcaattaaattactaactcatatgaaaaggtcacacatggtagcctccaaaactaaaagacttgaaaaaaaaaaatcacaacttttagggcctcaagaggtcaaatttgaggccaaaagctcagtaaaatctcttctttcactttgtgtggagtgaaaacagacagcctagctgaccacaaaccagcttgtgtttcagcactctgggtgtcatttgcttacctgtaaacccatgattccacctgctgtcatttatttacaaagtraatgctttatttatccatcagtagttagtcataataaaatataggtgaaacctacacttaaaaaatttttgttttgaagagtggcctcatagattgagagctgaaaggagtaaagcctgatcttgcgttacccatttctaggacaatagtcccaattgtgccttgcctaggacgcatgttagtatatgacatggggcagtttcactccttttaaagttcaggtgtgatgtttatctaaaaggggaaggtggtaatggagctcagagatttccaaataaggaggctcttcattatattcat

SEQ ID NO: 118870 - DNA, 601 bp, Human
gttcgtggtcacatttcaacaaaacagcttgagtataaagaaaataataaaaggctgttcttatttattttcctttggtggcttttggtttgctctttttgcataggtcatgactttgttctcctgggtccagatttataaaagcagaaaattactaattaagtcaaaataagtgtctttggtgtttatgcatttgcaatttcagtaattaaatggtacatgtgttgctgtcttgtctaaaacttttaaaggcagaattatgctgttgggatattagtatgcgtataacttgatttcaaartataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacatcatgatgtattgattgcctctggcctaggaatctgcagcttaagccagtgacacaatattttgcatttttaaatggtgattctcaccaaat

SEQ ID NO: 118871 - DNA, 601 bp, Human
aaggcagaattatgctgttgggatattagtatgcgtataacttgatttcaaagtataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacatcatgatgtattgattgcctctggcctaggaatctgcagyttaagccagtgacacaatattttgcatttttaaatggtgattctcaccaaataatgcctccccacaaaagaggaaacctaataatgccccaaatcctctttttactccatcttaatgacataaaaattaagtgaattagagaactacaatgatcttaaaataatttttcagccacatttcataaatgtggaaactgaggcacggatctgtttttgcctatgaaagataggtcctgtaactgttacacagtttaacacttctgaaattagaatattagagatcctgctaaatattacgtat

SEQ ID NO: 118872 - DNA, 601 bp, Human
tgggatattagtatgcgtataacttgatttcaaagtataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacatcatgatgtattgattgcctctggcctaggaatctgcagcttaagccagtgacacaayattttgcatttttaaatggtgattctcaccaaataatgcctccccacaaaagaggaaacctaataatgccccaaatcctctttttactccatcttaatgacataaaaattaagtgaattagagaactacaatgatcttaaaataatttttcagccacatttcataaatgtggaaactgaggcacggatctgtttttgcctatgaaagataggtcctgtaactgttacacagtttaacacttctgaaattagaatattagagatcctgctaaatattacgtattgtttccttggcctctct

SEQ ID NO: 118873 - DNA, 601 bp, Human
gtatttttacaaatgaaagatgatttaaaatggaggcatgtgtttctactctttgagttgggaagggcttggaatctttcaaattcagtacttcccagggatagttttccttttgattaaagttttgttcttatgttactttttactgttgtttttgcagtttacctaatgctaatagggtctcaggaactgtatttgatgttaaagtgtggtttttccagaagatgacagataattgatggtctccccttttcctcagcaacatagttgtacccagagggaatttatctttagaaagatrtagtttgtgaggaaagaggaggatggataagtggataaaatgtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcagggattcagtttcacagttttaacttcaatt

SEQ ID NO: 118874 - DNA, 601 bp, Human
aatcgtgcctggttgcaggggacgcttgacagcacttggccccgtgacagcccctctccgggccaggtccctgccacagtcttcggacatcactgcagtgtcttcaacgtggctttggccgccccctcgtccggcccacgctgatcactgcaaattcaccccaccccacctcacgcagatttcaatgtaatgaaccaacacaggatgttttaaactattagggaaacattgtttccataatattctcaccagaaacagatgtggaagtggcagcccgtgtttacagtttctcattttttttgtccccctttaaattaccattatgggtaaatcattgtttccctttaaaacaaaaaacaaatcagtacccctgcctacagaaaagaagagggaacatttatttaaaggatggaaagactgggagttaggcactcccagcctcactgaggggcatttttgcctttgagaagtcctcccaggtatcctggtatagcacaatgtggcaatccgtagtgggaatgaagattaaacaggagagactttgtattagacctgtgagacgagttaggaagccctgcctggcatggggaatgcaaacagg

SEQ ID NO: 118875 - DNA, 601 bp, Human
tatgagagcattaaccgcactagatttcaagcacctgaaggcactagtttgtaattactagctggttggcacagtcctgttccctttcttaaacttggattcgattgaaaatttaaccttgagttgcttcagcttccatttcaaaaggggagttggagtcaaggtggtagcgtttaattataccaaccaccccccaaaaaaacaaacaaaacaaacaaaaaaacctttactagtcactaagcatccaggaaacaaaggtgaactttttcacctttcagagcaaggcaggcagctccttatrgagaattctagaatttgttagatcaaataattgtttagagaaggatgacatcacccatacgaatagtcctgttagttgaggatgctttttctactttaaccctgaattcagaaggattggttgggatgcacagggggcttcttcactcatctgattatgactctcaatgggttatcaacatgcacatacgtgctattgagtaagtcagcatcacttgtcaccaaccaattccgaaattaattcttgacacacccctcgataaagccctgccagcggagactgccatcctgacaataaata

SEQ ID NO: 118876 - DNA, 601 bp, Human
gcttccatttcaaaaggggagttggagtcaaggtggtagcgtttaattataccaaccaccccccaaaaaaacaaacaaaacaaacaaaaaaacctttactagtcactaagcatccaggaaacaaaggtgaactttttcacctttcagagcaaggcaggcagctccttatagagaattctagaatttgttagatcaaataattgtttagagaaggatgacatcacccatacgaatagtcctgttagttgaggatgctttttctactttaaccctgaattcagaaggattggttgggatgcayagggggcttcttcactcatctgattatgactctcaatgggttatcaacatgcacatacgtgctattgagtaagtcagcatcacttgtcaccaaccaattccgaaattaattcttgacacacccctcgataaagccctgccagcggagactgccatcctgacaataaataaataaccctgagacagacttccaaccatgaatctgtcatttgaagaaaaatcttgcataaattttccccctgcaacttgcaggagtacttacttattcatgagagtagttaagcaaaaataatttgaccat

SEQ ID NO: 118877 - DNA, 601 bp, Human
tggtctgattttaaaatttcagacctctttgaaacaaaatttgtttcctttattaaaatatgcaatgctgcaccgtctttaattttgaaaaacgccttggtaccttgcagcaggtcgttaagaatcatctcgaaaagcctctggccttttaaaaatgatcaaatttatttgaatcaaaggcactttacgttagcttggtggataaggaaattcatgatggcatcttttatttttccattcattatcaaattattttttctttgcttcctgcatccccacacccatcacacacacacacacrcacacacatgcacatgcatacacagacacgcacacacatcacacgcacacacagccacacgcgccgcgcacacacacacgcatgccaggtaaccactctagctctgctgtgtatttagcatgcagtggtggagtggctatttctcatgagaccatccagaaccattgacttagtttagggcatctcaaagaaacagcttctgtggccggggaggggaggggcaaagatattggggtctggggacaaagtaactgacacatgtttgttcatctgtttcttttagaatataatatccctaga

SEQ ID NO: 118878 - DNA, 601 bp, Human
gtctgattttaaaatttcagacctctttgaaacaaaatttgtttcctttattaaaatatgcaatgctgcaccgtctttaattttgaaaaacgccttggtaccttgcagcaggtcgttaagaatcatctcgaaaagcctctggccttttaaaaatgatcaaatttatttgaatcaaaggcactttacgttagcttggtggataaggaaattcatgatggcatcttttatttttccattcattatcaaattattttttctttgcttcctgcatccccacacccatcacacacacacacacgcrcacacatgcacatgcatacacagacacgcacacacatcacacgcacacacagccacacgcgccgcgcacacacacacgcatgccaggtaaccactctagctctgctgtgtatttagcatgcagtggtggagtggctatttctcatgagaccatccagaaccattgacttagtttagggcatctcaaagaaacagcttctgtggccggggaggggaggggcaaagatattggggtctggggacaaagtaactgacacatgtttgttcatctgtttcttttagaatataatatccctagatg

SEQ ID NO: 118879 - DNA, 601 bp, Human
ggattcctggcaacatctgtcccccctccccaccccagacaccccccaccactaatgagcgtggcccctctgaacttccccagctcttcacccaatgtagaagagcagtggtgcagtgacctgtgaaaggggcttcacgtaggaagggggcgagatgggatccttcagcaggtgaaggcccagaagtacacagacatttattcagaaagaataaatttgtaagtataattctttgagaaaggaaagaccaaatgatttgtggaaggcctgtcgacaggcccgcacttgaccccaccgtccrtccccgccccccacccctgctgctccactgactgccctgccctgctcgtctgctcgtctgctcttgctaattaacctcccttcgcctttcctctgccttaactgtcgtgttctagtctggagagattatatgttttaatttctactccagtctatgaattggtgaatcagccaagtgaatgcttcaaaaactgggactctcaaaagattaaaaaatatatatatacaaaccgtgaaaaagataaactctgtcccctccatctcccattggtttctgcctcggtgactccccccctcttgg

SEQ ID NO: 118880 - DNA, 601 bp, Human
ttcagaaagaataaatttgtaagtataattctttgagaaaggaaagaccaaatgatttgtggaaggcctgtcgacaggcccgcacttgaccccaccgtccgtccccgccccccacccctgctgctccactgactgccctgccctgctcgtctgctcgtctgctcttgctaattaacctcccttcgcctttcctctgccttaactgtcgtgttctagtctggagagattatatgttttaatttctactccagtctatgaattggtgaatcagccaagtgaatgcttcaaaaactgggactcycaaaagattaaaaaatatatatatacaaaccgtgaaaaagataaactctgtcccctccatctcccattggtttctgcctcggtgactccccccctcttggcctcagtttccctgtcagagaggcaggaccgtagcaccttttttccgcatgacaacgccctcacctcccagggcctaacaggtacagcaggtgtgctgtgtgtgctggttccatttttgggctatagacctgatgagatacatactccacacaagaggccttttcttgccctctaaaaacataaactcgagaaccttccc

SEQ ID NO: 118881 - DNA, 601 bp, Human
atttgtaagtataattctttgagaaaggaaagaccaaatgatttgtggaaggcctgtcgacaggcccgcacttgaccccaccgtccgtccccgccccccacccctgctgctccactgactgccctgccctgctcgtctgctcgtctgctcttgctaattaacctcccttcgcctttcctctgccttaactgtcgtgttctagtctggagagattatatgttttaatttctactccagtctatgaattggtgaatcagccaagtgaatgcttcaaaaactgggactctcaaaagattaaaawatatatatatacaaaccgtgaaaaagataaactctgtcccctccatctcccattggtttctgcctcggtgactccccccctcttggcctcagtttccctgtcagagaggcaggaccgtagcaccttttttccgcatgacaacgccctcacctcccagggcctaacaggtacagcaggtgtgctgtgtgtgctggttccatttttgggctatagacctgatgagatacatactccacacaagaggccttttcttgccctctaaaaacataaactcgagaaccttccctggctgtgcttcta

SEQ ID NO: 118882 - DNA, 601 bp, Human
gataaactctgtcccctccatctcccattggtttctgcctcggtgactccccccctcttggcctcagtttccctgtcagagaggcaggaccgtagcaccttttttccgcatgacaacgccctcacctcccagggcctaacaggtacagcaggtgtgctgtgtgtgctggttccatttttgggctatagacctgatgagatacatactccacacaagaggccttttcttgccctctaaaaacataaactcgagaaccttccctggctgtgcttctaatgaaggctagtttctgaaaaacatacagcatttggatcagtgtaatgtggtacaaaaattaacattctgttatggtccccagaagccaaagggtgtgtcctttacctgtgggaccagtgaccctgaatatagatcattccataaagaccacgcaggccatcccatgtggctgagttaaactcaaggaaaagctacaaaaccttcaacctctacttaccagagggatctgacctcccctcccccttagattataaggccttctagggggtggaatcttatttgattcctattgcacatggaccaacatgcactaacatcatgaact

SEQ ID NO: 118883 - DNA, 601 bp, Human
tcgggatgtctttatgaaagcagtactcctaactgacatggtgcaatatgattttcttttcttttcaatcccactgcagtgagaaggcaaccaaagtgcaggacatcaaaaacaacctgaaagaggcgattgaagtacgtgctggctccttgtgctgtctgtcttgtagcgccctcccagccagtgctgttccctgaccgctttgctaaatcattttcagaccattgtggccgccatgagcaacctggtgccccccgtggagctggccaaccccgagaaccagttcagagtggactacatyctgagtgtgatgaacgtgcctgactttgacttccctcccgtaagctacaccccgacttgtgtggccttagccccgcccacctgagcacagtgtccatataggaacatgagtgacagccctgcacatgggcaggagcatccaaaccacacttcaggcaaaactacatttcagtgatgtccatccttaggaaaaagttaatttcatgtgtaaccttaatttaataataataatcattagggctttgttcaagatggatgagcaaaattctgtcaccccttctacatcttagctcacctgtcc

SEQ ID NO: 118884 - DNA, 601 bp, Human
ggtgcaatatgattttcttttcttttcaatcccactgcagtgagaaggcaaccaaagtgcaggacatcaaaaacaacctgaaagaggcgattgaagtacgtgctggctccttgtgctgtctgtcttgtagcgccctcccagccagtgctgttccctgaccgctttgctaaatcattttcagaccattgtggccgccatgagcaacctggtgccccccgtggagctggccaaccccgagaaccagttcagagtggactacatcctgagtgtgatgaacgtgcctgactttgacttccctccygtaagctacaccccgacttgtgtggccttagccccgcccacctgagcacagtgtccatataggaacatgagtgacagccctgcacatgggcaggagcatccaaaccacacttcaggcaaaactacatttcagtgatgtccatccttaggaaaaagttaatttcatgtgtaaccttaatttaataataataatcattagggctttgttcaagatggatgagcaaaattctgtcaccccttctacatcttagctcacctgtcctcacaaataaacatcactcttgaatactacaatctcact

SEQ ID NO: 118885 - DNA, 601 bp, Human
agggaaatagggctgtgctcacattttgaataatgtaaaaatactatattttattgctgtaattttaaaacataacaaagaggaacggtgaagacatagctacgcctcctctctccttggtagttgttgattgatctatttctgctctcaggtaagcgactctagtagctgcctagtgttactagatcctagtgactctaggtagagtttgtttttgtgttgtcttgacttttgaactctatttcatatccttatttattccttctcaccgggtcttgattcaaggatggtaagtggtcartggattttaaatcctaaactgtacacctaagcagtacaataccgtggtggggttattttcaaataaaacaaattactacctgcgaggaggacaggttaaggcctgcagtagcaatgggaaaagcatctttctccaaagtcactcataaaggtgggctcacctggttggtgtgttggcaaatgaagaagggggaacttaaaacacagactttattgcacaactctacctgatgcccaggctgcttcccttgctgcctaacacctgacttaccattgcctcagggatcgccctctgtccctg

SEQ ID NO: 118886 - DNA, 601 bp, Human
tcactcataaaggtgggctcacctggttggtgtgttggcaaatgaagaagggggaacttaaaacacagactttattgcacaactctacctgatgcccaggctgcttcccttgctgcctaacacctgacttaccattgcctcagggatcgccctctgtccctgtcacccaccatggtctctcccagaggacatcgtacccgatagctagaaagttgcctttgaaatagtttatggcttccctcatcttgcacatgatatagcaagcatgtggtggtcagggttatttaaaaaatatgtaaasattattattatttttttgaaacggagtctcactctgtcacccaggctggagtgcagtggtgcgaccttggctcactgcaacctctgcctcctgggttcaagtgattctcctgcctcagcctcccgagtagctgggactacaggtgcctgccgccacaaccagctaatttttgtatttttagtagagatggggtttcaccatattggccaggctggtctcgaactcctgaccttgtgatccacctgcctcggcctcccaaagtgctgggattacaggcatgagccaccgtgcccagccaaa

SEQ ID NO: 118887 - DNA, 601 bp, Human
aatgatacagaggtatacaattttcaaactgtttgccattttaatcaagcaatttgaaaattaaaatgtttttgtcaggcattaccaaatggcacagaatgtgataggccagcctggttttggggtcctttctctactggttgatatgcataaaaccttctaaaaatcaagaatattgccagagagcaacaggaataaagaagctaagtaaagaataaaaaagaaaaatagaaaaaataaaaataaacacgaagaacaaagccccaccaccgtgctgtgctgtttgtgtggccccactgcrtcgaggccacaggctagctgctagacgcatctagagttccctgattcctaaaattatttatcttaaatcctgtttgccctaaccttcttaaggcatcagctttgagttacaaatgtaaccaacacacaagcaaatgtgccattgacttagtgctgcataactgtgggacggtcacttccgttgagcctgaccttgtagagagacacaaatagttggcaaattgatgtgagcgctgtgaacaccccacgtgtctttctttttctcccagcttcctggacaagatcgacgtgatcaagcagg

SEQ ID NO: 118888 - DNA, 601 bp, Human; identical to SEQ ID NO: 73820

SEQ ID NO: 118889 - DNA, 601 bp, Human; identical to SEQ ID NO: 73821

SEQ ID NO: 118890 - DNA, 601 bp, Human; identical to SEQ ID NO: 73822

SEQ ID NO: 118891 - DNA, 601 bp, Human; identical to SEQ ID NO: 73823

SEQ ID NO: 118892 - DNA, 601 bp, Human; identical to SEQ ID NO: 73824

SEQ ID NO: 118893 - DNA, 601 bp, Human; identical to SEQ ID NO: 73825

SEQ ID NO: 118894 - DNA, 601 bp, Human; identical to SEQ ID NO: 73826

SEQ ID NO: 118895 - DNA, 601 bp, Human; identical to SEQ ID NO: 73827

SEQ ID NO: 118896 - DNA, 601 bp, Human; identical to SEQ ID NO: 73828

SEQ ID NO: 118897 - DNA, 601 bp, Human; identical to SEQ ID NO: 73829

SEQ ID NO: 118898 - DNA, 601 bp, Human; identical to SEQ ID NO: 73830

SEQ ID NO: 118899 - DNA, 601 bp, Human; identical to SEQ ID NO: 73831

SEQ ID NO: 118900 - DNA, 601 bp, Human; identical to SEQ ID NO: 73832

SEQ ID NO: 118901 - DNA, 601 bp, Human; identical to SEQ ID NO: 73833

SEQ ID NO: 118902 - DNA, 601 bp, Human; identical to SEQ ID NO: 73834

SEQ ID NO: 118903 - DNA, 601 bp, Human; identical to SEQ ID NO: 73835

SEQ ID NO: 118904 - DNA, 601 bp, Human; identical to SEQ ID NO: 73836

SEQ ID NO: 118905 - DNA, 601 bp, Human; identical to SEQ ID NO: 73837

SEQ ID NO: 118906 - DNA, 601 bp, Human; identical to SEQ ID NO: 73838

SEQ ID NO: 118907 - DNA, 601 bp, Human; identical to SEQ ID NO: 73839

SEQ ID NO: 118908 - DNA, 601 bp, Human; identical to SEQ ID NO: 73840

SEQ ID NO: 118909 - DNA, 601 bp, Human; identical to SEQ ID NO: 73841

SEQ ID NO: 118910 - DNA, 601 bp, Human; identical to SEQ ID NO: 73842

SEQ ID NO: 118911 - DNA, 601 bp, Human; identical to SEQ ID NO: 73843

SEQ ID NO: 118912 - DNA, 601 bp, Human; identical to SEQ ID NO: 73844

SEQ ID NO: 118913 - DNA, 601 bp, Human; identical to SEQ ID NO: 73845

SEQ ID NO: 118914 - DNA, 601 bp, Human; identical to SEQ ID NO: 73846

SEQ ID NO: 118915 - DNA, 601 bp, Human; identical to SEQ ID NO: 73847

SEQ ID NO: 118916 - DNA, 601 bp, Human; identical to SEQ ID NO: 73848

SEQ ID NO: 118917 - DNA, 601 bp, Human; identical to SEQ ID NO: 73849

SEQ ID NO: 118918 - DNA, 601 bp, Human; identical to SEQ ID NO: 73850

SEQ ID NO: 118919 - DNA, 601 bp, Human; identical to SEQ ID NO: 73851

SEQ ID NO: 118920 - DNA, 601 bp, Human; identical to SEQ ID NO: 73852

SEQ ID NO: 118921 - DNA, 601 bp, Human; identical to SEQ ID NO: 73853

SEQ ID NO: 118922 - DNA, 601 bp, Human; identical to SEQ ID NO: 73854

SEQ ID NO: 118923 - DNA, 601 bp, Human; identical to SEQ ID NO: 73855

SEQ ID NO: 118924 - DNA, 601 bp, Human; identical to SEQ ID NO: 73856

SEQ ID NO: 118925 - DNA, 601 bp, Human; identical to SEQ ID NO: 73857

SEQ ID NO: 118926 - DNA, 601 bp, Human; identical to SEQ ID NO: 73858

SEQ ID NO: 118927 - DNA, 601 bp, Human; identical to SEQ ID NO: 73859

SEQ ID NO: 118928 - DNA, 601 bp, Human; identical to SEQ ID NO: 73860

SEQ ID NO: 118929 - DNA, 601 bp, Human; identical to SEQ ID NO: 73861

SEQ ID NO: 118930 - DNA, 601 bp, Human; identical to SEQ ID NO: 73862

SEQ ID NO: 118931 - DNA, 601 bp, Human; identical to SEQ ID NO: 73863

SEQ ID NO: 118932 - DNA, 601 bp, Human; identical to SEQ ID NO: 73864

SEQ ID NO: 118933 - DNA, 601 bp, Human; identical to SEQ ID NO: 73865

SEQ ID NO: 118934 - DNA, 601 bp, Human; identical to SEQ ID NO: 73866

SEQ ID NO: 118935 - DNA, 601 bp, Human; identical to SEQ ID NO: 73867

SEQ ID NO: 118936 - DNA, 601 bp, Human; identical to SEQ ID NO: 73868

SEQ ID NO: 118937 - DNA, 601 bp, Human; identical to SEQ ID NO: 73869

SEQ ID NO: 118938 - DNA, 601 bp, Human; identical to SEQ ID NO: 73870

SEQ ID NO: 118939 - DNA, 601 bp, Human; identical to SEQ ID NO: 73871

SEQ ID NO: 118940 - DNA, 601 bp, Human; identical to SEQ ID NO: 73872

SEQ ID NO: 118941 - DNA, 601 bp, Human; identical to SEQ ID NO: 73873

SEQ ID NO: 118942 - DNA, 601 bp, Human; identical to SEQ ID NO: 73874

SEQ ID NO: 118943 - DNA, 601 bp, Human; identical to SEQ ID NO: 73875

SEQ ID NO: 118944 - DNA, 601 bp, Human; identical to SEQ ID NO: 73876

SEQ ID NO: 118945 - DNA, 601 bp, Human
cctcgggaaaagcgaacaggcggagacgatgaagggtgccagtgggaaagggagacggggtgggtcggcggcgctcagaggaaaggggcgaggggtcggtggcaggctccgcgcctcacagtgccagaacgcggcgggcagcaagccgggctctaaggatactcccgggagggccaggccactgggcgccgcgccagcgtccctccatcactccctcccttgtttcctcactccgccccggccttactcccctcgcttaccctgcccagccgggccagtcagcgctcccggctcagcaacsggctgtctcctgggcgtccgtggaaacgccgtccggacggaacaacttccggcccgacggcgccgtcattggctgttcgcgcgggggcggggcagaggccgccactgattggctggcggccgcggcgtcgcgtcggaacgtgactggatggtagtgtgctggccggtctgcctccgggagaaccgagcgcttccggtgcgtgtggtgagcggcgggccccgggctggaggggccgggactgggcagcgcctaaagcgccccgtgccgcttaacgcggtctctcatagccgctcgccttcc

SEQ ID NO: 118946 - DNA, 601 bp, Human
gcatctgttcaccgaggcggcacagtgcagtggaaagatcaggagttctggggtcacagacgcctgggtttcaatcccagcttggacttattcgaaaccttgggcaagggtcgcattacttttctgcttccccttcggtttcctcatctgtggaatgggcatggagaagcctgctaacattaccgttgaggggactaagtgcaacactacgcaaagcctctggcacatggcaggcgctaaataaaaatgggggcctctctcctcgggaaaagcgaacaggcggagacgatgaagggtgccrgtgggaaagggagacggggtgggtcggcggcgctcagaggaaaggggcgaggggtcggtggcaggctccgcgcctcacagtgccagaacgcggcgggcagcaagccgggctctaaggatactcccgggagggccaggccactgggcgccgcgccagcgtccctccatcactccctcccttgtttcctcactccgccccggccttactcccctcgcttaccctgcccagccgggccagtcagcgctcccggctcagcaaccggctgtctcctgggcgtccgtggaaacgccgtccggacgg

SEQ ID NO: 118947 - DNA, 601 bp, Human
tttgtctttcgttctccccaccctgcattcagctaagggtttcttataaatcacccagattctcagaaacacttgagctcttgaccaaccttcttgatgagactgtccaatcaggggtgggttgcctggggggccaggttgagaccaatgaaaccctcttgagaatcgagccattagctggtcattgcatcagccacccctcaccccccgctggcctccaaataacctccccaccctcttcccgttccccaccctcagcgtcagtgtgactgattttgtgtagtcgtgggcggtggaaagrgaaactgtaaattccccgcatctgttcaccgaggcggcacagtgcagtggaaagatcaggagttctggggtcacagacgcctgggtttcaatcccagcttggacttattcgaaaccttgggcaagggtcgcattacttttctgcttccccttcggtttcctcatctgtggaatgggcatggagaagcctgctaacattaccgttgaggggactaagtgcaacactacgcaaagcctctggcacatggcaggcgctaaataaaaatgggggcctctctcctcgggaaaagcgaacaggcgg

SEQ ID NO: 118948 - DNA, 601 bp, Human; identical to SEQ ID NO: 73820

SEQ ID NO: 118949 - DNA, 601 bp, Human; identical to SEQ ID NO: 73821

SEQ ID NO: 118950 - DNA, 601 bp, Human; identical to SEQ ID NO: 73822

SEQ ID NO: 118951 - DNA, 601 bp, Human; identical to SEQ ID NO: 73823

SEQ ID NO: 118952 - DNA, 601 bp, Human; identical to SEQ ID NO: 73824

SEQ ID NO: 118953 - DNA, 601 bp, Human; identical to SEQ ID NO: 73825

SEQ ID NO: 118954 - DNA, 601 bp, Human; identical to SEQ ID NO: 73826

SEQ ID NO: 118955 - DNA, 601 bp, Human; identical to SEQ ID NO: 73827

SEQ ID NO: 118956 - DNA, 601 bp, Human; identical to SEQ ID NO: 73828

SEQ ID NO: 118957 - DNA, 601 bp, Human; identical to SEQ ID NO: 73829

SEQ ID NO: 118958 - DNA, 601 bp, Human; identical to SEQ ID NO: 73830

SEQ ID NO: 118959 - DNA, 601 bp, Human; identical to SEQ ID NO: 73831

SEQ ID NO: 118960 - DNA, 601 bp, Human; identical to SEQ ID NO: 73832

SEQ ID NO: 118961 - DNA, 601 bp, Human; identical to SEQ ID NO: 73833

SEQ ID NO: 118962 - DNA, 601 bp, Human; identical to SEQ ID NO: 73834

SEQ ID NO: 118963 - DNA, 601 bp, Human; identical to SEQ ID NO: 73835

SEQ ID NO: 118964 - DNA, 601 bp, Human; identical to SEQ ID NO: 73836

SEQ ID NO: 118965 - DNA, 601 bp, Human; identical to SEQ ID NO: 73837

SEQ ID NO: 118966 - DNA, 601 bp, Human; identical to SEQ ID NO: 73838

SEQ ID NO: 118967 - DNA, 601 bp, Human; identical to SEQ ID NO: 73839

SEQ ID NO: 118968 - DNA, 601 bp, Human; identical to SEQ ID NO: 73840

SEQ ID NO: 118969 - DNA, 601 bp, Human; identical to SEQ ID NO: 73841

SEQ ID NO: 118970 - DNA, 601 bp, Human; identical to SEQ ID NO: 73842

SEQ ID NO: 118971 - DNA, 601 bp, Human; identical to SEQ ID NO: 73843

SEQ ID NO: 118972 - DNA, 601 bp, Human; identical to SEQ ID NO: 73844

SEQ ID NO: 118973 - DNA, 601 bp, Human; identical to SEQ ID NO: 73845

SEQ ID NO: 118974 - DNA, 601 bp, Human; identical to SEQ ID NO: 73846

SEQ ID NO: 118975 - DNA, 601 bp, Human; identical to SEQ ID NO: 73847

SEQ ID NO: 118976 - DNA, 601 bp, Human; identical to SEQ ID NO: 73848

SEQ ID NO: 118977 - DNA, 601 bp, Human; identical to SEQ ID NO: 73849

SEQ ID NO: 118978 - DNA, 601 bp, Human; identical to SEQ ID NO: 73850

SEQ ID NO: 118979 - DNA, 601 bp, Human; identical to SEQ ID NO: 73851

SEQ ID NO: 118980 - DNA, 601 bp, Human; identical to SEQ ID NO: 73852

SEQ ID NO: 118981 - DNA, 601 bp, Human; identical to SEQ ID NO: 73853

SEQ ID NO: 118982 - DNA, 601 bp, Human; identical to SEQ ID NO: 73854

SEQ ID NO: 118983 - DNA, 601 bp, Human; identical to SEQ ID NO: 73855

SEQ ID NO: 118984 - DNA, 601 bp, Human; identical to SEQ ID NO: 73856

SEQ ID NO: 118985 - DNA, 601 bp, Human; identical to SEQ ID NO: 73857

SEQ ID NO: 118986 - DNA, 601 bp, Human; identical to SEQ ID NO: 73858

SEQ ID NO: 118987 - DNA, 601 bp, Human; identical to SEQ ID NO: 73859

SEQ ID NO: 118988 - DNA, 601 bp, Human; identical to SEQ ID NO: 73860

SEQ ID NO: 118989 - DNA, 601 bp, Human; identical to SEQ ID NO: 73861

SEQ ID NO: 118990 - DNA, 601 bp, Human; identical to SEQ ID NO: 73862

SEQ ID NO: 118991 - DNA, 601 bp, Human; identical to SEQ ID NO: 73863

SEQ ID NO: 118992 - DNA, 601 bp, Human; identical to SEQ ID NO: 73864

SEQ ID NO: 118993 - DNA, 601 bp, Human; identical to SEQ ID NO: 73865

SEQ ID NO: 118994 - DNA, 601 bp, Human; identical to SEQ ID NO: 73866

SEQ ID NO: 118995 - DNA, 601 bp, Human; identical to SEQ ID NO: 73867

SEQ ID NO: 118996 - DNA, 601 bp, Human; identical to SEQ ID NO: 73868

SEQ ID NO: 118997 - DNA, 601 bp, Human; identical to SEQ ID NO: 73869

SEQ ID NO: 118998 - DNA, 601 bp, Human; identical to SEQ ID NO: 73870

SEQ ID NO: 118999 - DNA, 601 bp, Human; identical to SEQ ID NO: 73871

SEQ ID NO: 119000 - DNA, 601 bp, Human; identical to SEQ ID NO: 73872

SEQ ID NO: 119001 - DNA, 601 bp, Human; identical to SEQ ID NO: 73873

SEQ ID NO: 119002 - DNA, 601 bp, Human; identical to SEQ ID NO: 73874

SEQ ID NO: 119003 - DNA, 601 bp, Human; identical to SEQ ID NO: 73875

SEQ ID NO: 119004 - DNA, 601 bp, Human; identical to SEQ ID NO: 73876

SEQ ID NO: 119005 - DNA, 601 bp, Human
tggagaccatcctggctcacgcggtgaaaccccgtctctactaaaagtacaaaaaattagccagacatggtgccaggcacttgtagtcccagctactcgggaggctgaggcaggacaatggcgtgaacccaggaggcggagcttgcagtgagccgagatcgcgccactgcactccagcctgggcaacagagtgagacttcgttttttttttaaaaaaaggctgggcacagtggctcacacctgtaatctgccagcactttgggaggccgaggcaggtagatcacctgaggtcaggagttcragaccagcctcgccaaaatggtgagaccctgtgtctactaaaaatacaaaaaattagccgggtgtgttggcgtgtacctgttatcccagctactcgggaggtgaggcaggagaatcgcttgaacccagaaggtggaggttgcagtgagccgagatcatgccactgcactccagactgggctacagagcgagactccataagaaaaaaagaaaaaaaaggggggcaaaaagaaacagatgaaaccaatgtgaataatttattttaacacaatatacctaacatatttttatttcaatatct

SEQ ID NO: 119006 - DNA, 601 bp, Human
catttatttattttattttattttttgagatgcagtcttgctctgtcacccaggctgcggtgcagtggcgcaatcttgcttcactgcaacctccacctcccaggttcaagcgattctcctgcctcagcctccttagtagctgggattacaggcacgagctaccatgcccagctaatttttgtatatttagtatggacagggcttcaccatgttggccaggctggtctcgaactcctggcctcaaatgatctgtgtgcctcagcctcccatagtgctgggattacaggcatgagccactgcrtccggcctacttaccttttatttttgcttgcattaccctttctttgccttgtttcatttggctaagactgtcttgtttacttgctttgcttctgagggattatatgagagttctatgggtttttccataatggagtgtacttttattattttattatttgtttttttgagacagggtctcactctgtcactcaggctggagtgtagtgatgcagtcactgctcactgcagctttgactttcttggctccagtgatccttccacctcagcctcctgagtagctggaaccacaggcacccac

SEQ ID NO: 119007 - DNA, 601 bp, Human
gatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggccccccyaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaa

SEQ ID NO: 119008 - DNA, 601 bp, Human; identical to SEQ ID NO: 54579

SEQ ID NO: 119009 - DNA, 601 bp, Human; identical to SEQ ID NO: 54580

SEQ ID NO: 119010 - DNA, 601 bp, Human; identical to SEQ ID NO: 54581

SEQ ID NO: 119011 - DNA, 601 bp, Human; identical to SEQ ID NO: 54582

SEQ ID NO: 119012 - DNA, 601 bp, Human; identical to SEQ ID NO: 54583

SEQ ID NO: 119013 - DNA, 601 bp, Human; identical to SEQ ID NO: 54584

SEQ ID NO: 119014 - DNA, 601 bp, Human; identical to SEQ ID NO: 54585

SEQ ID NO: 119015 - DNA, 601 bp, Human; identical to SEQ ID NO: 54586

SEQ ID NO: 119016 - DNA, 601 bp, Human; identical to SEQ ID NO: 54587

SEQ ID NO: 119017 - DNA, 601 bp, Human; identical to SEQ ID NO: 54588

SEQ ID NO: 119018 - DNA, 601 bp, Human; identical to SEQ ID NO: 54589

SEQ ID NO: 119019 - DNA, 601 bp, Human; identical to SEQ ID NO: 54590

SEQ ID NO: 119020 - DNA, 601 bp, Human; identical to SEQ ID NO: 54591

SEQ ID NO: 119021 - DNA, 601 bp, Human; identical to SEQ ID NO: 54592

SEQ ID NO: 119022 - DNA, 601 bp, Human; identical to SEQ ID NO: 54593

SEQ ID NO: 119023 - DNA, 601 bp, Human; identical to SEQ ID NO: 54594

SEQ ID NO: 119024 - DNA, 601 bp, Human; identical to SEQ ID NO: 54595

SEQ ID NO: 119025 - DNA, 601 bp, Human; identical to SEQ ID NO: 17624

SEQ ID NO: 119026 - DNA, 601 bp, Human; identical to SEQ ID NO: 17625

SEQ ID NO: 119027 - DNA, 601 bp, Human; identical to SEQ ID NO: 17626

SEQ ID NO: 119028 - DNA, 601 bp, Human; identical to SEQ ID NO: 17627

SEQ ID NO: 119029 - DNA, 601 bp, Human; identical to SEQ ID NO: 17628

SEQ ID NO: 119030 - DNA, 601 bp, Human; identical to SEQ ID NO: 17629

SEQ ID NO: 119031 - DNA, 601 bp, Human; identical to SEQ ID NO: 17630

SEQ ID NO: 119032 - DNA, 601 bp, Human; identical to SEQ ID NO: 17631

SEQ ID NO: 119033 - DNA, 601 bp, Human; identical to SEQ ID NO: 17632

SEQ ID NO: 119034 - DNA, 601 bp, Human; identical to SEQ ID NO: 17633

SEQ ID NO: 119035 - DNA, 601 bp, Human; identical to SEQ ID NO: 17634

SEQ ID NO: 119036 - DNA, 601 bp, Human; identical to SEQ ID NO: 17635

SEQ ID NO: 119037 - DNA, 601 bp, Human; identical to SEQ ID NO: 17636

SEQ ID NO: 119038 - DNA, 601 bp, Human; identical to SEQ ID NO: 17637

SEQ ID NO: 119039 - DNA, 601 bp, Human; identical to SEQ ID NO: 17638

SEQ ID NO: 119040 - DNA, 601 bp, Human; identical to SEQ ID NO: 17639

SEQ ID NO: 119041 - DNA, 601 bp, Human; identical to SEQ ID NO: 119005

SEQ ID NO: 119042 - DNA, 601 bp, Human; identical to SEQ ID NO: 119006

SEQ ID NO: 119043 - DNA, 601 bp, Human; identical to SEQ ID NO: 119007

SEQ ID NO: 119044 - DNA, 601 bp, Human; identical to SEQ ID NO: 54579

SEQ ID NO: 119045 - DNA, 601 bp, Human; identical to SEQ ID NO: 54580

SEQ ID NO: 119046 - DNA, 601 bp, Human; identical to SEQ ID NO: 54581

SEQ ID NO: 119047 - DNA, 601 bp, Human; identical to SEQ ID NO: 54582

SEQ ID NO: 119048 - DNA, 601 bp, Human; identical to SEQ ID NO: 54583

SEQ ID NO: 119049 - DNA, 601 bp, Human; identical to SEQ ID NO: 54584

SEQ ID NO: 119050 - DNA, 601 bp, Human; identical to SEQ ID NO: 54585

SEQ ID NO: 119051 - DNA, 601 bp, Human; identical to SEQ ID NO: 54586

SEQ ID NO: 119052 - DNA, 601 bp, Human; identical to SEQ ID NO: 54587

SEQ ID NO: 119053 - DNA, 601 bp, Human; identical to SEQ ID NO: 54588

SEQ ID NO: 119054 - DNA, 601 bp, Human; identical to SEQ ID NO: 54589

SEQ ID NO: 119055 - DNA, 601 bp, Human; identical to SEQ ID NO: 54590

SEQ ID NO: 119056 - DNA, 601 bp, Human; identical to SEQ ID NO: 54591

SEQ ID NO: 119057 - DNA, 601 bp, Human; identical to SEQ ID NO: 54592

SEQ ID NO: 119058 - DNA, 601 bp, Human; identical to SEQ ID NO: 54593

SEQ ID NO: 119059 - DNA, 601 bp, Human; identical to SEQ ID NO: 54594

SEQ ID NO: 119060 - DNA, 601 bp, Human; identical to SEQ ID NO: 54595

SEQ ID NO: 119061 - DNA, 601 bp, Human; identical to SEQ ID NO: 17624

SEQ ID NO: 119062 - DNA, 601 bp, Human; identical to SEQ ID NO: 17625

SEQ ID NO: 119063 - DNA, 601 bp, Human; identical to SEQ ID NO: 17626

SEQ ID NO: 119064 - DNA, 601 bp, Human; identical to SEQ ID NO: 17627

SEQ ID NO: 119065 - DNA, 601 bp, Human; identical to SEQ ID NO: 17628

SEQ ID NO: 119066 - DNA, 601 bp, Human; identical to SEQ ID NO: 17629

SEQ ID NO: 119067 - DNA, 601 bp, Human; identical to SEQ ID NO: 17630

SEQ ID NO: 119068 - DNA, 601 bp, Human; identical to SEQ ID NO: 17631

SEQ ID NO: 119069 - DNA, 601 bp, Human; identical to SEQ ID NO: 17632

SEQ ID NO: 119070 - DNA, 601 bp, Human; identical to SEQ ID NO: 17633

SEQ ID NO: 119071 - DNA, 601 bp, Human; identical to SEQ ID NO: 17634

SEQ ID NO: 119072 - DNA, 601 bp, Human; identical to SEQ ID NO: 17635

SEQ ID NO: 119073 - DNA, 601 bp, Human; identical to SEQ ID NO: 17636

SEQ ID NO: 119074 - DNA, 601 bp, Human; identical to SEQ ID NO: 17637

SEQ ID NO: 119075 - DNA, 601 bp, Human; identical to SEQ ID NO: 17638

SEQ ID NO: 119076 - DNA, 601 bp, Human; identical to SEQ ID NO: 17639

SEQ ID NO: 119077 - DNA, 601 bp, Human; identical to SEQ ID NO: 119005

SEQ ID NO: 119078 - DNA, 601 bp, Human; identical to SEQ ID NO: 119006

SEQ ID NO: 119079 - DNA, 601 bp, Human; identical to SEQ ID NO: 119007

SEQ ID NO: 119080 - DNA, 601 bp, Human; identical to SEQ ID NO: 54579

SEQ ID NO: 119081 - DNA, 601 bp, Human; identical to SEQ ID NO: 54580

SEQ ID NO: 119082 - DNA, 601 bp, Human; identical to SEQ ID NO: 54581

SEQ ID NO: 119083 - DNA, 601 bp, Human; identical to SEQ ID NO: 54582

SEQ ID NO: 119084 - DNA, 601 bp, Human; identical to SEQ ID NO: 54583

SEQ ID NO: 119085 - DNA, 601 bp, Human; identical to SEQ ID NO: 54584

SEQ ID NO: 119086 - DNA, 601 bp, Human; identical to SEQ ID NO: 54585

SEQ ID NO: 119087 - DNA, 601 bp, Human; identical to SEQ ID NO: 54586

SEQ ID NO: 119088 - DNA, 601 bp, Human; identical to SEQ ID NO: 54587

SEQ ID NO: 119089 - DNA, 601 bp, Human; identical to SEQ ID NO: 54588

SEQ ID NO: 119090 - DNA, 601 bp, Human; identical to SEQ ID NO: 54589

SEQ ID NO: 119091 - DNA, 601 bp, Human; identical to SEQ ID NO: 54590

SEQ ID NO: 119092 - DNA, 601 bp, Human; identical to SEQ ID NO: 54591

SEQ ID NO: 119093 - DNA, 601 bp, Human; identical to SEQ ID NO: 54592

SEQ ID NO: 119094 - DNA, 601 bp, Human; identical to SEQ ID NO: 54593

SEQ ID NO: 119095 - DNA, 601 bp, Human; identical to SEQ ID NO: 54594

SEQ ID NO: 119096 - DNA, 601 bp, Human; identical to SEQ ID NO: 54595

SEQ ID NO: 119097 - DNA, 601 bp, Human; identical to SEQ ID NO: 17624

SEQ ID NO: 119098 - DNA, 601 bp, Human; identical to SEQ ID NO: 17625

SEQ ID NO: 119099 - DNA, 601 bp, Human; identical to SEQ ID NO: 17626

SEQ ID NO: 119100 - DNA, 601 bp, Human; identical to SEQ ID NO: 17627

SEQ ID NO: 119101 - DNA, 601 bp, Human; identical to SEQ ID NO: 17628

SEQ ID NO: 119102 - DNA, 601 bp, Human; identical to SEQ ID NO: 17629

SEQ ID NO: 119103 - DNA, 601 bp, Human; identical to SEQ ID NO: 17630

SEQ ID NO: 119104 - DNA, 601 bp, Human; identical to SEQ ID NO: 17631

SEQ ID NO: 119105 - DNA, 601 bp, Human; identical to SEQ ID NO: 17632

SEQ ID NO: 119106 - DNA, 601 bp, Human; identical to SEQ ID NO: 17633

SEQ ID NO: 119107 - DNA, 601 bp, Human; identical to SEQ ID NO: 17634

SEQ ID NO: 119108 - DNA, 601 bp, Human; identical to SEQ ID NO: 17635

SEQ ID NO: 119109 - DNA, 601 bp, Human; identical to SEQ ID NO: 17636

SEQ ID NO: 119110 - DNA, 601 bp, Human; identical to SEQ ID NO: 17637

SEQ ID NO: 119111 - DNA, 601 bp, Human; identical to SEQ ID NO: 17638

SEQ ID NO: 119112 - DNA, 601 bp, Human; identical to SEQ ID NO: 17639

SEQ ID NO: 119113 - DNA, 601 bp, Human; identical to SEQ ID NO: 119005

SEQ ID NO: 119114 - DNA, 601 bp, Human; identical to SEQ ID NO: 119006

SEQ ID NO: 119115 - DNA, 601 bp, Human; identical to SEQ ID NO: 119007

SEQ ID NO: 119116 - DNA, 601 bp, Human; identical to SEQ ID NO: 54579

SEQ ID NO: 119117 - DNA, 601 bp, Human; identical to SEQ ID NO: 54580

SEQ ID NO: 119118 - DNA, 601 bp, Human; identical to SEQ ID NO: 54581

SEQ ID NO: 119119 - DNA, 601 bp, Human; identical to SEQ ID NO: 54582

SEQ ID NO: 119120 - DNA, 601 bp, Human; identical to SEQ ID NO: 54583

SEQ ID NO: 119121 - DNA, 601 bp, Human; identical to SEQ ID NO: 54584

SEQ ID NO: 119122 - DNA, 601 bp, Human; identical to SEQ ID NO: 54585

SEQ ID NO: 119123 - DNA, 601 bp, Human; identical to SEQ ID NO: 54586

SEQ ID NO: 119124 - DNA, 601 bp, Human; identical to SEQ ID NO: 54587

SEQ ID NO: 119125 - DNA, 601 bp, Human; identical to SEQ ID NO: 54588

SEQ ID NO: 119126 - DNA, 601 bp, Human; identical to SEQ ID NO: 54589

SEQ ID NO: 119127 - DNA, 601 bp, Human; identical to SEQ ID NO: 54590

SEQ ID NO: 119128 - DNA, 601 bp, Human; identical to SEQ ID NO: 54591

SEQ ID NO: 119129 - DNA, 601 bp, Human; identical to SEQ ID NO: 54592

SEQ ID NO: 119130 - DNA, 601 bp, Human; identical to SEQ ID NO: 54593

SEQ ID NO: 119131 - DNA, 601 bp, Human; identical to SEQ ID NO: 54594

SEQ ID NO: 119132 - DNA, 601 bp, Human; identical to SEQ ID NO: 54595

SEQ ID NO: 119133 - DNA, 601 bp, Human; identical to SEQ ID NO: 17624

SEQ ID NO: 119134 - DNA, 601 bp, Human; identical to SEQ ID NO: 17625

SEQ ID NO: 119135 - DNA, 601 bp, Human; identical to SEQ ID NO: 17626

SEQ ID NO: 119136 - DNA, 601 bp, Human; identical to SEQ ID NO: 17627

SEQ ID NO: 119137 - DNA, 601 bp, Human; identical to SEQ ID NO: 17628

SEQ ID NO: 119138 - DNA, 601 bp, Human; identical to SEQ ID NO: 17629

SEQ ID NO: 119139 - DNA, 601 bp, Human; identical to SEQ ID NO: 17630

SEQ ID NO: 119140 - DNA, 601 bp, Human; identical to SEQ ID NO: 17631

SEQ ID NO: 119141 - DNA, 601 bp, Human; identical to SEQ ID NO: 17632

SEQ ID NO: 119142 - DNA, 601 bp, Human; identical to SEQ ID NO: 17633

SEQ ID NO: 119143 - DNA, 601 bp, Human; identical to SEQ ID NO: 17634

SEQ ID NO: 119144 - DNA, 601 bp, Human; identical to SEQ ID NO: 17635

SEQ ID NO: 119145 - DNA, 601 bp, Human; identical to SEQ ID NO: 17636

SEQ ID NO: 119146 - DNA, 601 bp, Human; identical to SEQ ID NO: 17637

SEQ ID NO: 119147 - DNA, 601 bp, Human; identical to SEQ ID NO: 17638

SEQ ID NO: 119148 - DNA, 601 bp, Human; identical to SEQ ID NO: 17639

SEQ ID NO: 119149 - DNA, 601 bp, Human; identical to SEQ ID NO: 119005

SEQ ID NO: 119150 - DNA, 601 bp, Human; identical to SEQ ID NO: 119006

SEQ ID NO: 119151 - DNA, 601 bp, Human; identical to SEQ ID NO: 119007

SEQ ID NO: 119152 - DNA, 601 bp, Human; identical to SEQ ID NO: 54579

SEQ ID NO: 119153 - DNA, 601 bp, Human; identical to SEQ ID NO: 54580

SEQ ID NO: 119154 - DNA, 601 bp, Human; identical to SEQ ID NO: 54581

SEQ ID NO: 119155 - DNA, 601 bp, Human; identical to SEQ ID NO: 54582

SEQ ID NO: 119156 - DNA, 601 bp, Human; identical to SEQ ID NO: 54583

SEQ ID NO: 119157 - DNA, 601 bp, Human; identical to SEQ ID NO: 54584

SEQ ID NO: 119158 - DNA, 601 bp, Human; identical to SEQ ID NO: 54585

SEQ ID NO: 119159 - DNA, 601 bp, Human; identical to SEQ ID NO: 54586

SEQ ID NO: 119160 - DNA, 601 bp, Human; identical to SEQ ID NO: 54587

SEQ ID NO: 119161 - DNA, 601 bp, Human; identical to SEQ ID NO: 54588

SEQ ID NO: 119162 - DNA, 601 bp, Human; identical to SEQ ID NO: 54589

SEQ ID NO: 119163 - DNA, 601 bp, Human; identical to SEQ ID NO: 54590

SEQ ID NO: 119164 - DNA, 601 bp, Human; identical to SEQ ID NO: 54591

SEQ ID NO: 119165 - DNA, 601 bp, Human; identical to SEQ ID NO: 54592

SEQ ID NO: 119166 - DNA, 601 bp, Human; identical to SEQ ID NO: 54593

SEQ ID NO: 119167 - DNA, 601 bp, Human; identical to SEQ ID NO: 54594

SEQ ID NO: 119168 - DNA, 601 bp, Human; identical to SEQ ID NO: 54595

SEQ ID NO: 119169 - DNA, 601 bp, Human; identical to SEQ ID NO: 17624

SEQ ID NO: 119170 - DNA, 601 bp, Human; identical to SEQ ID NO: 17625

SEQ ID NO: 119171 - DNA, 601 bp, Human; identical to SEQ ID NO: 17626

SEQ ID NO: 119172 - DNA, 601 bp, Human; identical to SEQ ID NO: 17627

SEQ ID NO: 119173 - DNA, 601 bp, Human; identical to SEQ ID NO: 17628

SEQ ID NO: 119174 - DNA, 601 bp, Human; identical to SEQ ID NO: 17629

SEQ ID NO: 119175 - DNA, 601 bp, Human; identical to SEQ ID NO: 17630

SEQ ID NO: 119176 - DNA, 601 bp, Human; identical to SEQ ID NO: 17631

SEQ ID NO: 119177 - DNA, 601 bp, Human; identical to SEQ ID NO: 17632

SEQ ID NO: 119178 - DNA, 601 bp, Human; identical to SEQ ID NO: 17633

SEQ ID NO: 119179 - DNA, 601 bp, Human; identical to SEQ ID NO: 17634

SEQ ID NO: 119180 - DNA, 601 bp, Human; identical to SEQ ID NO: 17635

SEQ ID NO: 119181 - DNA, 601 bp, Human; identical to SEQ ID NO: 17636

SEQ ID NO: 119182 - DNA, 601 bp, Human; identical to SEQ ID NO: 17637

SEQ ID NO: 119183 - DNA, 601 bp, Human; identical to SEQ ID NO: 17638

SEQ ID NO: 119184 - DNA, 601 bp, Human; identical to SEQ ID NO: 17639

SEQ ID NO: 119185 - DNA, 601 bp, Human; identical to SEQ ID NO: 119005

SEQ ID NO: 119186 - DNA, 601 bp, Human; identical to SEQ ID NO: 119006

SEQ ID NO: 119187 - DNA, 601 bp, Human; identical to SEQ ID NO: 119007

SEQ ID NO: 119188 - DNA, 601 bp, Human; identical to SEQ ID NO: 54579

SEQ ID NO: 119189 - DNA, 601 bp, Human; identical to SEQ ID NO: 54580

SEQ ID NO: 119190 - DNA, 601 bp, Human; identical to SEQ ID NO: 54581

SEQ ID NO: 119191 - DNA, 601 bp, Human; identical to SEQ ID NO: 54582

SEQ ID NO: 119192 - DNA, 601 bp, Human; identical to SEQ ID NO: 54583

SEQ ID NO: 119193 - DNA, 601 bp, Human; identical to SEQ ID NO: 54584

SEQ ID NO: 119194 - DNA, 601 bp, Human; identical to SEQ ID NO: 54585

SEQ ID NO: 119195 - DNA, 601 bp, Human; identical to SEQ ID NO: 54586

SEQ ID NO: 119196 - DNA, 601 bp, Human; identical to SEQ ID NO: 54587

SEQ ID NO: 119197 - DNA, 601 bp, Human; identical to SEQ ID NO: 54588

SEQ ID NO: 119198 - DNA, 601 bp, Human; identical to SEQ ID NO: 54589

SEQ ID NO: 119199 - DNA, 601 bp, Human; identical to SEQ ID NO: 54590

SEQ ID NO: 119200 - DNA, 601 bp, Human; identical to SEQ ID NO: 54591

SEQ ID NO: 119201 - DNA, 601 bp, Human; identical to SEQ ID NO: 54592

SEQ ID NO: 119202 - DNA, 601 bp, Human; identical to SEQ ID NO: 54593

SEQ ID NO: 119203 - DNA, 601 bp, Human; identical to SEQ ID NO: 54594

SEQ ID NO: 119204 - DNA, 601 bp, Human; identical to SEQ ID NO: 54595

SEQ ID NO: 119205 - DNA, 601 bp, Human; identical to SEQ ID NO: 17624

SEQ ID NO: 119206 - DNA, 601 bp, Human; identical to SEQ ID NO: 17625

SEQ ID NO: 119207 - DNA, 601 bp, Human; identical to SEQ ID NO: 17626

SEQ ID NO: 119208 - DNA, 601 bp, Human; identical to SEQ ID NO: 17627

SEQ ID NO: 119209 - DNA, 601 bp, Human; identical to SEQ ID NO: 17628

SEQ ID NO: 119210 - DNA, 601 bp, Human; identical to SEQ ID NO: 17629

SEQ ID NO: 119211 - DNA, 601 bp, Human; identical to SEQ ID NO: 17630

SEQ ID NO: 119212 - DNA, 601 bp, Human; identical to SEQ ID NO: 17631

SEQ ID NO: 119213 - DNA, 601 bp, Human; identical to SEQ ID NO: 17632

SEQ ID NO: 119214 - DNA, 601 bp, Human; identical to SEQ ID NO: 17633

SEQ ID NO: 119215 - DNA, 601 bp, Human; identical to SEQ ID NO: 17634

SEQ ID NO: 119216 - DNA, 601 bp, Human; identical to SEQ ID NO: 17635

SEQ ID NO: 119217 - DNA, 601 bp, Human; identical to SEQ ID NO: 17636

SEQ ID NO: 119218 - DNA, 601 bp, Human; identical to SEQ ID NO: 17637

SEQ ID NO: 119219 - DNA, 601 bp, Human; identical to SEQ ID NO: 17638

SEQ ID NO: 119220 - DNA, 601 bp, Human; identical to SEQ ID NO: 17639

SEQ ID NO: 119221 - DNA, 601 bp, Human
agttctatttaaaaatcttaaaatagtaatgtagaataaatgctggggagaaaattgtccaatagtcattttccaattcattttcctaaatcactaatacaaattatctcaggtaatataccacaggataacataagtacaccgtatactaccggttggcaatctaggcattattatctttaaggtaaatttaaattaacttggttttttgttttcttgttttttgtagagacaggatttcaccttgttgtccaggctggtcttgaactcctggactcaaacagcctgcctgccttggcctctctaagtgctgggatcataggcatgagccactgcacccagcctaacttgtcatttttaagacttaaataataacaaagcaaataagtccctgttttaaaactttgtctttctatgtttttttttgtgaccaacatattgatacttaactgtgaattcttactttgtgactactgtaaaactttaacacaactttatttggtggcaagcacccatattgattaaactgaatttccatttataactttttaaaaacttaactaaacatgaaaaatttttcttcttttcaggctatctttgt

SEQ ID NO: 119222 - DNA, 601 bp, Human
ttctatttaaaaatcttaaaatagtaatgtagaataaatgctggggagaaaattgtccaatagtcattttccaattcattttcctaaatcactaatacaaattatctcaggtaatataccacaggataacataagtacaccgtatactaccggttggcaatctaggcattattatctttaaggtaaatttaaattaacttggttttttgttttcttgttttttgtagagacaggatttcaccttgttgtccaggctggtcttgaactcctggactcaaacagcctgcctgccttggcctctctaagtgctgggatcataggcatgagccactgcacccagcctaacttgtcatttttaagacttaaataataacaaagcaaataagtccctgttttaaaactttgtctttctatgtttttttttgtgaccaacatattgatacttaactgtgaattcttactttgtgactactgtaaaactttaacacaactttatttggtggcaagcacccatattgattaaactgaatttccatttataactttttaaaaacttaactaaacatgaaaaatttttcttcttttcaggctatctttgtca

SEQ ID NO: 119223 - DNA, 601 bp, Human
ctatttaaaaatcttaaaatagtaatgtagaataaatgctggggagaaaattgtccaatagtcattttccaattcattttcctaaatcactaatacaaattatctcaggtaatataccacaggataacataagtacaccgtatactaccggttggcaatctaggcattattatctttaaggtaaatttaaattaacttggttttttgttttcttgttttttgtagagacaggatttcaccttgttgtccaggctggtcttgaactcctggactcaaacagcctgcctgccttggcctctctaagtgctgggatcataggcatgagccactgcacccagcctaacttgtcatttttaagacttaaataataacaaagcaaataagtccctgttttaaaactttgtctttctatgtttttttttgtgaccaacatattgatacttaactgtgaattcttactttgtgactactgtaaaactttaacacaactttatttggtggcaagcacccatattgattaaactgaatttccatttataactttttaaaaacttaactaaacatgaaaaatttttcttcttttcaggctatctttgtcacg

SEQ ID NO: 119224 - DNA, 601 bp, Human
tgaaattttggtgcacccatcaccagagcagtatacaatgtacccaatgtgaagtcttttatccttcatcccccttccacctgttccccaccagcccccgaagtccaatgtatcattcttatgcctttgtgtcctcaaagtttacctcctgtttatgagtgagaacatatgatgtttggttttccattcctgagttacttcacttagaataatagtctccagtgaccgggtgcagtcactcacacccgtaatcccagcactttgggaggccgaggccggcagatcacgaagtcagaagatmgagactatcctggacaacatggtgaaaccccgtctctactaaaaatacaaaaattagctgggcatggtggcacgtgcctatagtcccagctacttgggaggctgaggtaggagaattgctttgacaggaggcaggggttgcagtgagccgagatcgcaccactgcactccagcctggcaacagagcgagactctgtctcaaaaaaaaaaaaaaaagaataatagtctccagttccacccgggttgctgtgaatgccattttgttccttttcatggctgagtagtattccatggcatgtgt

SEQ ID NO: 119225 - DNA, 601 bp, Human
catcaccagagcagtatacaatgtacccaatgtgaagtcttttatccttcatcccccttccacctgttccccaccagcccccgaagtccaatgtatcattcttatgcctttgtgtcctcaaagtttacctcctgtttatgagtgagaacatatgatgtttggttttccattcctgagttacttcacttagaataatagtctccagtgaccgggtgcagtcactcacacccgtaatcccagcactttgggaggccgaggccggcagatcacgaagtcagaagatagagactatcctggacaacatggtgaaaccccgtctctactaaaaatacaaaaattagctgggcatggtggcacgtgcctatagtcccagctacttgggaggctgaggtaggagaattgctttgacaggaggcaggggttgcagtgagccgagatcgcaccactgcactccagcctggcaacagagcgagactctgtctcaaaaaaaaaaaaaaaagaataatagtctccagttccacccgggttgctgtgaatgccattttgttccttttcatggctgagtagtattccatggcatgtgtgtgcgtgtgtgtgtgtg

SEQ ID NO: 119226 - DNA, 601 bp, Human
ttctctaattttgtcttcacactttatttcattaagttggtctccaatctctgatatcctttcttctgcttgatcgattcagctattgatacttgtgtatgcatcacgaagttctcctgctgtgtttttcagctccatcaggtcatttatgttcttctctaaactggttattatagttagcagttcctctaaccttttatcaagtttcttagtttccttgcattgggttagaacatgctcctttaacttggaggagtttgttattacccaccttctgaagcctacttctgtcagttcatcraactcattctctgtccagttttgttcccttgctggcgaggagttgtgatcctttggaggagaagaggtattctggtttttggaattttcagcctttttgctctggtttttcctcatcttcgcggatttatctacgtttggtctttgatgttggtgacttttgaatgggggtttctgcgtgggcgtcctttccgttgatgttgatgctattgctttctgtttgttagttttccttgtaacagtcaggcccctcttctgcaggtctgctggagtttgctcgaggtccactccagaccctgtt

SEQ ID NO: 119227 - DNA, 601 bp, Human
agtttgttattacccaccttctgaagcctacttctgtcagttcatcgaactcattctctgtccagttttgttcccttgctggcgaggagttgtgatcctttggaggagaagaggtattctggtttttggaattttcagcctttttgctctggtttttcctcatcttcgcggatttatctacgtttggtctttgatgttggtgacttttgaatgggggtttctgcgtgggcgtcctttccgttgatgttgatgctattgctttctgtttgttagttttccttgtaacagtcaggcccctctyctgcaggtctgctggagtttgctcgaggtccactccagaccctgttttcctgggtatcaccagtggaggctgcagaacagcaaagattgctgcctgctccttcctctggaagtttcgtcccagaggggcacctgccggatgccagctggagttctcctgtacgaagtgtctgtcgacccctgctgggaggtgtctccccgttaggaggcgcggggttcagggacccacttgaggaggcagtctgtcccttagcaaagctcgagcactgtgctgggagatctgttgctctcttcggagcca

SEQ ID NO: 119228 - DNA, 601 bp, Human
tcttcgcggatttatctacgtttggtctttgatgttggtgacttttgaatgggggtttctgcgtgggcgtcctttccgttgatgttgatgctattgctttctgtttgttagttttccttgtaacagtcaggcccctcttctgcaggtctgctggagtttgctcgaggtccactccagaccctgttttcctgggtatcaccagtggaggctgcagaacagcaaagattgctgcctgctccttcctctggaagtttcgtcccagaggggcacctgccggatgccagctggagttctcctgtaygaagtgtctgtcgacccctgctgggaggtgtctccccgttaggaggcgcggggttcagggacccacttgaggaggcagtctgtcccttagcaaagctcgagcactgtgctgggagatctgttgctctcttcggagccagcaggcagaaatgtttaagtctgctgaagctgtgcccacagccatcccttccgccaggtgctctctcctagggagaagggagtttatctataagcccctgactggaactgctgcctttctttcagagatgccctgcccagagtggaggaatctagagaggca

SEQ ID NO: 119229 - DNA, 601 bp, Human
tgacttttgaatgggggtttctgcgtgggcgtcctttccgttgatgttgatgctattgctttctgtttgttagttttccttgtaacagtcaggcccctcttctgcaggtctgctggagtttgctcgaggtccactccagaccctgttttcctgggtatcaccagtggaggctgcagaacagcaaagattgctgcctgctccttcctctggaagtttcgtcccagaggggcacctgccggatgccagctggagttctcctgtacgaagtgtctgtcgacccctgctgggaggtgtctcccckttaggaggcgcggggttcagggacccacttgaggaggcagtctgtcccttagcaaagctcgagcactgtgctgggagatctgttgctctcttcggagccagcaggcagaaatgtttaagtctgctgaagctgtgcccacagccatcccttccgccaggtgctctctcctagggagaagggagtttatctataagcccctgactggaactgctgcctttctttcagagatgccctgcccagagtggaggaatctagagaggcagtctggctaccatggcttttccacactgtggtgggttc

SEQ ID NO: 119230 - DNA, 601 bp, Human
ctgcccagagtggaggaatctagagaggcagtctggctaccatggcttttccacactgtggtgggttccgcacccagttcaaacttccgactggctttgtttacactgtgaggggaaaactgcccactcaagcctcaataatggtggatgcccctccccccaccaagctggaacatcccaggttgacttcagactgctgtgctggcagtgagaatttcaagccagtggatcttagcttgttgggctccgttgggggtgggatccacagagcaagaccactcagctccctggcttcagcccyctttccaggggagtgaatggttctgtcttgctggcattccaagtaccactcagttggaaatgcagaaatcacccgtcttctttctgcattggtcttgctgggagctgcagaccagagctgttcctattcagccatcttgcccgggaatcccacattttctttatctactcattaattgatgggcatttgggctggttttacatttttgcagttggaaattatgttgctataaacatgtgtgtgcaagtatctttttcatataatgacttcttttcctctgggtatatacctagttgtagg

SEQ ID NO: 119231 - DNA, 601 bp, Human
catccgtgccaacaatatatttagaacaagtatttggtcaactaacacatcattctctatactgggcaataagtaaatttcacagaccatcagcactggggaacacactttgcgaagccctcatggtggactatagttaaaggaacatagatctacctttcagcccttccagatctgcagtcacagccctacacttgtactttgccaatcttaataaagcttaaagcctggagtacaaatgaggctgaggactacaaccaggtacttgttacagaagaaacacagaatacagaatccttgmttaggatgaatccctgtaattatattcctagaaatataagaaattgaaattcatattcaaaatataattgaaacatataaatgattacgtgaaatgactttataaagtagctatataagtgtttaaacatacctgttacatatgacgaaaaactgacttttttacttgctttattattacttataggttgtaaatttaaagatgttagaagaaatgtccaaaaagatacaggtaggtataatatcacgcaaccacactcatgggttttttaaatgaatagcattgaaaaactctctgtca

SEQ ID NO: 119232 - DNA, 601 bp, Human
atgaggctgaggactacaaccaggtacttgttacagaagaaacacagaatacagaatccttgcttaggatgaatccctgtaattatattcctagaaatataagaaattgaaattcatattcaaaatataattgaaacatataaatgattacgtgaaatgactttataaagtagctatataagtgtttaaacatacctgttacatatgacgaaaaactgacttttttacttgctttattattacttataggttgtaaatttaaagatgttagaagaaatgtccaaaaagatacaggtaggtrtaatatcacgcaaccacactcatgggttttttaaatgaatagcattgaaaaactctctgtcaaaaagaacaaatcagtttttttttaatataaaaataagttttcaatattgtgtgaagttccaaactatagacttattctgatatgtaaagaggtatttgtgaagaccatcatttacctaaccatggagttgcttttcactgattgttgtagttatattatacatataaactacatttgaggttagaatgtagaagttggcatgaaaaaaagtatgtaaataggaaactgacatattgc

SEQ ID NO: 119233 - DNA, 601 bp, Human
attcctagaaatataagaaattgaaattcatattcaaaatataattgaaacatataaatgattacgtgaaatgactttataaagtagctatataagtgtttaaacatacctgttacatatgacgaaaaactgacttttttacttgctttattattacttataggttgtaaatttaaagatgttagaagaaatgtccaaaaagatacaggtaggtataatatcacgcaaccacactcatgggttttttaaatgaatagcattgaaaaactctctgtcaaaaagaacaaatcagtttttttttaatataaaaataagttttcaatattgtgtgaagttccaaactatagacttattctgatatgtaaagaggtatttgtgaagaccatcatttacctaaccatggagttgcttttcactgattgttgtagttatattatacatataaactacatttgaggttagaatgtagaagttggcatgaaaaaaagtatgtaaataggaaactgacatattgctccccccaggtctttactgttccttgcagacttgactgtggtagtagaaattaaacatgagctgggaactccaagttagcagtgaa

SEQ ID NO: 119234 - DNA, 545 bp, Human
tatttgctactcaattttaagtgttttaagagttattttatgccaggcatggtggctcatgcctgtaatcccagcactttgggaggcggaggcgggcagatcaactgaggtcgggagttcaagaccagcctgacaaacatggtgaaaccccgtctctactaaaaatacaaaattagctgggcgtggtgacacatgcttgtaatcccagctacttgagaggctgaggcaggagaatcacttgaacstgggaggcagaggttgcagtgagctgagatcgtgccattgcactccggcctggtgacagagcaagactccatctcaaaaaaaaaaaaaaaaaaaaagagggggggttattttaaagcagtattcattgcaaaaaaaaattttttgcaagaacagcaattgacttattttgaaattcagtaaaaggcattttgacttgtaatatgaggtttaattctagaccccttttgattcagacatatcaataggcacttcagatttatagattgtcatttggtattagtttggcttaagaaatttaa

SEQ ID NO: 119235 - DNA, 601 bp, Human
gtcatagctcactgtagccttgaactgccgggctcaagcgatcctcccacctcaggctcccgagtagctaggacttcaggtgtgcgccaccgtgccaggcttttttttttttttttttttggagagacagggtctcactttattgccaaagctggtcttaaactactggactcaagcagtcctcccaccttggcctcccaaagtgctgggattataggcctgagccatcatgcccagcctctccctttatatggtagatccagatctctgaaacagttctatgtctggaacactttgtggraagcaagttcacgagtaagactaggggtcaatacctattcagtcctctatttcacatcctaaagcaaaatatatatctacagctttacctacaatacaatacaatacaatacagtaattgatgtccataacgataagtcatccacactaaattaggctcagtataccctctaagtacattaggaagcatgtaatacattttttaggatctttgaaaatgacttaaatgaatagttttgctactgaggattaatctccatttttctggaaaatccagttatacaaaactgctaatttcttt

SEQ ID NO: 119236 - DNA, 601 bp, Human
gcactccagcctgggcgacaaagtgagaccctgtctcaaaaaaaaaaaaaaatcaaatgatgcttcaaatccaaaaagttcacctctcttctcttgaaaacaaactacatggccatggccagatgtatatatgaatatccatatgttttacatctttaacattgcagataattaagtccatattactacagactcagtttatcacctcagcattctgtggcaaacaggcttgctggtgttagcaatgcagtttccacatctcaataaggatatgaaatgagatgattggcagagtaagaayatcttttgggaggctattaaaactccaaataaattatttaaagcttttattttgcttatctgctgagattagcaatacagtttgtttttaaaaaatattgtctatgaaaattatccctagtgcattatgtcatcacaaaaaagcagaagactagggcttctataaattgagaaatggattttgttaaatataccagttacttgctacagaaagtgctctgtccttcttaccaggggggaaaaatgttagcaaaaataatgccattatgtactgttttaatcttatttggtcctgtaagta

SEQ ID NO: 119237 - DNA, 601 bp, Human
ctagaccagaagagctccttctatcactgggcaaagtctcataaaagtagcttagttgctttcaatagtctaaggtgggctggttgcagtggctcacgctagtaattccagcattttgagaggccaaggcaggcagatcacttgaggccaggagttcaagaccagcctggccaacacagcaaaaccctgtctctaccaaaaaatacaaaaattagccaggcatggtggtgcatgcctgtagtcccaactactcagtaggctgaagcaggagaattgcttgaacctgggagtggaggtttcrgtgagctgagatcgcgccactgcactccagcctgagtgacagagtaagaccctatctcaaaaaaaaaaaaaaaaatactctaaggtggaaaatcgatgtctccatctaagtatttccatggcatagcacataccaacacaggagtcacactttatccagcagttactggtccatcttgttgaaagctgacaaagaacagcagcttcagtggaggggcatagagctcaagtggaatctaacacctgtattgtgaaagaaagagactttccaagaatctttatagcccggtatattaataca

SEQ ID NO: 119238 - DNA, 601 bp, Human
ctccctctacaggcaagtttaaggttgactcgattccatttcaggagctgatcaatgccctactgcatgcccaaaccaaatttactaggagggtttattgtgtcccaaagatttggtattaaaagtattaccaaggtacaataaccattttagatctttacacacatcttggaattgaagtggcaagaataactgtccctagaaataataagtgctggagccaccaagatttgcagcaattctatccaaggctgagaaggaaaccccaccactcagtgaagccaccattttaaaaaaaaaacatagatcgatatgcaattggaacactgctaactctgtgacagcttcagaaagaaaagccatgaattcagctggctgctggcagcctcatccagggttgcctagaccagaagagctccttctatcactgggcaaagtctcataaaagtagcttagttgctttcaatagtctaaggtgggctggttgcagtggctcacgctagtaattccagcattttgagaggccaaggcaggcagatcacttgaggccaggagttcaagaccagcctggccaacacagcaaaaccctgtctctaccaaa

SEQ ID NO: 119239 - DNA, 601 bp, Human
cctgggagctctccctctacaggcaagtttaaggttgactcgattccatttcaggagctgatcaatgccctactgcatgcccaaaccaaatttactaggagggtttattgtgtcccaaagatttggtattaaaagtattaccaaggtacaataaccattttagatctttacacacatcttggaattgaagtggcaagaataactgtccctagaaataataagtgctggagccaccaagatttgcagcaattctatccaaggctgagaaggaaaccccaccactcagtgaagccaccatttwaaaaaaaaaacatagatcgatatgcaattggaacactgctaactctgtgacagcttcagaaagaaaagccatgaattcagctggctgctggcagcctcatccagggttgcctagaccagaagagctccttctatcactgggcaaagtctcataaaagtagcttagttgctttcaatagtctaaggtgggctggttgcagtggctcacgctagtaattccagcattttgagaggccaaggcaggcagatcacttgaggccaggagttcaagaccagcctggccaacacagcaaaaccctgt

SEQ ID NO: 119240 - DNA, 601 bp, Human
accagaatgtaagccccatgaggggtggattcaagtctgctttggtaaccactacattgctagtgtcaggcacatcctatgccatattggttgaatcaaaggaaagatggatgtatgaataggtgggactggcataaccttgagtgaaatttatgtattgtatttttgtattgcaggagtgttttgtggggtcacaaagatagaatctagaagtgcagaaactatgtctatgaggatcccacccagacttcagagggaagtagggttagtatttgagactagagaatctccttgacctcaygttgcctctgagaattagaagtatctgaattatgtcttccaaactccattattataagttaggttgatctatgtgaggaacagaggagaaaaaagcctggatagggaattaggattgccatttattaataaataggatcattatttcttggaggcataaaaatgtttgctgcctgggagctctccctctacaggcaagtttaaggttgactcgattccatttcaggagctgatcaatgccctactgcatgcccaaaccaaatttactaggagggtttattgtgtcccaaagatttggtat

SEQ ID NO: 119241 - DNA, 601 bp, Human
ccagctcttgccacagttgacttctcagtttcctccttctcagaggccttctctgaccttcctaagtgccacccaccaccaggtagtctcttacacatcactctgttgattttcttcttaatgtctactccctcttccaccagaatgtaagccccatgaggggtggattcaagtctgctttggtaaccactacattgctagtgtcaggcacatcctatgccatattggttgaatcaaaggaaagatggatgtatgaataggtgggactggcataaccttgagtgaaatttatgtattgtayttttgtattgcaggagtgttttgtggggtcacaaagatagaatctagaagtgcagaaactatgtctatgaggatcccacccagacttcagagggaagtagggttagtatttgagactagagaatctccttgacctcatgttgcctctgagaattagaagtatctgaattatgtcttccaaactccattattataagttaggttgatctatgtgaggaacagaggagaaaaaagcctggatagggaattaggattgccatttattaataaataggatcattatttcttggaggcataaaaa

SEQ ID NO: 119242 - DNA, 601 bp, Human
atcccagcactttgggaggccaaagcgggtggatcacgaggtcaggagatcaagactatcctggctaacacggtgaaatcccatccctactaaaaaaatacaaaaaaaaaaaaaaattagccaggcgtggtggtggacgcctgtagtcccagctactcgggaggctgaggcaggagaatggcgtgaacccaggaggcggagcttgaagtgagctgagatcatgccactacactccagcctgggcaacagagcgagactccatctcaacaaacaaacaaacaaacaaaaaaaaaaaaaaaaagaagtagaggttgaatattttcatggcaaccactggatggcaatagacattaacagtgagtggggataatcaatacaaaagcatctttctgctttacttgattttctttgcgttttcagaagtagaatcaaactgagctcctagagatgttagggagaggtaaacaagagtgaatttggaagtgaaagaattaggttttggggcacatactctgcttttgcaagtgctttgtaggcagataaatctcccaagatttcagtgctcagccaagagttgtaagaaaatgaagtgcctgccaga

SEQ ID NO: 119243 - DNA, 601 bp, Human
ccacacagcaggaggggagcggcaggtgagtgagcatttcttcctgagctctacctcctgtccaatcagcagtgacactaggagattagattctcataggagcgtgaaccttattgtaaactgcacaagcaagggatctaggctgtatgctccttatgagactctaatgcctgatgctttgaggtggaacagtttcatcctgaaaccatcccaccctcccaccttcccatggaaaaactgtcttccatgaaacttgtccctggtaccaaaagggttggggactactgatataaactacagrggcaaatatatacagtgggagagacaaaacttaatagttcaggtgaatgaccttatgtctcatcccagaggcaaatcagttccaatttgacagaggaacagtaaggctggaacctcaaaagtgtctctttctcagagaactttgccctcaggctctaggtttggctctgagactttcctcatcaacaagtccctttatgtttttagccagagtagtgggccctgaggaaaagatgtctccataagaactaaaatgtaaatcataacaggacttataaatcattcaaagccaagatttttg

SEQ ID NO: 119244 - DNA, 601 bp, Human
ttattattaaaataaatatttaaatagcaacaacattagaggataagcactttacctaaattatctcaaataatcatcccaagaatccagtgatgtaggtactattatctcctttgaacagacaaaaaaatcgaaatgcagacaggttaacttgtccagagtcacatagctagtagtaagtggagaaggtaagacccagatccaattggcgcacgattctttaacgcagtgaaaaggggatgtgcaatcaaaacgatacggtgtcttgagggagggaatctagacaaggggccactggtgrgggaaaggacctcaggcatggggttgggagcagctgctgtgattctagttgcggattcccagtcctttgaaaacagaacagtttcacaggatgccaaagcatgatggaaatttccgatgagaacaatctactctttttgctccaggcaataatgagctgagctccccactaggatgaagttcccctcatacatttccagtgtaactcataacttggcattctggtttcgaccagactcagacaagcttcagaacacttactgctgagaatgggtccttggactaaggaaaatactgcaaa

SEQ ID NO: 119245 - DNA, 601 bp, Human
atgagtaactgtattagattctcccaaagccccatctcattgtataattattattaaaataaatatttaaatagcaacaacattagaggataagcactttacctaaattatctcaaataatcatcccaagaatccagtgatgtaggtactattatctcctttgaacagacaaaaaaatcgaaatgcagacaggttaacttgtccagagtcacatagctagtagtaagtggagaaggtaagacccagatccaattggcgcacgattctttaacgcagtgaaaaggggatgtgcaatcaaaasgatacggtgtcttgagggagggaatctagacaaggggccactggtgggggaaaggacctcaggcatggggttgggagcagctgctgtgattctagttgcggattcccagtcctttgaaaacagaacagtttcacaggatgccaaagcatgatggaaatttccgatgagaacaatctactctttttgctccaggcaataatgagctgagctccccactaggatgaagttcccctcatacatttccagtgtaactcataacttggcattctggtttcgaccagactcagacaagcttcagaa

SEQ ID NO: 119246 - DNA, 601 bp, Human
ggtggggcatgcctgtaatcccagctacttgggaggctaaggcaggagaactgcttgaacctgggaggtggaggttacagtgagctgaaatcactcccattgcactccagcctgggtgacaagagtgaaactccatctcaaaaaaaaaaaaaaaaatgagtaactgtattagattctcccaaagccccatctcattgtataattattattaaaataaatatttaaatagcaacaacattagaggataagcactttacctaaattatctcaaataatcatcccaagaatccagtgatgtagrtactattatctcctttgaacagacaaaaaaatcgaaatgcagacaggttaacttgtccagagtcacatagctagtagtaagtggagaaggtaagacccagatccaattggcgcacgattctttaacgcagtgaaaaggggatgtgcaatcaaaacgatacggtgtcttgagggagggaatctagacaaggggccactggtgggggaaaggacctcaggcatggggttgggagcagctgctgtgattctagttgcggattcccagtcctttgaaaacagaacagtttcacaggatgccaaa

SEQ ID NO: 119247 - DNA, 601 bp, Human
ataagtaattaggccgggcgtggtggctcacacctataatcccagcactcaggtaggctgatcacctgaggtcaggagtttgagaccagcctgggcaacatggtgaaaccctgtctctactaaaaatacaaaattagctgggtgtggtggggcatgcctgtaatcccagctacttgggaggctaaggcaggagaactgcttgaacctgggaggtggaggttacagtgagctgaaatcactcccattgcactccagcctgggtgacaagagtgaaactccatctcaaaaaaaaaaaaaaaaatgagtaactgtattagattctcccaaagccccatctcattgtataattattattaaaataaatatttaaatagcaacaacattagaggataagcactttacctaaattatctcaaataatcatcccaagaatccagtgatgtaggtactattatctcctttgaacagacaaaaaaatcgaaatgcagacaggttaacttgtccagagtcacatagctagtagtaagtggagaaggtaagacccagatccaattggcgcacgattctttaacgcagtgaaaaggggatgtgcaatcaaaac

SEQ ID NO: 119248 - DNA, 601 bp, Human
cagtcaatcaaactgtgacataggaagaaaacttgcaaacttactaactgaaatgttatgaaacagtatgttgcagaaagtattcctgcattaaataagtaattaggccgggcgtggtggctcacacctataatcccagcactcaggtaggctgatcacctgaggtcaggagtttgagaccagcctgggcaacatggtgaaaccctgtctctactaaaaatacaaaattagctgggtgtggtggggcatgcctgtaatcccagctacttgggaggctaaggcaggagaactgcttgaaccygggaggtggaggttacagtgagctgaaatcactcccattgcactccagcctgggtgacaagagtgaaactccatctcaaaaaaaaaaaaaaaaatgagtaactgtattagattctcccaaagccccatctcattgtataattattattaaaataaatatttaaatagcaacaacattagaggataagcactttacctaaattatctcaaataatcatcccaagaatccagtgatgtaggtactattatctcctttgaacagacaaaaaaatcgaaatgcagacaggttaacttgtccaga

SEQ ID NO: 119249 - DNA, 601 bp, Human
gatagagctaagtggtatccaaccctggctggacattttaaatcagctggggcatactagaaaatactgatctacagatgttatatccacatattatattctgagatattatgggtgaggaactaagcatatatttattgaaaactacagtcaacagaaaatgacaaattgggtcagctggctttaggaaacctcccgagaggcaacctgtcccacaatatactttggaaagagcttattagtgagatcaattcaacttccgataaattgttggaaagcagtcaatcaaactgtgacatargaagaaaacttgcaaacttactaactgaaatgttatgaaacagtatgttgcagaaagtattcctgcattaaataagtaattaggccgggcgtggtggctcacacctataatcccagcactcaggtaggctgatcacctgaggtcaggagtttgagaccagcctgggcaacatggtgaaaccctgtctctactaaaaatacaaaattagctgggtgtggtggggcatgcctgtaatcccagctacttgggaggctaaggcaggagaactgcttgaacctgggaggtggaggttacagtgag

SEQ ID NO: 119250 - DNA, 601 bp, Human
agagaaatggcagtcatctgaagcattttatgtaagagggatttgtctatctactctaaagaggcaattccatgtttatcacgggaagaacataactgaacctcacccccaaatactacttcaaatattcctaaattttctcattgttcaaagttagcttcccataaaaaataaccatagggctgaacaccttcctttttaattttatttccctccctccctcccttccttccttccttcgttcctttttctttcctcctctcctctcctctccctctttctttcttttttttttttttttgacagactgtcactctgttgcccaggctggagtgcagtggcacgatctcagctcactgaagccttaccctcccaggctcaagtgatcctctcaccttagccttctgagaatttgggagtacaggcgtgcaccaccatacctggccaatttttgtatcttttttttgtaaagatggggttttgtcatgttgctaaggctggtctcaaacacctggctgggtctcccaaagtgttgggattacaggcatgagccactgttcccagccagggctgaaacttctttgcatgtaaagtttcactt

SEQ ID NO: 119251 - DNA, 601 bp, Human
cagctgacattgcataaggtgtaaacacacagcttgttccaattgcttcagtgttagacagcgtggctcatcattttctctcttaactcacacggtgattccactggcaacaggtcagcacctggctctctggggatgccccagtaaagtattgtcaactgaaagtcaggctcaataatatttatagactggcatgagctacccagttgagaagacactcccaaggtttgtaagccatgcaaagaaatgacatccatctgctttgcaaatattatttaaggcttccccctaaaaaggagcyacggaatgcttatttactttctcactgaatctgaggggtagagactatcaagtcccagttactaagaagtcaggaagagaattaaaaatagaaccatggaaacagggatgcactgaagaattctatcaactattctatatgtttgaggaatttcataagaaaatattgggaaaaaagaaaatccatctgatcatcgcatactatacagactgagagaactttctactgctccatattcttattatagttaatgtagtggaaaatagaagttgagagatttttgctcattggctaattaaa

SEQ ID NO: 119252 - DNA, 601 bp, Human
gaagtctgctttgttctccactctctcccctagtgcctagaaaagagcctggcatgcaatgggttctcaatagttgttgatatagcaatggtgctgaatttacaaatgttcactcaccaagagtcagcatcatttgaaataaggaagagaggtctaggaaggagttaactgcttgataattctctctctctctctctttccctctgtctctctcttttacacacacacacacacacacacacacacacacacaaatacatacacacaaacacacacatgcactgaaacagaagtcttcagraaatgaacacctacaatcaaggagacattctgacaacagcctcatccagtattcagtaggaagaaacaggacccaatcagtatgaaagatttgaaaagagattgctgtgttctactgaaactaaaaaaagatagggaattgctgcaagtaagccagatggggtagaatgccatgaaacttacagcagatggcactaaaatattaaactaacatttccttatgctccaagctgagctgtatgttaacgctgtttataggagccagtctatttaaaaacatacagatgaaaaatgaatccgg

SEQ ID NO: 119253 - DNA, 601 bp, Human
tctcactctgagttcacatgagatctgattgtttaaaagagtgtggcacctcccatctcactctcttgctctcactcttgccatttgacatggctgccgtccttcatcttctgattggaagcttcctgaggcctcaccagaatgacatgccagcactatgcttcctgcaaagcctgcagaaccatgagtcaataaaacctcttttctttataaattacccagcttcaggtatttctttgtagcaatgcaaaaacggactaacacattatgtttattgttcttgtctttctccccctacaaraacgtaagttccgtgagagcacaaatcttcattttgttcactgaagtatctcaagtgcctcaaacagtgcctgatgtataagatgtaacaacaaatatttgttatataagtaaaccagctatctatctatctatatggaatgatgtaactgaaattttggttgttagccaacactcatatgaccattatttaaaatggcacactgctcagtcagatattatacagtgaacaggagtgttccaggctgaggcctactcatcagcaatgtgattccacagtttgaagctcctggaaaaacaa

SEQ ID NO: 119254 - DNA, 601 bp, Human
aaatattgagcaagaggaaacccatttgaatctgttccagctggaagcttgttgtcatctatatcaacaaaatagatgttgctggaaacataattttggtggctgaaactgctgcacttttctatatcatcatggttaatatgaatgtgtcttttatcctttgagcgcagggtatactgctcgagtgatgggtgcaccataatctcacaaatcactgctaaagtgcttacataatcaaataccacctgttccccaacaacctatggaaataaaaaaataaaaaataaaataaaataaaaayaaaagttaataaagaaaagaatgtgtcctgcaaatttatgagtcaaactagaatacctttactaggaaatgaaatcacttatctttttcataagaggaaaagaaacaaaacaaaacttgttccatctaatattgagtaacatatttttctgcacttacatttttatgaaaaaaattgtataaacaaatggcataataaagacacagcttgtaacaagttgatgttaagaatttagtgtggaggatggggaagtagcaatatttagaatgtagctcttggccagagatttaactgtcaagc

SEQ ID NO: 119255 - DNA, 601 bp, Human
atgggaaggaacaaatagtcatagctgcctgccatttttcaatagattacaatagctaattttaaaaataaggtgatatagtttggctgtgtcctcacccaaatctcatcttgaactcccacgtgttgtgggagggacatggtgggaggtaattgaattgtgggggcaagtctttcctgtgctcttgctagtgaataagtctcatgagatctgttggttttaaaaagaggagttccccttcacaagctctctctctttgcctgctgccatccatgtaagacgtgacttgctcttccttgcrttctgccatgattgtgaggtttccccagccacgtggaactgtaagtccaagtaaacatttgtcttttgtaaactgcccagtctcaggtatgtctttatcagcagcgcaaaaatggactaatacctaaggcattaagaatcaagctaaaaatgtgcctgaaaaacaattctatcttcctgtaagcactagacttaatgtttatgtgccagataaattcactacaaggttacacttctaaagcatttctgaacttttagttgtaattggcagtctgcattttacctatacaactggagttgc

SEQ ID NO: 119256 - DNA, 601 bp, Human
gatctttttattttatggccctgcatgatacaacatgattagtggataagtaacatcaatatgagataaatttcttactgtcagaactttctaaggatggaaagtcagtttggaaggtggtgagttctctgtactgagaatgttcataagatttttaaaatactggttccctccaacccagaaattctttgactctgaaccttttgtacagttagtttaaaaataaatggtgattccttggtttctacaaataggtaacatcataatcaacacttgatcttttctaatattatgttcaatkggaaggaacaaatagtcatagctgcctgccatttttcaatagattacaatagctaattttaaaaataaggtgatatagtttggctgtgtcctcacccaaatctcatcttgaactcccacgtgttgtgggagggacatggtgggaggtaattgaattgtgggggcaagtctttcctgtgctcttgctagtgaataagtctcatgagatctgttggttttaaaaagaggagttccccttcacaagctctctctctttgcctgctgccatccatgtaagacgtgacttgctcttccttgcatt

SEQ ID NO: 119257 - DNA, 601 bp, Human
caggaagataacatttcattttcctatgaataaatgctgattaatgaatggcaatcagactcttttcttgtacttctcacaaacatctccttctctttcaaaacttggctcaaatatccctcattttggtatgcatcattcacttctcccagataattactggcctctcctttgtgttccttgttcacaactttgttattatacttaatattttataccatggttatttctggatgtctttctcccactgtagagtgatgatgtgcttgagactaccaccatatcctgttcatcactgaaytaagtacagtccattataaagtaaatactgaatatatgtttacagaattgaatttaaatctagagagaagtttcagtggcccattaaaggatttgagctctcaaatctgtcatcactgatatgtaggaagtgagtaatcatactaaagataatgcaacagggatagtaaaagcattgaatgatagaatcctcccaaatatttcaagaaaaatagggttagcctaacaatataaaatttaatggagacaaaatgcaaggcctagtacttccacccaaagtgccaaccataataatgtgaaa

SEQ ID NO: 119258 - DNA, 601 bp, Human
aacattagtaagagcttcctaactgctctcataggggggaaaaaaaacaagaatcacaagatctagaaaatattttaaatgtagtcagccattctgaaataatgtgattgcagtggcattgtcaactagccactacatactcctgagttatttttgattggcttatgttattcacccttctagagtctcatttttttttgtccacttgtctcttcagggaagaactatcaggaagataacatttcattttcctatgaataaatgctgattaatgaatggcaatcagactcttttcttgtamttctcacaaacatctccttctctttcaaaacttggctcaaatatccctcattttggtatgcatcattcacttctcccagataattactggcctctcctttgtgttccttgttcacaactttgttattatacttaatattttataccatggttatttctggatgtctttctcccactgtagagtgatgatgtgcttgagactaccaccatatcctgttcatcactgaactaagtacagtccattataaagtaaatactgaatatatgtttacagaattgaatttaaatctagagagaagtt

SEQ ID NO: 119259 - DNA, 601 bp, Human
gttatgcttccaagatagaggagtctcttacaaagcagattcaggtaaataggataggaaacaatttttcagaatttcctattcttggtccctaaactccaaatttaagaaacattagtaagagcttcctaactgctctcataggggggaaaaaaaacaagaatcacaagatctagaaaatattttaaatgtagtcagccattctgaaataatgtgattgcagtggcattgtcaactagccactacatactcctgagttatttttgattggcttatgttattcacccttctagagtctcawttttttttgtccacttgtctcttcagggaagaactatcaggaagataacatttcattttcctatgaataaatgctgattaatgaatggcaatcagactcttttcttgtacttctcacaaacatctccttctctttcaaaacttggctcaaatatccctcattttggtatgcatcattcacttctcccagataattactggcctctcctttgtgttccttgttcacaactttgttattatacttaatattttataccatggttatttctggatgtctttctcccactgtagagtgatgatg

SEQ ID NO: 119260 - DNA, 601 bp, Human
gaacaaacaactatacaaccttcatcctgcttactcatccactggctttgggcttggctatggcacaggctttggctaatgggatgtgagggaacacgatgttcacttaccacatttgagcagaagcctaaacgtgactgtgtggcttagctagggccgttttgtgccatccttgtatcaggacagcatgtcctagacaggggctgctcctttagcctgggttccaaaacgaaaacatgcatggagctaagccaagctgagcagagcccaaaagacttcagcagaaccaaaccctgatgtrttgtacagaagaaagactacttctcattgtagcccctcagatctgggatttatttgttacaaactagaaaaagctgaagaattccctgacttaataggtgacaaaacattaccatctcttttatctatataaaataaggataaatctttatttttccaataaatattatctgactttattaatccctaaatctacctttgattatatcagcacgattttgctatatattgatattatatttatatatacatatacatacatatatgatacacacacatatcagaaagattataacacttt

SEQ ID NO: 119261 - DNA, 601 bp, Human
tttagccaggcatttcatcactcagctcttattccccagttggtcattcatgactttgttttctaaatcaggatttttttaacttcaataaaatattgattcatgataaactcttagtgaaagtaatgctagtgtaataattaaaagcatcagattacccatctggaagtaaggagagtcatagttctaggcatgtgggaagagggggagaactgttcccaatgggcataaataattgacaaacactctaagaatggagggaagaaatcacatacgtaagtgtgtgtatgcacttacacayacatggcactttttctgagaatcagagatttatcacaatatattttatataacaaagcataattaaatatcgttttcaagaaacatgaattgcaggcttctggaaataattctgaaaatttgcacggtgcaaaaacattaaagcacatcaattacaaaactgagaaaaatgctatatggtgtcttagagcctcacagctcaggttgaaaagaaaatttctgttatattcttataccttctgtgccattcaaaatttgttgctaagtttccaatattatggatcaatttatccttaggatg

SEQ ID NO: 119262 - DNA, 601 bp, Human
tcattcttatgcctttgcatcctcatagcttagctcccacttataagtgagaatatacaatgtttggttttccattcccaagttacttcacttagaataatggtctccacttccatccaggtcactgtgaatgccattattttgttccttcctggtttttacttttttgtacaaggtatgctattaatctggactccaagtccaattcaatatgaatgctgctgtccaaagttttctccttgtggctgagttttgtcttatcatgtttgagacaatgttgctacagaaaaaatgtgcccartacaagaatccctgagaatccaaaggctggtctatgccacaatggatgaatgtgtttagctaaaataggaagtgagcctgctgctccacggcagcacatctgaagatgagttttctgctggactcagaacctgctcagaaccaggctgagttttttagttcccttcacctcaacctcaatttggtttaaaggagatgtatctgaaaaaatgttccatttgggttctgaaatcttactttaatgctaaataccacctttcagcaaagggtcttcatcgccttttccttctttagccaggca

SEQ ID NO: 119263 - DNA, 601 bp, Human
aaaatctaaatcataccacccatactctggaccacagtacaggaaaaataaaaataaacaccaagaagatctctcaaaaccatataactgcatggaaattaaacaacttactccgaatgacttttgggtaaagaacaaaattaaggtataaagaaaaaaaatttttgaaataaatgaaaacagagacacagcataccaaaatttgtggaatggagcaaaaccagcactaagaagaaagtttaaggtgctaaatgcctacctcagaaaggcagatatcaacttaacaatctaatatcccacytacaggaaccaaaaaagtgagaacaaagtaacccaaaagctagaagaggaaaagaaataactaaaatcagagcagaactgaacaaagttgagacccaaaaatccatgcaaacctaacaaacccaaaagttggattcttgaaaacataaacaaaattgatagcccactagctagattaccacagaaaaagagagagaagatccaaataagcacaatcagtagcaaaaaaagttacattacaactgatcccacagaaatataacaaatcctcagagactattatgaacacttctatgcacac

SEQ ID NO: 119264 - DNA, 601 bp, Human
cccaccaaactaagcttcataagtgaaggagagatagattttttccagacaaacaagcactaagggaattcactactattagaccaaccttacaagcgatctttgagagagttctaaacataaaagcaaaagaatgaatgatacctgttaccacaaaaataaacttaagtacacagcccacagaccctataaagcagctacacaatagaaactacaaagcaaccagctaacaacttcacaacaggatcaaaacctcacatatcaatattaatcttgaatgtaatttcctttttttttttttggtagagatgggatcttgttatgttgaacaggatggtcttgaactcttgacctcaagttatactcctgccttggcctcccaaagtgctgggattacaggcatgatccaccacacacagccttaacctagaatgcaaatgccctaaacacctcacttaaaaggcacagagtggcaagttgaatttttaaaaaagtacatcagtctgctgtcttcaagagacccatctcacacataatgacacagataggatcaaaggaaagggtcaaagaaagatctatcatgcaaaaggaaaacaaagag

SEQ ID NO: 119265 - DNA, 601 bp, Human
attccaaccaagaacttcatatcccaccaaactaagcttcataagtgaaggagagatagattttttccagacaaacaagcactaagggaattcactactattagaccaaccttacaagcgatctttgagagagttctaaacataaaagcaaaagaatgaatgatacctgttaccacaaaaataaacttaagtacacagcccacagaccctataaagcagctacacaatagaaactacaaagcaaccagctaacaacttcacaacaggatcaaaacctcacatatcaatattaatcttgaakgtaatttcctttttttttttttggtagagatgggatcttgttatgttgaacaggatggtcttgaactcttgacctcaagttatactcctgccttggcctcccaaagtgctgggattacaggcatgatccaccacacacagccttaacctagaatgcaaatgccctaaacacctcacttaaaaggcacagagtggcaagttgaatttttaaaaaagtacatcagtctgctgtcttcaagagacccatctcacacataatgacacagataggatcaaaggaaagggtcaaagaaagatctat

SEQ ID NO: 119266 - DNA, 601 bp, Human
ggagtttcagccactccccaccaccatgcagagaccttgaggcctaggaggtttcccagctccaaaactaggcacacctctgggtacgtggtggctgcccactgggttctcctttggcgctggtgctcgtgcatgccatcagagggcctgtaaagcctgcctagtccaaccccacccatttgccacctgtcccaccccttccagggctgagcagggagctcagaccaatgtgcacaccataaaccagcccattgcttgaggcaacagagaacttctcccggtaagcaaggctatacccagmcacattggccacagacagctcctacccataggcaccatctactggcttgaggttgaactgcacagcccaagataagacctgtcagcagaagtgcatagggctatagaagcaaagccaaaatatactacccagccttctctgtaatcacatcctccagggagggggtgaaagggaaagggaaagaaagaaaacaacaataatattatagggaaagacagaaaaagaaaaaaccccaaccacacaaaaataatgacaaaaattagaaacgccagcatttccagatgggaaggaacaaatgca

SEQ ID NO: 119267 - DNA, 601 bp, Human
atgtttctccaagccctggaggtaacttggggaaaggcttggaaatgctatgagggaaagacgctgggaaaagctgcagacattttccgaggcctggaaccaagaacaggacaccatttttaatccaggcacattcaaaggcagccattctttagtgacctggcagcatggccacttaggcattttataatagtcttaggtcagagactgaagtgcctgctctggagttgggtagtggcctctgcaaccagagctatggaaagtgcctcagcaggaggtgctggaattgtgctttctcctrttgcaggcccggggtgggaggagagccgctacagctgcatctcatctgggtgatgagacttgtaagccagggctagcttggcaacctggaaccagtctgcacgtgtcattgctgggtgtcccagcctgctcccctgagatcatggtggcagggtcctctctgctccatccccaggcagaaatccaggcatttggagcatctgcttgcctgcgccagcagtctgagccaccccacccttcatggatatagatcatggtgcagaaggaccctctccactccatgcctaggcagatctccagg

SEQ ID NO: 119268 - DNA, 601 bp, Human
gataagctttaattcacaaagtaaatgagaatccactagatttatgaaggacaccccagatctctaggaggaaaacgtgggcaaacagccctcgtgacagtgtctgtctgataaacataagtgaagccccagcacatgagaggagcagagagcctcctctgtgactcacctttccactggggatctgagcagcccaggttaaggaacagcattatgtttctccaagccctggaggtaacttggggaaaggcttggaaatgctatgagggaaagacgctgggaaaagctgcagacattttcygaggcctggaaccaagaacaggacaccatttttaatccaggcacattcaaaggcagccattctttagtgacctggcagcatggccacttaggcattttataatagtcttaggtcagagactgaagtgcctgctctggagttgggtagtggcctctgcaaccagagctatggaaagtgcctcagcaggaggtgctggaattgtgctttctcctattgcaggcccggggtgggaggagagccgctacagctgcatctcatctgggtgatgagacttgtaagccagggctagcttggcaacct

SEQ ID NO: 119269 - DNA, 601 bp, Human
gttgagagcttttcttctgagacctggaacaagacaaagatgaccactcttgtcacttctgttcaacacagtactagaagtttgagccagaccaattaggaaaagaggaagaaataaaaggcatccaaatctgaaaggaagaagctaaattgtctctctttgaagacaacatgaacttgtatatagaaaagtctgaagactccaccaaaaaaactgttagatctaataaatgaatttagtaaagttgcaggaaacaaaatcacatacaaaaatgagtagcatttctatacattaacagtgrattatctgaaaaataaatcaagaaaatattcccctttacaataactacaaaaacatattaggaataaatttaaccaaggaggttaaatgtatatctctacactaaagactgtaaaacattgatgaaagaaattgaaaaagacacaaataaatggaaaaagatctcatattcatgaattagaagaattaatattgttaacatgtccatcctacccaaaagcagtctacagattcaacacaatccctgtcaaaataccaatgaccttcttcaaagaaatagaaaaaacaaaccagaaatctg

SEQ ID NO: 119270 - DNA, 601 bp, Human
aaaaaagctgtaggcattaagattcaataaattctctaatttcacttttcttcatgctttataggtcatattcagctactacaatttcttatgttttatactgtattccatcctcttccctgaatttagttttgttaggattacctccttgagattttttttatatggggtacttgagcaataaagttgtaaagtttaaatgtcagaaaatatcttgattttgcttatacgaataatagttcgggtgggtatagaagtctaagttcaaaatagttttctccatagaaatctgaaatcattstgtactgtcttctcatgtacagtgctgctgatgagaaatataatacgtgcctgattctcatctcttcagtccttgttctccattctttattctctccactctgaaaattttaaaaagtaactttatcccatgatcaagtgggattcatcccagggatgcaagaacggttcaacatatgcaaatcaataaatgtaatacatcacattaacagaatgcaggataagacccatatgataattttagtagatgcagaaaaagcatttaataaaacttaatatgctttcatgatgaaaactctca

SEQ ID NO: 119271 - DNA, 601 bp, Human
ttagactcaaagaaaggaaactgtgatctcgtatcactaaatcccctaccactcaacagaaaaaagctgtaggcattaagattcaataaattctctaatttcacttttcttcatgctttataggtcatattcagctactacaatttcttatgttttatactgtattccatcctcttccctgaatttagttttgttaggattacctccttgagattttttttatatggggtacttgagcaataaagttgtaaagtttaaatgtcagaaaatatcttgattttgcttatacgaataatagttygggtgggtatagaagtctaagttcaaaatagttttctccatagaaatctgaaatcattgtgtactgtcttctcatgtacagtgctgctgatgagaaatataatacgtgcctgattctcatctcttcagtccttgttctccattctttattctctccactctgaaaattttaaaaagtaactttatcccatgatcaagtgggattcatcccagggatgcaagaacggttcaacatatgcaaatcaataaatgtaatacatcacattaacagaatgcaggataagacccatatgataatttt

SEQ ID NO: 119272 - DNA, 601 bp, Human
tattgtattatcatgacttagatattattttctataaaaataagaagcatgtttagactcaaagaaaggaaactgtgatctcgtatcactaaatcccctaccactcaacagaaaaaagctgtaggcattaagattcaataaattctctaatttcacttttcttcatgctttataggtcatattcagctactacaatttcttatgttttatactgtattccatcctcttccctgaatttagttttgttaggattacctccttgagattttttttatatggggtacttgagcaataaagttgyaaagtttaaatgtcagaaaatatcttgattttgcttatacgaataatagttcgggtgggtatagaagtctaagttcaaaatagttttctccatagaaatctgaaatcattgtgtactgtcttctcatgtacagtgctgctgatgagaaatataatacgtgcctgattctcatctcttcagtccttgttctccattctttattctctccactctgaaaattttaaaaagtaactttatcccatgatcaagtgggattcatcccagggatgcaagaacggttcaacatatgcaaatcaataa

SEQ ID NO: 119273 - DNA, 601 bp, Human
tctttgcttttatatagctgaaaaatacattaattaatccatttaaagttgtatgaaggtagtattaattttgtgtattaacacaatgacttattttctgatctaaatatttccaaatcatcctgggataggggaagtgaaatatgcatttctaatataactgacatggaaaatacattttgcagatttgaaatgacgtggattcaatacacatctttatctgtcaattcagtaggcatttaatactagggtttcttttggttttcatttaactttcttttagaaaattgaaaaaaaaaaagcttagttagaatttgtctctggccagtctcaaaacactttgtaatatacttgcctaagatccattcactgtagaattaaatgtcacaaatgatggctttttaccacaacttctgaaaactttctttgtttttcaaaccaggtgagccaagttacaaatctgtttattcatttctatttcctgaaaggttagatcatagagtatttagtattctatctccatagtaggtcccttgaagggcttctttctcttgctttagaattactctcttatttccttagtatctttggtttcaggtag

SEQ ID NO: 119274 - DNA, 601 bp, Human
atttcaagacttagctcaaggttcaactccatttgtcttcctttccttatggcattactatttctggtacatcttctcatgattattttatttatttgaacaagatttattacacatccaatgttataccatgcattgtgctggctgctgggtagatagactacttctgcccccacagaaggattccacttgcctttcctgctgttgaagtttatacctatgtctcctttgaattgctagagggcaggaactgactcatggtcatctttgtatctcccagcttctggcgaaagtagatgcytaataaatgtgtattgaacaaatggaaacaaacacaagtgtttctgtttacattaacacaacaataaaacttaacaagtataaaagttactcataattgccaatgagtaatgtttcacacttcataaaacagaaacaattgtctctagggaacaaaatcaaatgtatacttacagagcacatggttaagcattgctaaaaaaggctttgagaatatgatttgataatttatgagtttcctcataattctatgattaaagtgactaatcatagggaatatagttagtcccactgaactcca

SEQ ID NO: 119275 - DNA, 601 bp, Human
aactgaaattctctcacctgctccatatttcaagacttagctcaaggttcaactccatttgtcttcctttccttatggcattactatttctggtacatcttctcatgattattttatttatttgaacaagatttattacacatccaatgttataccatgcattgtgctggctgctgggtagatagactacttctgcccccacagaaggattccacttgcctttcctgctgttgaagtttatacctatgtctcctttgaattgctagagggcaggaactgactcatggtcatctttgtatcycccagcttctggcgaaagtagatgcctaataaatgtgtattgaacaaatggaaacaaacacaagtgtttctgtttacattaacacaacaataaaacttaacaagtataaaagttactcataattgccaatgagtaatgtttcacacttcataaaacagaaacaattgtctctagggaacaaaatcaaatgtatacttacagagcacatggttaagcattgctaaaaaaggctttgagaatatgatttgataatttatgagtttcctcataattctatgattaaagtgactaatcataggg

SEQ ID NO: 119276 - DNA, 601 bp, Human
acatcagaacacaaggatcatcccagattcctgtttctgtctcactgttcccttcccctaccctcaaaccttgatttctactttccaaatctctcccaaattcatcctctcagctgctacagctttagtttatagtttagaccctcgtcactgctcactagatttttttagtgatcttctaactatccttttggttaccaatctgtccttctcatggagaaatctttctaaacataaatctgatcatggtgctaccctttaagaagctagaagatccagcatgtgctttttaatgtggctscttcccatctccccatcttcatctcccatggctttgccactgacatactttccagaaaaatggaattatcctaattccctgaaatcacatgctatttcaccctttgaggactttacacacattcttttcttcaactgaaattctctcacctgctccatatttcaagacttagctcaaggttcaactccatttgtcttcctttccttatggcattactatttctggtacatcttctcatgattattttatttatttgaacaagatttattacacatccaatgttataccatgcattgtgct

SEQ ID NO: 119277 - DNA, 601 bp, Human
ataggagccttaaaatgttcatatgttttagtatggtaattctatttccagaaatctatctcaagaaaataatttgaaatgaacacaaagccttataaacaaagatactcaatggagtggtatttaaagttttttaaagctaaaatctaaatgttgaacaatagagaatgtgtaactaagtaactgaaaagtgataggcatctttatgctgtcatgaaaaaccatatttatgaagagtttttaataacttgggaaaatgtttatcatatcaagttaaaaaaagaagtatatgaatttatayagccaacataacaagtatacaaaaatatgtacagacataataatagaatatatgttgaaattttgacagtggtggttgaattatggattacagttattttgtcttttataagtttctatattaatagtatgtgtgtgtctatctctatttcccattttctcttttttctctgcttctcttttcatctaagtgctcataaaactacaaatctattttattatttccatatttattaaatacatcttagatttccacatgtacaaatccaacaaaaacttaccaagcattatttgctatgaa

SEQ ID NO: 119278 - DNA, 601 bp, Human
ttattaaaaagggttgaacagtaaaacagcagagtacaaaacaggtgttatattagtaatcactcttaataatttcattgttaatcattgtcactgcaaaaattaacagtgacctgacctatgagaagaagctgaactgtttagctcaaatgaagtctggggatgacttctggatttaagttattcacactcaacctatcacttattgccacagacacttcaaagttcacagttctctgaaatatcataattttccagagcttccatacagacttgcatataattttccagagcttccatrcagaacaatttgaaccttgcaaattgttctcattttatcttaggtctaacaggttgggggttggggtttgtttttcttttttaaaaaaatagaacttcttaaaaaccaggtcagacttatcaacagaatctaaataaggcttggtgtgttgtgcaacctctacaacatagcaacaatgaaatttcactgcaactactgccctcatacccaatagcatttacaatacctctgacaaagtgtgtctatttccatggtacctgttgccatgggagctgagcagtgctcctcctagaacaatca

SEQ ID NO: 119279 - DNA, 601 bp, Human
catacaccctttgacttaggtttcatctttaccattgtatcaatgtttgtaaaataaggctagagactggagctctaacttttctcaatccagactctacctctctccagctaagaccatgaggtctttatttcttctctatgccttaatttccccaactgtgggatgaatctgcttatagtactagtcataggtaccttttaatggttattaaaaagggttgaacagtaaaacagcagagtacaaaacaggtgttatattagtaatcactcttaataatttcattgttaatcattgtcaytgcaaaaattaacagtgacctgacctatgagaagaagctgaactgtttagctcaaatgaagtctggggatgacttctggatttaagttattcacactcaacctatcacttattgccacagacacttcaaagttcacagttctctgaaatatcataattttccagagcttccatacagacttgcatataattttccagagcttccatacagaacaatttgaaccttgcaaattgttctcattttatcttaggtctaacaggttgggggttggggtttgtttttcttttttaaaaaaataga

SEQ ID NO: 119280 - DNA, 601 bp, Human
ttttctcactcccaggatcttggcatctaaatgctattctaggaattttagaaaaataaatagtcaaagctatttacaacaatgactaccacgctgtggcctgagatggtgagtttcacttgaattgccaagaagggaacaagggcgtcatataaaccctggaaaacaagcccagggacaagtcctgttctggggtctggaggatttggaaggctgccaaagcttaggcagtggtggtaggggtgcgtggggaatgtgaaaaggggtcttttctccaaagttttatttaagggttgaatgmtaatgcgaaaatggcctagctcaatcattttagcttctctggcttggccttcctaacagcaagaaagaagccatcaatgagctacaaaacttcatttttcctacaggctggaagtggtctctttttaatatatgttctggattccactgtctgagagaagaaaattgatttaaacatttaggtatctacagacaactcttactgactcaggggccagcgcactcagattgcagattgcagcatccctgtttctctaccttgtgcctcatcctttgtgaattctgaaagctggttgctttt

SEQ ID NO: 119281 - DNA, 601 bp, Human
gttctagatactgaattatctagttcaatatgttctttcatttaacactcacaattaaattgtaaaaataaataatttaataataatatattttataatttaataatacaattttataataatttaataataaattattattaaatcattatttctacttcacagatgaggagcctaagatttggagaggttaagtaacttgtctaaagtcacatcatgtataagtggtggagcttggattgaaactcaggggtatccaattccaacacccagggatcccagccagattatttttattatscattttcacttgaattttatatttaagatataaatcacaagaaaataaattcttacaatggctggaattctgttttaaatgcaaccagctattaagggcatgatctggggtcaacatattcagcctccattcaaacctttagtcctactcaactttcaatcctccaagacaactctctgataacccccactccccatttaatgctgtgttaggtaccactctgtatactttcattattctctttgttttcttgtttgctctgcaactatcctggatgcttcatgaggggaggttcatcat

SEQ ID NO: 119282 - DNA, 601 bp, Human
tatctcaaaattgcaaatggcacagattaaaagacaaagttatctatacaaactataatgaggctagtgtatatgtatcaggtacactcctcacctaaaattaggggaaattgatatctcaatttattcaaaaatacttgttgaaaatgcatattggggccagcacctatctcctctaggtgctggacttaaaagggcaagcaagtcacacatgaaaacaatacagcccagtggggtatgcagatgaatacacacacacacacacacacacacaaacacacacacattatcaaatggtgtkaaaggcaccatgatggaggaagctcagtgagttatggtgcacagaggagtggtggctaaccaagatatggtaaagagggtcagggaaggtttcctggaataaatagtgtctaaactaagtcttggcagatgaataaactaagtcacacaaatcatgtgtgcatatgggggtgaaggcaggaaagagagaaaggggaaaatggactgcatgtggagagtcttttaggccagggaatataaagacagaagtcagaatgctcagtaggaagctggaatgctaatttggggatcaggagactag

SEQ ID NO: 119283 - DNA, 601 bp, Human
caaattgccaggctctaaaaatgctttgaactggctttacctaaagccagagggattactaccaaaggaactatttaacaaacggcattcaaagaaagaaaccaaacataaaggctgtacgtgtgtgcccgtatgtgtgtgtatgttattcaacatattgaaagattaatcaggagttcagagctttatactgtagaaagaaaaaacctggacattgtataattctgaaatgaaagatgcaaatggcaaaggaagaagtagcaaagagaagttaataagtatctcaaaattgcaaatggcwcagattaaaagacaaagttatctatacaaactataatgaggctagtgtatatgtatcaggtacactcctcacctaaaattaggggaaattgatatctcaatttattcaaaaatacttgttgaaaatgcatattggggccagcacctatctcctctaggtgctggacttaaaagggcaagcaagtcacacatgaaaacaatacagcccagtggggtatgcagatgaatacacacacacacacacacacacacaaacacacacacattatcaaatggtgttaaaggcaccatgatggaggaa

SEQ ID NO: 119284 - DNA, 601 bp, Human
aaagagagctacaaattgccaggctctaaaaatgctttgaactggctttacctaaagccagagggattactaccaaaggaactatttaacaaacggcattcaaagaaagaaaccaaacataaaggctgtacgtgtgtgcccgtatgtgtgtgtatgttattcaacatattgaaagattaatcaggagttcagagctttatactgtagaaagaaaaaacctggacattgtataattctgaaatgaaagatgcaaatggcaaaggaagaagtagcaaagagaagttaataagtatctcaaaaytgcaaatggcacagattaaaagacaaagttatctatacaaactataatgaggctagtgtatatgtatcaggtacactcctcacctaaaattaggggaaattgatatctcaatttattcaaaaatacttgttgaaaatgcatattggggccagcacctatctcctctaggtgctggacttaaaagggcaagcaagtcacacatgaaaacaatacagcccagtggggtatgcagatgaatacacacacacacacacacacacacaaacacacacacattatcaaatggtgttaaaggcacca

SEQ ID NO: 119285 - DNA, 601 bp, Human
tttggttaactaggaagctcaaagtgaaataatttaccccttttctttatgacattggtttcctgtttctctctttttcaactttcattttttaaatgaaaacttttattgaaatacttgtataatactaagagagcccttgtatactttgtgcgctttcttccaatggtaatgttacaggatccctttggtactacttccccagctggaaatctctgtagccactgtgttacagctcttgcttggggagtcccaaggtctgagcccccaagaaatgttgtggcttttgtgttccgtgagwgggagggagtggtgcccagaagctttttctctcttgttgctcggcgagtgggagggagtggtacccagtggctttgcttttttgtgtctggagctaggcaaatgcgggtgtgttacagctgtcttgttcctgctgcccacagctttgtgagttccaggtccttgtcccacaaccaagaggaataacatctgcacacaccagagagtgagtaaggcaaagaattttatttagcaacagaagcaaagctctcaactgcgagaggggacccttcggcagtgagtaggggcccaaaggcaggta

SEQ ID NO: 119286 - DNA, 601 bp, Human
tagtagagacggggtttcaccttgttagccaggatggtctcgatctcctgacctcatgatccacccgcctcggcctcccaaagtgctgggattacaggcgtgagccaccgcgcccggccaagatatttcttttttgccttgacttctttggttaactaggaagctcaaagtgaaataatttaccccttttctttatgacattggtttcctgtttctctctttttcaactttcattttttaaatgaaaacttttattgaaatacttgtataatactaagagagcccttgtatactttgtgcrctttcttccaatggtaatgttacaggatccctttggtactacttccccagctggaaatctctgtagccactgtgttacagctcttgcttggggagtcccaaggtctgagcccccaagaaatgttgtggcttttgtgttccgtgagagggagggagtggtgcccagaagctttttctctcttgttgctcggcgagtgggagggagtggtacccagtggctttgcttttttgtgtctggagctaggcaaatgcgggtgtgttacagctgtcttgttcctgctgcccacagctttgtgagttc

SEQ ID NO: 119287 - DNA, 601 bp, Human
ttaatatcaaggaaggtgctgtctttctcaagcagattgtatgttttattagatgatggttatttattgcattcattatttgttgaatgagtgatttgttgaatgaatgaatacaagatatttctttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgccyggctaattttttgtatttttagtagagacggggtttcaccttgttagccaggatggtctcgatctcctgacctcatgatccacccgcctcggcctcccaaagtgctgggattacaggcgtgagccaccgcgcccggccaagatatttcttttttgccttgacttctttggttaactaggaagctcaaagtgaaataatttaccccttttctttatgacattggtttcctgtttctctctttttcaactttcattttttaaatgaaaacttttattgaaatacttgtataatactaagaga

SEQ ID NO: 119288 - DNA, 601 bp, Human
aaacactcaaattccaaggataattattatgcttttactatggtgcttcgagtttcataataatccacataaaggacacatcatatggcaaatttcaaaattaatatcaaggaaggtgctgtctttctcaagcagattgtatgttttattagatgatggttatttattgcattcattatttgttgaatgagtgatttgttgaatgaatgaatacaagatatttctttttttttttttttttttttttttttgagacggagtctcgctctgtcgcccaggccggactgcggactgcagtggygcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagatatttcttttttgccttgacttctttggttaactaggaagctcaaagtgaaataattt

SEQ ID NO: 119289 - DNA, 601 bp, Human
gttgatggatgcagcaaatgaacatggggcatgtatacctatgtatcaaacctgcatgttgtgcatatgtaccctagaactttaagtataatataaaaaataaaaaataaaaaaaagaactgttgcagccatcttatgatcatgaggagatgatgatgaggaatactctgtaagtctagtgccctggcactagagctctgtcaagtcacctatgtctctgagatctccttgctctaaagttcttattaagtgagtagtgaataaccttaaggttcacactgccgatgagtggattttctgycacttgcagccaaaagcatttctactgttaaactcactaaggttcagtagcactgttgtacctcttccctggccccttcatcatgcagactccttgttccagagcaacaaaatcttctgtctccatttttttgctcatttctctcaccatgaatgagttagacattttccaatattttatttgaaggtcatcattgatcactttgaaagtgtgcaacgacaaatagaataactaaatgaatgggttgctattgcaaaaattgcccagtacatcaacataacagaaacattctcaataaat

SEQ ID NO: 119290 - DNA, 601 bp, Human
gcattaggagaaatacctaatgtagatgacgggttgatgggtgcagcaaaccaccatggcacgtatatacctatgtaacaaacttgcatgttctgcatatgtatcccattacttcaagtataataaaaaaagtcacaaaataaccacaatatgataaaattaaatgcatctgaggcaactaacattattttttatttaatagagtcttgagaaatataactcaattaagaaatcagtaacatagaatatttaaacctatgcccatgtgtattaactatattttgtattttctgtatcatakgatgttttgacatcttcagaggcctgcatgtatcaacagtttgttcctttttatttatttttttctgagtaacattccatgttatggatgtaccatgtattgtttcatcattcacctgctgaagaaagcttctgactattataactgctgtgaacatctgtgtataatttttttttgtgcaagcgtaagtttttatttccctgggataaatgccagagtgcaattactgagtcacaggataattatatgtttcattatagaaactatccaacttttttgcaaagtggctgtacaacttta

SEQ ID NO: 119291 - DNA, 601 bp, Human
acttaaacataagacctaaaccataaaaaccctagaagaaaacctaggcaataccattcaggacataggcatgggcaaagacttcatgactaaaacaccaaaagcaatggcaacaaaagcaaaaattgacaaatgggatctaattaaactgacagacttctgtacagcaaaagaaactatcatcagtgtgaacaggcaatctacagaataggagaaaatttttgcaatctgtccatctcataaagggctaatatccagaatctacaaggaacttaaacaaatttacaagaaaaaaaaaaccatcaaaaagtgggcaaaggatatgaacagacacttctcaatagaagacatttatgcagccaacaaacatatgaaaaaaagctcagcatcactggtcattagagacatgcaaatcaaaaccacaatgagataccatctcatgccagttagaatggtgatcattaaaatgctggatgctggagaggatgtggagaaataggaatgctattatactgtcagtgggagtttaaattagttcagccattgtggaagatagtgtggcgattcctcaaggatctagaaccagaaacatcatttgacc

SEQ ID NO: 119292 - DNA, 601 bp, Human
acaatcctaagtaaaaagaacaaagctggaggcatcatgctacctgacttcaaactatactacaaggctacagtaaccaaaacagcatggtactgctaccaaaacagatatatagactaatggaacagaacagagaactcagaaataacaccgcacatctacaaccatctgattttgacaaacctgacaagaacaagcagtggggaaaggattccctatttaataaatggtgctgggaaaactggctagccacatgtagaaaactgaaactggactccttccttatacattatacaaaagwtaactcgagatggattaaagacttaaatgtaagacctaaaaccatgaaaacactagaagaaaacctaggacataggcttgggcaaagacttaaacataagacctaaaccataaaaaccctagaagaaaacctaggcaataccattcaggacataggcatgggcaaagacttcatgactaaaacaccaaaagcaatggcaacaaaagcaaaaattgacaaatgggatctaattaaactgacagacttctgtacagcaaaagaaactatcatcagtgtgaacaggcaatctacagaatagga

SEQ ID NO: 119293 - DNA, 601 bp, Human
caaagaatccaggagctgttttttttgaaaatataaacaaaatagataagactgctagccagactaataaagaagaaaaaagagaaaaatcaaatagacacaataaaaaatgataaagggtaggtcaccactgatcccacagaaatacaaactactgtcagagaatactataaacacctctacacaaataaatgagaaaatctagaagaaatggataaattcctggacacatacaccctcccaaggctaaaccagaaagaagttgagtccctgaacagaccaatatcaagttgtgaaattsaggcagtaattaatagcctaccaaccaaaaaaaaaaaaaaaaaaaagcccaggaccataaggattcacagccgaattctattcgaggtataaagaggagctggtaccattccttctgaaactattccaaacaacagaaaaagagggaatcctccctaactcattttatgaggctagcatcatcctgataacaaaacctggcagagacacaacaaaaaaggaaaatttgaggccaatatccctgatgaacatcaatgcaaaaatcctcaataaaatactggcaaaccaaatccagcagcac

SEQ ID NO: 119294 - DNA, 601 bp, Human
ctctcagaccatggtgcaatcaattagaactcaggattaaggaactcaaaaccacacaactacatggaaactgaacaacttgctcctgaatgactactgggtaaataatgaaattaaggaagaaataaataagttatttgaaaccaatgagaacacagacacaatgtaccagaatctcttggacacagctaaagcaatgtttagagggaaatttatagcactaaattcccaaaaaagaaaccaggaaagacctaaaatttacaccctaacatcaaaatgaaaagaaacagagaagcaagarcaaacaaattcaaaagctagcagaagacaagaaataactaagatcagagcacaactgaaggagacagggacatgaaaaacccttcaaaaaaccaaagaatccaggagctgttttttttgaaaatataaacaaaatagataagactgctagccagactaataaagaagaaaaaagagaaaaatcaaatagacacaataaaaaatgataaagggtaggtcaccactgatcccacagaaatacaaactactgtcagagaatactataaacacctctacacaaataaatgagaaaatctagaag

SEQ ID NO: 119295 - DNA, 601 bp, Human
caaatcaacagaatatacatttttctctgtaccacattgcacttattctaaaattgaccatgtaattggaagtaaaacactcttcagcaaatgcaaaagaacagaaatcataacaaacagtctctcagaccatggtgcaatcaattagaactcaggattaaggaactcaaaaccacacaactacatggaaactgaacaacttgctcctgaatgactactgggtaaataatgaaattaaggaagaaataaataagttatttgaaaccaatgagaacacagacacaatgtaccagaatctctyggacacagctaaagcaatgtttagagggaaatttatagcactaaattcccaaaaaagaaaccaggaaagacctaaaatttacaccctaacatcaaaatgaaaagaaacagagaagcaagaacaaacaaattcaaaagctagcagaagacaagaaataactaagatcagagcacaactgaaggagacagggacatgaaaaacccttcaaaaaaccaaagaatccaggagctgttttttttgaaaatataaacaaaatagataagactgctagccagactaataaagaagaaaaaagagaaa

SEQ ID NO: 119296 - DNA, 601 bp, Human
ataaaatacttaggaataaatttaacaaaagatgagcaaaagtcataccctgacaactacaagatactgttgaaagaaattagagaatacctaattaaatgaaatgactttttttgttcatagattgaaagatttgacattgttaacatggcagtattcctgaaataaatctgtagattcaaacaatccctgtcaaaatgtcatttagtttattgtttgttttgtgttgttttcagaaattgacaacgggatcctaaaattcatgtagagatgcaagggactcagaataaacaaaataatmttgaaaaaggacaaagttgtaggcctcatactccttggtttcaaaatttactaccatgctacaatgatcaagacagggtggtggtagtggcataaggccagacatatagatcaatggaacagaatcaagagtctagaattaaaccatcacatatatggtcaactgatttttaacaagggtgccaagaccattcagtgggggagagaattttctgtattttcaacagcagtgtattttcaacaacagtcctgggacgactggatatgaacaagaacaaatttggacctctgccttacacca

SEQ ID NO: 119297 - DNA, 601 bp, Human
tcccatctcactctgtaaggtcactatttccctgatgctaaaatcagaaaaagtcattatgaaaaaaaaaaaaactacagagcaatatctcttatgaatatagatgccaaaatattcaacaaaactaacaaactgaagccagcaacatataaaaaggatacatcatgattaggtgggatttgttccagggtaaaacaatgaatgtaatatatcatattaataaaattaaggacaaaaaccatacaattatctcaatgcagaaaaaaaattgagaaatccaatgccctttcatgttaaaaaygacaacaagaacaacagtattaaacactaagaacagtagaaaacttctgtaacttgataaagggaatctccaaaaacactcatggcaattatgatatttaatggtgaaagattggaagattttctcctaatatctggaacaagacaaagattgtctattctcacaacttctgttcagtactgtggagggtctagctagggcaatgaaacaagaaaaagaaatgaaagccattgacattgaaaatgaagaagtaaaactatctctatctgcacacaaaatgatattgtatgtagaaacttc

SEQ ID NO: 119298 - DNA, 601 bp, Human
taaaactgaaggtgaaataaagacatccccagataaacaaagataattcattgctagcagactcactttcgaaaaaattctaaagaaaatctttcaagtagaaaggaaatttcccccagatagctgctaaaattcatagaaacaaagaattccagaaatagtaaatattttggtgtatgtaatagactgcataatatgtagtttctgttttttatttatttaagaatgagactattctatatgtaaaaatatatataaagcaataaatataagcaataaaaatataagcaataaaataaamctatatatataaagcaatagtcatatgactatattattgaatttataacatatatagatagcaatctattaagaaaacaaaaattatatatatactcccctaatatacatactcccagaataataggttcccaaaataaaaacaaaaatggacagaattaaagggagaaatagataattcaacaataatagttgaaaacttcaatatccctcattcaacaatggatagaactaaacagaatattgttataacaaggaaagaggaattgaacaacattttatttatttatttatttattta

SEQ ID NO: 119299 - DNA, 601 bp, Human
ttaaagagagcctcacctagacacacctttatcgaacacttgaaataaaagacagaaatttggaaaggaggaagtaaaaatgactcattgcatgcaggagattattaatactaataccgactgatttctcattagaaacaatggagaccagaaagaagttccatgacattctgcatgctgagacaaatgctgtcaaccaagaattttatatccagaaaattatctaaaactgaaggtgaaataaagacatccccagataaacaaagataattcattgctagcagactcactttcgaaaaaattctaaagaaaatctttcaagtagaaaggaaatttcccccagatagctgctaaaattcatagaaacaaagaattccagaaatagtaaatattttggtgtatgtaatagactgcataatatgtagtttctgttttttatttatttaagaatgagactattctatatgtaaaaatatatataaagcaataaatataagcaataaaaatataagcaataaaataaaactatatatataaagcaatagtcatatgactatattattgaatttataacatatatagatagcaatctattaagaaa

SEQ ID NO: 119300 - DNA, 601 bp, Human
agttcttcagctctctgggacagagctcccagtgggaggggtgggttgccatctttgctgtctcacagccctcacccttcttgtctccaggctctagagagtccatggggacccggcactggtctgaacccccagcacagagcatccacctaatggaaaagtgtccatactgttctccacgcaggtcctggtcctcacttctcttcactgggcagagttaccaggcccaggactccagtgcaaccactctgcccctgcctgaccgcttcaatcagaggcagcccagcagttaagagaacayctaaatgcagagatgagaaagaaccaacacaagaactctgacaagtcagatgaccagagtgtcttatatcctccaaatgactacactagttcttcaacaaggattcttaaccagggttggctggaataacagaaagaaaattcagaatactgataggaacaaagatcattgaggttccagagaatggcaaaatccaatccgagaaaactaacaatcaaaataaaatgataccgaagctgacagataaaatagccagtataaaagaactcatctgatagagctgaaaaacaaactgcaaga

SEQ ID NO: 119301 - DNA, 601 bp, Human
cctttccttatgggtcctggaccctatttctcctcactgggcagaatctcctgaccaagatttacaactaccctcgccagtatgttcaagctggcaacagatccatacctccctgggatggagctcccagagggagtgacacactgccatctttgctgttttgcagccttgattgttgataccttcaggtgctggaaaatctgaggtgattagaaactggagcagacctcctgcatattccagcagcccaatggaaaagtggccagacttttatatatgtttgttacatgttttctatatrttacatgttttctatatgttacatgttttctacatgttacatgttttctatatgtttgttacatgagtccctgttcccgtatctcctcactgggcaggttctcccagcctgggtctccagcctttccccactggagctattgagccagtagcagttcttcagctctctgggacagagctcccagtgggaggggtgggttgccatctttgctgtctcacagccctcacccttcttgtctccaggctctagagagtccatggggacccggcactggtctgaacccccagcacagagcatcca

SEQ ID NO: 119302 - DNA, 601 bp, Human
ctgcctttccttatgggtcctggaccctatttctcctcactgggcagaatctcctgaccaagatttacaactaccctcgccagtatgttcaagctggcaacagatccatacctccctgggatggagctcccagagggagtgacacactgccatctttgctgttttgcagccttgattgttgataccttcaggtgctggaaaatctgaggtgattagaaactggagcagacctcctgcatattccagcagcccaatggaaaagtggccagacttttatatatgtttgttacatgttttctayatattacatgttttctatatgttacatgttttctacatgttacatgttttctatatgtttgttacatgagtccctgttcccgtatctcctcactgggcaggttctcccagcctgggtctccagcctttccccactggagctattgagccagtagcagttcttcagctctctgggacagagctcccagtgggaggggtgggttgccatctttgctgtctcacagccctcacccttcttgtctccaggctctagagagtccatggggacccggcactggtctgaacccccagcacagagcat

SEQ ID NO: 119303 - DNA, 601 bp, Human
tcattagccgtctgctgaactatgcagacaaaagggggatgcttagtaagacaggatacacaataaaaacaaaactgagcagagatatcagcagctatataccatggaaaagatagatcagtcagattaagtcagaaaagttactaaaaacaaacaaaaaatcaaaacaataacaataactctcagttaaaatgtcagaatctaaagttgtcacattatattaaccaaatgttcaattttcaacaaaaaattactagacatacagaaacaaaagaatgatccatactcaagaaaaaaaaaataaaaacttactatgactaggtctagatattgatttagcagacaaaaacttcaaagcagctactatgaatatgttcaaagaataaaaagaaactacatttaaagactttgtgaaaaataggatgataatgattcaacaaataggaagtactgataaagacacagaaactctaaaagggagctaacaggaaattctggagataaaagtacaataactctctaagttttaaagatgggcaactagaagcaactggtgtgtgttgctcttatggagagcaatagaaggggcgaataaatacag

SEQ ID NO: 119304 - DNA, 601 bp, Human
cagccatatccaatatctggatcatctatgggtctgcttctatcatctccttttttgcttgattgttggtctcatgtttttgcctgttatatgtctaataatatcttatagcatgatgggctttgtgtattaaagaatcacaaagactgacagttgatgctattttccttcagaaaagttgctcctgcctctagtaagtagcaactgaggaattgataaattcccatcagaaattaagctgagttatggtgggttgcagttttagttaggctaggcctacctctggtttcagtgatctcayagatggcatttgaaatgtgattgttttaggccaataagcctctggctagtctaagaaaaaagaaagaacacaaggccaaggatggtggatcattcctgtaatcccagcactttgggaggccaaagtgggaagactgcttgagacaagaagtttgagatcagcctgggtaacttagggagaccctgtctctacaaaaaataaaaaaaaaattcaggcatggtgctgtgcacctgtagtcctagctatttgggaggctgaggtgttcaagcaactctcctgcctcagcctcctgagtagctg

SEQ ID NO: 119305 - DNA, 601 bp, Human
atagcttagatttttgtattaggtttatactggcctcacaaagcaagttagaaaatgttactccctcctgtatttgctgaaagagtttatgtaagatggtattatttcatattggaatatttggaagaattcaccaccaagcccatctgggctgggacttttctttgtaaaacagtttgtaattatagatttctttaatagatgttaggattattctaattccatttttaaatttctgcttatgtcaatgttggtttttatttccaaatgaatttgtccattttatttaattaattaattwatttatttattttttgagatggagtcttgctctgtcaccaggctggagtgcagtggcgtgatctcagctcactgaagcctccacctcccaggttcaagcgattctcctgcctcagcctcttgagtagctgggactacaggtgtgcactaccacgcacagctgatttttgtatttttagtagagatggggtttcaccatcttggccaggatggtctcgatctcttgacctcatgatctgcctgcctcggcctcccaaagtgctgggattacaggcgtgagccaccgtgcctggcctgactt

SEQ ID NO: 119306 - DNA, 601 bp, Human
tagaataacctcacatggcttctatgtgacatcattttaatatatcactattcaatttggattcaatatgctaatattttgtgtagaatttttgtatccatattgaagaaatattgtccttcaattttcttttcttgcaatatgcttgtacatcttgtgatagcttagatttttgtattaggtttatactggcctcacaaagcaagttagaaaatgttactccctcctgtatttgctgaaagagtttatgtaagatggtattatttcatattggaatatttggaagaattcaccaccaagmccatctgggctgggacttttctttgtaaaacagtttgtaattatagatttctttaatagatgttaggattattctaattccatttttaaatttctgcttatgtcaatgttggtttttatttccaaatgaatttgtccattttatttaattaattaatttatttatttattttttgagatggagtcttgctctgtcaccaggctggagtgcagtggcgtgatctcagctcactgaagcctccacctcccaggttcaagcgattctcctgcctcagcctcttgagtagctgggactacaggt

SEQ ID NO: 119307 - DNA, 601 bp, Human
tttcccgagatggagtttcactcgtctcccaggctggagtgcagtggcgcgatctcggctcactgcaacttccgcctcctgggttcaagtgattctcctgcctcagcctcccaagttgctgggactacaagcacctgccaccacgcccagctaattttggtatttttagtagagacagggtttcaccatgttggccaggctggcctcgaactcctgatctcaggtgatccgcccccttcagtctcccaaaatgctgggattacaggcatgagccactgcgcccagccacaaaatgtattttaaatataagacttgaaggtcaaaattactgtttgatccatgggctgcagaatggatgttgtgttagcaggcaagaaaacattcatttccttgcacatttctattagagctcttaggtgaccaggttcatggtcaatgagcagtaatattttgaaaggaatatgtattttttcctaaacagtagttctcaacagttatcttaaaatattcagtaaactatgctgtaaacagatgtcctgttatccaggctttgatgttaaatttattgagcatagacagagtagagtagatttaacataat

SEQ ID NO: 119308 - DNA, 601 bp, Human
gtgacactttaggaagaaaaaaattgaaccttagaaatgaattgcatgaaaaaaatgctggacataaaaattattaaaggccagcttgaggatttataaaagaaaggtaaaattaaaacaggagacaaaaacagaacataaggtggaagggagtgggaagagtaaaagcattctacagtcctttcattgtttaggaggaaaatagaagtaccagctgtagactttggcaactcatatttgtgtattaaatatttgtcagcggaaaagaaaataattagaatatataacttctaaataaatwaattgcataaactagagaattaatcaaacaatagaaattaggaaaggggaaaataagaaaatacaaagaactggtaaatggaaagcacaaaatgaagtgtcataagtcctcacttaacatcgttgataggttcttggaaactgcaactttaaagaaaaagacatataagagaatgaatattttttttctcatcagtgttaataatgaatctaccttgcatgaaatgacattattgaagaacctgctgtacatcttttcacttaaagttatagtttccaagaacctatgacattgaggact

SEQ ID NO: 119309 - DNA, 601 bp, Human
gaaacagcgtgtactgccaatctgacagtctgtatagtgtgtatggtgaatacacaatgttcccaataaggaacagggagaagcaagctctctttaaagtggaggatacattaggtcagactttctgggccaggcgttttcattgaccataaagttgaccttggggccaggcgcggtggttcactcctgtaatcctagcattttggaaggccgaggtgagtggatcacttgagccaggagctcaagaccagcctgggcaacatggtgaaaccccatctctaaaaaaaatacaaaaaaaaawttttttccgggcatggtggcatgcacctgtactcctagctacttgggaggctgaagtgggaagatcacttgaacccagggagatcgaggctgcagtgagttgtgatcgcaccactgcactccagcctgggtgacatagtgagaccccgtctaaaagctgaccttggaatgtcagcttggctgaaagatcacattattttcattcatactaagtgtggagagagatgttggatggcacacaaaaatccactctaacagtttgatagttgaaggttgaggaagtaagatggctatttcacag

SEQ ID NO: 119310 - DNA, 601 bp, Human
gggaattctgtcagttaaatactgaaaagactggtatatgatgatagcctgatcagcaccgacttctcactgcatgatatgaggacaagactgagaagaaaggagagggtaaggcaggggttgcctggtgggcttttgctgccctggctgcttttcagttggagggagatctttagagctgtggccactaggaggcactgccagtccaatgatagccccagttatcattccctaagtccagaaggtgccagcaggtacctttactgatgagtattgtgtccaccacattacgggaaacagygtgtactgccaatctgacagtctgtatagtgtgtatggtgaatacacaatgttcccaataaggaacagggagaagcaagctctctttaaagtggaggatacattaggtcagactttctgggccaggcgttttcattgaccataaagttgaccttggggccaggcgcggtggttcactcctgtaatcctagcattttggaaggccgaggtgagtggatcacttgagccaggagctcaagaccagcctgggcaacatggtgaaaccccatctctaaaaaaaatacaaaaaaaaaattttttc

SEQ ID NO: 119311 - DNA, 601 bp, Human
gattattttttctatttgtattccctacctttcctccctcctcccaatttttttcattgccacgtcatttttgggaattctgtcagttaaatactgaaaagactggtatatgatgatagcctgatcagcaccgacttctcactgcatgatatgaggacaagactgagaagaaaggagagggtaaggcaggggttgcctggtgggcttttgctgccctggctgcttttcagttggagggagatctttagagctgtggccactaggaggcactgccagtccaatgatagccccagttatcattccctaagtccagaaggtgccagcaggtacctttactgatgagtattgtgtccaccacattacgggaaacagcgtgtactgccaatctgacagtctgtatagtgtgtatggtgaatacacaatgttcccaataaggaacagggagaagcaagctctctttaaagtggaggatacattaggtcagactttctgggccaggcgttttcattgaccataaagttgaccttggggccaggcgcggtggttcactcctgtaatcctagcattttggaaggccgaggtgagtggatcacttgagcca

SEQ ID NO: 119312 - DNA, 601 bp, Human
gtcaatgcagtgacaatccaagggtgtcatttgtggggacgttcaaacagaactcagggaagcaaagggcattctgtctcaacagtgtcatctttgggattgaccactggggggcaatggaggtgggtggtgtgtatttgggagataagacttttggcttccaagcccaggtagttaaggatgtcaggagtccacagttaaaatgcaaatgtctaaggaaggaacagaacaatgggtggtgacctgctttttaaatcttaccataaactactttatcagaacatacatcaagaccctgaargaatggatgggataaatgtattttgatgaagaaaaggtagaaataggaaagagaaaggactggaatgtgggcattgtctggaaaagaaggtactgttggaaggggtccctagaggagacaagacactgcatgaggacagagaatgccctggagaccacgggagcatacagaagagttcagagggagcaggaacaaactttccacttcatcttgtggcatggccttatccattacagggtctttttcatagagaagtggagccttcccgattcttctacagttgccagaggtgttctttcc

SEQ ID NO: 119313 - DNA, 601 bp, Human
gtcttcaatggcgaaactatgacattttgtgttaatttctaatgataaaagtccatgtgtttttttaaaacctcggagacataaactgaggcaaccgagtcaaaccgcataagattgtgatgaaatagattaagatatttaattcataagattttgtgaatatcttatacaaatagaaaagaaaacctgccatctttggatatctacttttgttaaaaatactagaaactcataatcatggtctaaaatccagtgtttatgtccaactaaatttgatcttataccaagccatagttgtttktcaggtgtgtatatcaaataaactggatggatctaaacacagaacaagaataaaatgttacaaaatattttcacagctgccttctatattgaacatatgttcttccacgtaattgtcatcattcttcaaaacattgtgcctcaactggcatacatttcttatttactggcttttaaatttatcagctccatcgatttacttttgacaacggtatttccaacactcacataatttgaagtagacgactgtattttatgtcattgccacccaatccaacaaacaagaggcaaggtaagcagg

SEQ ID NO: 119314 - DNA, 601 bp, Human
ggggttattaagcctacacaatcaccattacatagataatttaaacctttagaaaaatcattgaggaaaaagccatcaacctcagcggcagaaggtggagcagtgggaagtgagggtctctggagacagcccaggcttgcagccagcctctggcattactatctgtgtgcccttaccaaagcctcagtcatcccctccaaaatgaggacaataataaaacttacaccacacaggttttgtggggactaaatgtagtaattcaaacaaaccactcagtaaagagtcctgtaaattgtaggayggtactgatctgtaagattgttatctatacaggtgttttgctaggttgtcatttaattctcattttgttttcactgagtagaatgtgctttgatttattaaccaatatttggtggtagtataactttttaaaattagaagcagaattggtgtgatgtagtatatataaggaggactttagcctccctttctttaaacattcttgtctgtagctgaaattatatatgttgataaggttccttctgcatgtgcactacagtgtttatggcacactataattagtttcagtggagtcttcatg

SEQ ID NO: 119315 - DNA, 601 bp, Human
cagtatatcaacaatacatgggtgcaaacatgcacacaacttaggaggatgagaaatttgcctgtgacaaacatttaattattttcaaaaagaaaagtgttattctgaaagctaaccactgaaggcccaactcataatagatctggttttcttggattcaatggattttataatttaattctattataaggtaacttaaaatataccaattacttcacattctgttccagaacatattaactggtctaaagatgagaaataactgtgtacagattatcatttcaaatataagggagggagrgaaggagggaaagagagactttttaaaaatgatgaagaaggaagggcctggtaactataatggacgatgtcatccacaatccctattgatatatagtaatcataatatttttgtcatagaatattaggattatcgttttttaatgaaacaagtattcacagaaatctgagaacaataatagatttgaagatgtaaatttagatcagtatttcgtcaacctttctaacccacaatgaatctttaaaaaaaatgttggacactgcagagtgtccctctgtagggtctaaaactgcaacatgt

SEQ ID NO: 119316 - DNA, 601 bp, Human
atagaacactatacttttaagttgtaaaactcctaacagttttcttatttgaaatatatgctgtaagtttggaatataattttaattatcaagatttaaagtagttagcattattaactgtcacctaggcagaagatggcttttaaagaatcattaatgtcaaattcctagctttcaaattatgagcttaattataaggcagccatatttctttgaatggctgtattttcttttcttttttttttttttgagacggcgtcttgctctgttgcccaggctggagtgcaatggcgtgatctcrgctcactgcaacctctgccccctgggttcaagcaattctcctgcctcagcctcccgagtagttaggactacaggcgtgtgccaccacgcctgactagtttttgtatttttagtagagatgaagtttcactgtgttgcccaggctggtctcgaactcctgacctcaggtggtccacctacctcagcctcccaaagtgctgggattacaggcgtgagccaactgtgcctggcctgtactttcataagaactagaaaggtgacagtatatcaacaatacatgggtgcaaacatgcacacaact

SEQ ID NO: 119317 - DNA, 601 bp, Human
gaagagatggtcacagggaggaaaagacgggctttggaaatgtgatagttgaggcatgaagaaataattttgagatactcaagaatggttgtcttcatgtactatttctttaagctttttgacctcatcaaaatacaaactgttcatttggtctattggtcatcaaccataattagccacaaaatcttaagattgtgtcatcccttcttaaaacccatcattgtagtggaatagaaaagaaccaggaggtagacagctgttggttcctttttaaaaaaaatgaatacgtttaaaatttggrccaagatgataacagcaaaaatatttcttgaactaaaaagacaaaaggattgatttctcattgtacctctgttccattcaataaaatattatgttcttcttgatgccaattatcaccaaatttgaaatttgccaatctgcagtttggtgaaatatttctgaagaaaggggataaaatatgaccacatttaaagcattttctttgtaaaatgtgtagaactgcaatactttctaaaaattaaaacttatagttgtgcttttcatttgttcaacattaacaccagctttgtcaaagagctca

SEQ ID NO: 119318 - DNA, 601 bp, Human
gaaagtttattaaaaatgtatgaactgaaaagacaagtagtgcagctatttatattttatttataaggtaaaatgtgatataagcggataatataaaatagcaataaattgtgcataattatctgcattatggtaccatattcttaactgtgtaattttattccatcttggcccagaaaatacttcaggcagcactacaccacttgctatgtgacaaattaatgctactttttaaaaggccaagtgaggccaggcccagtggctcacacctgtaaccccagcactctgggaggctgaggcrggcggatcatctgaggtcaagagtttgagaccagcctggccaacatggtgaaaccctgtgtctactaaaaatacaaaaagaaaatcagctgggcatagtggcacacgcctgtgatcccagctacttgggaggctgaggcaggagaatcacttgaacccaggaggtagaggttgcagtgagccaagatcgagccgctgcactccagcctgggcaacggagcaacactccatctctaaataaataaataagtaaatgccaagtgagaaaatgtgacaagttcctgttcattgataatatcag

SEQ ID NO: 119319 - DNA, 601 bp, Human
cactgccaaaaacaggaaatctgagggtgaactggtttggggaaaagctgacacttgtctttaaatctccagattctgacatgatgacatctaagcagggcattctgacacagcctggggcagagatgagatcagagatgaaatgaggctgacaattgcacacattactaagtgttttaaaagcttagaagttaaatgacttgctctttaggctctgtcacagtagccctcagttaacatggtccttaatatcatatatccaatgatattcagatgaatatgtacagtaggccattggaartgcagggctaaaatttagtacagggggctgaacatttacttttgggtgtattctatgtggaaacgatgactgcagccatgagagtggaggaaatctccaatggagggtaggctaagggatgcagtctaggatgaaaccatcctttgggattgaaaggaataagtgggtccagagaaaagagaggtccacctgctagaaagggcaccacaatagtgcaggttatggcagccaaggagaaggacatttctcagaaggaaggggtaagctacagtgtggaatgctgtagacataacaaggaaa

SEQ ID NO: 119320 - DNA, 601 bp, Human
acaaattttcttgtcaattgtgtctttaactgtggctgccttaaaatatttttatcatccacagacaattgtctcattttggtgaaaattgtttcataatcagctatcaaatttaacaggtgctcttaaatgcaggattctaattaataatgctgaaaattgtgacattaaaatagaggaaaatgtttcaaatagaagactaagtggcatttggtttactttggactttatttatataaatgttattagtatgtgttccaaaattatgggaaacttctataatgttgatacaatttagtgyacattattaataattataattgttatgtaaaattgttgtatgccacaaaagtaaacaaaactgctacataattgtagctttaatagtggctatagccttttgtcatccacagacattttgtcttgctttggtccttttcaaaaggcagtttataatcagatatacgactcttaagtgcaggtctcaaataactttaaaaattgtgctattgaaagagaggaaaagaacaaacttttagggctctcatggaaagctaatgtgttaaacattgctaaaccttttctttcagagtcaggagga

SEQ ID NO: 119321 - DNA, 601 bp, Human
gcttatttggtacaaaaatcatacagaaagcattgtcaaatatgaaatggtgtttggctttctttggtctatatttgtgtaaatgcgttattggtatatgctctgaaattatgcaaaactcctgttattctaatataacttagtatatgttatcagtaatcatcataattattatgttaacagactgtgtgccacagaggtaacaaattttcttgtcaattgtgtctttaactgtggctgccttaaaatatttttatcatccacagacaattgtctcattttggtgaaaattgtttcatamtcagctatcaaatttaacaggtgctcttaaatgcaggattctaattaataatgctgaaaattgtgacattaaaatagaggaaaatgtttcaaatagaagactaagtggcatttggtttactttggactttatttatataaatgttattagtatgtgttccaaaattatgggaaacttctataatgttgatacaatttagtgcacattattaataattataattgttatgtaaaattgttgtatgccacaaaagtaaacaaaactgctacataattgtagctttaatagtggctatagcct

SEQ ID NO: 119322 - DNA, 601 bp, Human
gttatcattttggccaaatgaattacgtatggtaacctaggattctattttgtgataaccagtattttaaacctttgatatttaacaaactttccaacatcaaattataaattatgtctcttttttacctaatattttagatattaggtcctctaaagtccaaaaataacatttggcttatttggtacaaaaatcatacagaaagcattgtcaaatatgaaatggtgtttggctttctttggtctatatttgtgtaaatgcgttattggtatatgctctgaaattatgcaaaactcctgtwattctaatataacttagtatatgttatcagtaatcatcataattattatgttaacagactgtgtgccacagaggtaacaaattttcttgtcaattgtgtctttaactgtggctgccttaaaatatttttatcatccacagacaattgtctcattttggtgaaaattgtttcataatcagctatcaaatttaacaggtgctcttaaatgcaggattctaattaataatgctgaaaattgtgacattaaaatagaggaaaatgtttcaaatagaagactaagtggcatttggtttactttgg

SEQ ID NO: 119323 - DNA, 601 bp, Human
tttaaagattattggtaaaataaaatgtcttgaaaatgtagacatttggtctaaattaaggtcaaatatcaaatttgctaaatgctttaaggtcaagctgtttctttgacttttgaaaattgttcgatttacctactttggagcagattatagataaggcctggggacatacggaaagccaagtccactagctatgctaaaatgagtcagatcttcatttctgtccgatgtcctaggctccacccttagtagataattaaaatctcttacttatcaggtttttcactaaaaataaaagttkctaacagttaacattgtaatatgtagttgagaccactgaagaagcagttttacatacaaggtatgtagggaatgtgtttttggtaaaagattataagaaggcatgggaatatagcttttgttaaagggaatgtaattttggctagttctgagggttttaaaaattgtcttaacctaaaagagtaacagaacaaaactgaaggcttaagcaaagtgaaagggttaatcttgtaaaaattctgtgggtataaaccagttggctaatatttaaaagaaattatttagcttttttccttaggtt

SEQ ID NO: 119324 - DNA, 601 bp, Human
ccaaagtgctgggattataggtgtgagccaccgcgcccggcctatagatatatttaaaaggcctttatgtttttctcttcttggaacttgtttttctggaaaaaggatttttcttctcagtcgactgtattatttttctccatttttttgtcttgtccttcttaaagcactcatgagaggccctaagataacttctggtagcctgagattcattgggaaaaacagaggaggcaccacataccctgttttggaaaaaaaaaaccctctgatttccttataaaaccccaggaatttaaaagcmgataaatccctctcaaaattaaaggatctgttctgttttgcatactgttatctgatggttttgagttttgggggtatcagaaattacttcgtattatgataattaggtaggaaatataagggatggctaatagtagttatggagggatacttaattctttgcacacttggataggagaagcatgctcttggctacttggaagacaagaaaacgcccccactacccccactgggagatgagactcccaggagagatgggctgattacaaaatgggctgattggctttgggttaccttgcaa

SEQ ID NO: 119325 - DNA, 601 bp, Human
tctccctttctctgtctgggtaaaacagtaaattactggtctcctccgcaaggtttgattaatagaaaaaaggatttgtgaaactagtcttaggctgtagcaaatgttgtgtactttgtgctaaaaatttgtctttctgtgttctgtaacggagagggggtattgcaggatagaatgtgggtttacaacccctataagcctgcttctcaagccagcttggcaggctcgtcagttacaaactttgctacaggtccctgaaaccagtactgtataaaatttctgtcttgttttgtgtccttargagcttaaccttgtgaccatgcggggatactttcttttggtttccaccatccagaggacaggaattttggggttcatgtcataattagtcctaaaaatttttcttgggcagttaaaagctttccaagcttgaaatttgcttctctaggccccttctgggaaaagcaatagaaactgcttaatgctgtatagctcagtagctacggctttatcttttgacagtggtggccggggttcaattgttggcttctggaataattcctttctggtttatttgtgtaattttgccatttattgaggt

SEQ ID NO: 119326 - DNA, 601 bp, Human
taaaacagtaaagggtgattttctcttgtaaagtggctggaaccccactgctatagcacaagtgagcagggtcatcagaagccactccattcttctggaagctgcagagaaaaggaacccagaaacctggtatgccagcaaaaagggtaagaaattcttaccagccaagtttctggtctctctctctctccctttctctgtctgggtaaaacagtaaattactggtctcctccgcaaggtttgattaatagaaaaaaggatttgtgaaactagtcttaggctgtagcaaatgttgtgtacyttgtgctaaaaatttgtctttctgtgttctgtaacggagagggggtattgcaggatagaatgtgggtttacaacccctataagcctgcttctcaagccagcttggcaggctcgtcagttacaaactttgctacaggtccctgaaaccagtactgtataaaatttctgtcttgttttgtgtccttaggagcttaaccttgtgaccatgcggggatactttcttttggtttccaccatccagaggacaggaattttggggttcatgtcataattagtcctaaaaatttttcttgggcagtta

SEQ ID NO: 119327 - DNA, 601 bp, Human
aattgcaatggagaaatagtcctggggagatgtcctttaactgttgccttatcacagggtgactgtagccccatggtggggtgtctgtctgtagccccattgcagggtgtccagattggtgagtatcctaggtgctgccaatgcctcctttcttctcctgactggtaatgtagcctatggggggtgtctgtagccccatcgtggagtgtctgtttctagctccaccatggggtgtctgtgtctgtagcctcatttgcagggtgtctgttttgcaatttggggggtctcagttggttctttstaactagtatgaagagtcttggtttgggagacttctcctcaatcaggaagatttcgaggaggtttctcagacagagaataggaggatagtttggaagggatactcttggagttcttggttagggatctaatttggaaggccttctgtccatctcctctttgtctgtgtttgtatatgtggaagggatctcagagacggttgctgatggaaatccagcaggcctaactcagggaaccatccttatctggtcacattccatgagccccaaagaaggctcaacaggcctcttggggtgactat

SEQ ID NO: 119328 - DNA, 601 bp, Human
cctaaactgctcctaagatcagtgcttgagatactttgcagaccctgcacttgatgaataagctggccccactcagatcaataaacaggctcatctgatcttgtggcccccacccaggaattgactgagcacaagaagactgctttgactccctatgatttcatctctgaccaatcagcactcctggttcactggcttccccccacccacaaagttatccttaaaaactctgctccctgaatgctcagagagactgatttgagtaataacaaaacttggttctcccacacagccggctctrtgtgaagtactctttctccattgcaattcccctgtcttgatgaattagctctgtctaggcagtgggcaatgtgaaccccttgggcagttacaaatttgggggctcatccaggattgcccttgtggctacctgcctgtggttcaatggcccccctccagtgatggatccagaagccagcccaagtggcctcctagttctcttggactggcggctgactctggtattctttctactggcgtggcactgctgacccaatgtgcatgaatttaattgcaatggagaaatagtcctggggagatg

SEQ ID NO: 119329 - DNA, 601 bp, Human
acattagccacaagataagaaattatggtttaggagtcatgcagctggaggctacaagattctgaccctccctaaactgctcctaagatcagtgcttgagatactttgcagaccctgcacttgatgaataagctggccccactcagatcaataaacaggctcatctgatcttgtggcccccacccaggaattgactgagcacaagaagactgctttgactccctatgatttcatctctgaccaatcagcactcctggttcactggcttccccccacccacaaagttatccttaaaaactcygctccctgaatgctcagagagactgatttgagtaataacaaaacttggttctcccacacagccggctctatgtgaagtactctttctccattgcaattcccctgtcttgatgaattagctctgtctaggcagtgggcaatgtgaaccccttgggcagttacaaatttgggggctcatccaggattgcccttgtggctacctgcctgtggttcaatggcccccctccagtgatggatccagaagccagcccaagtggcctcctagttctcttggactggcggctgactctggtattctttc

SEQ ID NO: 119330 - DNA, 601 bp, Human
gaagtgttacctcttacacatctgttttcatttattgagcaggaactaagtgccaggctttgtgctggaggtggggatataaaaataagtgaattatacaaaacaaacacacactcacacaaatggataagaaataaatggtaatctgttttatgatgctcgtacatatttggaaacaaatacattataagacagaatgatttgtgctgaagggggcactccttagtgtgaaggaagatgcttacccacttgtgagacgtgaaggggctcagaagagcctgaaaggagttttcagacaaasagaagatagaatttgctattttcaagtgaatcccctctgaatgaattgctttatacctggtagaaatggcatgccctctagggaagcctcctaaatctccaaccaggaggccacctgctcaagaagtctgtgaatggcaggcacttcatggactttccttgaagaaactgtgggcagaaagcattagctaagtaacatgagtttggtgtagggtcgtctcttagcagatctttcaattacttgctaagattgcaggaggtttctaataaggaggttaacaaaaggactgttatcttaaaa

SEQ ID NO: 119331 - DNA, 601 bp, Human
cttgtccttaacaacaaaacatgaatgagttcaccaaatgatttttcttttagaagggtttgtttagaatgaagcaccaaaagccataatctttttcaggtggagaagagggatcttttggaagacatgacctgcaataaacccctggaactctgagagtagagggcagagtgggagaaaaggggctctccacagaagcccagcagctcctgggttgaatggattggagacaataaattggggcaagcctaggctaaaggtctaaagccaaggcagcagggctaaaggtctttgacggtcyggggcctccaggtatttactctctttgtgcaggggaggggcaaatgggaattaaaaggaaactaaagcatcaccactaactgaagtgttacctcttacacatctgttttcatttattgagcaggaactaagtgccaggctttgtgctggaggtggggatataaaaataagtgaattatacaaaacaaacacacactcacacaaatggataagaaataaatggtaatctgttttatgatgctcgtacatatttggaaacaaatacattataagacagaatgatttgtgctgaagggggcac

SEQ ID NO: 119332 - DNA, 601 bp, Human
aaatgtaagtggtagtggtttgtactgctagcttcacctgcagtgtacctgcagacacctggtttacagaattagactccagtcatttgctcataggaagacagaagtgatcaggttgaagagagcagggagctactcccattttacatgggtgtgtaattagcatgaaagaacaatattgaaaaagtcacatgccctcatgacaatgcaaggcaatagaggtgacataaggaatttttgcagagtaaagtactaaccctctctttggctacagacttacctcaggctggctggagagtawatcaggtctaaaagagtctccttcataacaggctgaggatactcccagcaatctgaagccggagagagaattcactccccacaaactccccacccaccaccactacctggtccatcagggacattaactcagaaagactccagtaggcagacctttgttgggcaaaatttgttccctttcctctattacatttctgccatgtaggaaatagagaagaggctcacaagcatgttttgggggtgaaacagatcttttttttctcttttgagtaggactggtcctacaaataggtttccagag

SEQ ID NO: 119333 - DNA, 601 bp, Human
tcacatataagaaaagactattgaatctccattgaccatatcgcgatgggtgtagctctgtgggctacaccatccatacagtggcctgaattatgtgactttgaaacaaacttgaaaatatagaggactctgtgaagtaccacttcactccactgcactccagcctgggtgacagggttagactctgtcttaaaaaaaaaaaaaaagagagagagagcccctggagctgacatgtggactaaaccattttgttcaacatggtttgtttgcttacattctgtgatttaaaaatctgaaatgmaacctttaaaatctacattgcatccaccattcagttattaccctccttcaacttagaaacaaaaaattacatgcaaaagagtagtcatagtgcttcaaatgtcatgcaaaatggaaatactttaaatattccagtcccgggatataaaaaaaaatagcataaaacccttactgaaggatctatgcaaatttaccctccaactgggtatgtgacaaatggtttttatagaattctatgccaatcaattttaaggaagagaaataagatgcaaaattcccatctcacaaccaaatgtaagtg

SEQ ID NO: 119334 - DNA, 601 bp, Human
gtgagcagacagatggctgtgccaagggcacttactgtcattccactttggtttggaagaatcttttccacccttgaggataattcacaaattcacatataagaaaagactattgaatctccattgaccatatcgcgatgggtgtagctctgtgggctacaccatccatacagtggcctgaattatgtgactttgaaacaaacttgaaaatatagaggactctgtgaagtaccacttcactccactgcactccagcctgggtgacagggttagactctgtcttaaaaaaaaaaaaaaagakagagagagcccctggagctgacatgtggactaaaccattttgttcaacatggtttgtttgcttacattctgtgatttaaaaatctgaaatgaaacctttaaaatctacattgcatccaccattcagttattaccctccttcaacttagaaacaaaaaattacatgcaaaagagtagtcatagtgcttcaaatgtcatgcaaaatggaaatactttaaatattccagtcccgggatataaaaaaaaatagcataaaacccttactgaaggatctatgcaaatttaccctccaactgggtat

SEQ ID NO: 119335 - DNA, 601 bp, Human; identical to SEQ ID NO: 40169

SEQ ID NO: 119336 - DNA, 601 bp, Human; identical to SEQ ID NO: 40170

SEQ ID NO: 119337 - DNA, 601 bp, Human; identical to SEQ ID NO: 40171

SEQ ID NO: 119338 - DNA, 601 bp, Human; identical to SEQ ID NO: 40172

SEQ ID NO: 119339 - DNA, 601 bp, Human; identical to SEQ ID NO: 40173

SEQ ID NO: 119340 - DNA, 601 bp, Human; identical to SEQ ID NO: 40174

SEQ ID NO: 119341 - DNA, 601 bp, Human; identical to SEQ ID NO: 40175

SEQ ID NO: 119342 - DNA, 601 bp, Human; identical to SEQ ID NO: 40176

SEQ ID NO: 119343 - DNA, 601 bp, Human; identical to SEQ ID NO: 40177

SEQ ID NO: 119344 - DNA, 601 bp, Human; identical to SEQ ID NO: 40178

SEQ ID NO: 119345 - DNA, 601 bp, Human; identical to SEQ ID NO: 40179

SEQ ID NO: 119346 - DNA, 601 bp, Human; identical to SEQ ID NO: 40180

SEQ ID NO: 119347 - DNA, 601 bp, Human; identical to SEQ ID NO: 40181

SEQ ID NO: 119348 - DNA, 601 bp, Human; identical to SEQ ID NO: 40182

SEQ ID NO: 119349 - DNA, 601 bp, Human
ttgtattgtggttatacaagataatgtccctgttcttctgaacaggaagtggaaaacgtcgacaattctcaaatggctcagaaaaaaaagaaaaacagagacataaacatggcaaaatgttaactaataaatctttgtgaagggtgtatgggtagtaataacacaacttttctttaggtttgaaatttttcttttttttttttttttgagacagtctcactctgtcacccaggctggaatgcaatggcatgatctcggcttactacaacctccgcctctcgggttcaagcgattctcctgyctcagcctcccaagtagctgggattacaggtgcacgccaccacacccggataatttttgtattttagtagagacagggtttcacattgttggccaggctggtcttgaactcctgtcatcaggtgatccacccgcctcagcctcccaaagtgctggtattacaggcgtgagccaccacactggatcttaggtttgaaattcttctaaatgcaaaaatcaatacaggactgtccctcaaaaggagttataatactgaaagaagcgtcaacatacagaaatgtcatgaataaaaaaggaatgc

SEQ ID NO: 119350 - DNA, 601 bp, Human
cagcacgggatgaaaaacaggacaggaagctaagagaggtcttgaatttgggttaacttaattatttggtttaagattaattttggaatgagatacaaaaaaaaaattttaagtttaaattacctaattttaatttgattacctattttacctgttttaaactgtctattttatattattcatgcctctgtatcttccttatttggataaaaattcaacttcctggccgggtgcagtggctaacacctataatcccagcatcttgggaggccgaggcagatggatcatctaagttcgggastttgagacaagtctgaccaacatggagaaatcccatctctgctaaaaatacaaaattagccaggcatggtggtgcatgcctgttaatcccagctactcgggagggtgaggcaaaagaatagcttgaactcaggaggcggaggttgcggtgagccaagattgcgccattgcattccagcctgggcaacaagagtgaaacttcatctcaaaaaaaaaaaaaaattcaacttcctataaaaaactaagctctgaaataagccggagattctaaatctttcaacacaaatctgagagactaaac

SEQ ID NO: 119351 - DNA, 601 bp, Human
tggttgaatccaggaggcggaggttgcagtgaaccaagatcacgctaccacactcaagcctgggcaacggggagactccatctcaaaaaaaaaaaaaaaaaaaaagagatttgacagtacattcatttaatctggcaattttaatttgaacaaatacctattaacaacaaattaaatcctattgcacatgaattatttgttgcaccaccaccagattttctaattctagcagaggccacgatgaaataggccagacatgctgccattaaagtttgctgggatgattgtaataaatctactsaaagtattcaagttctaactttcaaagtgatgtagagaaacataaaagatttcactgtatcatctaaaaatataactgttttgtctgatcattaaattctgatttgcatttactctttgtatatattctagaagaaatccttctaaaacatttaattaatcatacccagttccaaagaaaccgtgagtcaaaagggaaagacaagaagaattagacacagagtaaacatgtagagaacatgttttgctgaattcaaatgcttttgcacaagtatggtgagtgtcctttattcccagcacg

SEQ ID NO: 119352 - DNA, 601 bp, Human
tagctgggtgtggtggcaggcacctgtaatcccagctacttgggaggctgaggcaggagaattggttgaatccaggaggcggaggttgcagtgaaccaagatcacgctaccacactcaagcctgggcaacggggagactccatctcaaaaaaaaaaaaaaaaaaaaagagatttgacagtacattcatttaatctggcaattttaatttgaacaaatacctattaacaacaaattaaatcctattgcacatgaattatttgttgcaccaccaccagattttctaattctagcagaggccaygatgaaataggccagacatgctgccattaaagtttgctgggatgattgtaataaatctactgaaagtattcaagttctaactttcaaagtgatgtagagaaacataaaagatttcactgtatcatctaaaaatataactgttttgtctgatcattaaattctgatttgcatttactctttgtatatattctagaagaaatccttctaaaacatttaattaatcatacccagttccaaagaaaccgtgagtcaaaagggaaagacaagaagaattagacacagagtaaacatgtagagaac

SEQ ID NO: 119353 - DNA, 601 bp, Human
atccacccgcctcggcctcccaaagtgctgggattataggcatgagccaccacaccctgcccctaattgtatactttcaaaaggcaaaagtaagaatatatgcactgtcatgtggaaagatttctatccaacattcttattaaaaaaaaaaaagtaaaggaaaactaggaagcttataagtgataaatctttgtttttttgagatgaagtctcactctgtcacccaggctggagtgcagtagcatgatcttggctcactgcaatctccacctccagggttcaggcgattctcctgcctcarcctcccaagtagctgggattacaagcgtgtgacaccacgcctcgctaatttttgtatttttaatagagatggggttttgccatgacggccaggctggtctcaaactcccgacctcaggtgatctgccacctcggcctcccaaagtgccagtattacaggcgtgagccactgcgcctggcctaaaagtgataaatcttaaagagctaaaagtgataaaacctctacaaattgttttccagaacaactcattcctactggttccaaagaaacattgtattatgtaatgaggttatgtgctgt

SEQ ID NO: 119354 - DNA, 601 bp, Human
acctaggactgccttgggcaggaacaatgacagtgtgacagtctgagatcactcatgttcagtggaaggggaggatgaactttccacctcagttcccctaaatgaaatcaatgtctaaccacatgaccctcagttaccgaaagcattaccaaaaacaaaggcagattattagattgtggtgataactgtacaactctgtaaatatactaaaacttacgtaattgtatacttttttttttttttttagacagagtctcggtctgtcgcccaggctggagtgcagtggcggatctcggctcgmtgcaagctccgcctctcgggttcacgccattctcttgcctcagcctccccagtagctgggactacaggcgcccgccaccacacccggctaattttttgtatttttagagacggggtttcaccgtgttagccaggatggtctggatctcctgacctcgtgatccacccgcctcggcctcccaaagtgctgggattataggcatgagccaccacaccctgcccctaattgtatactttcaaaaggcaaaagtaagaatatatgcactgtcatgtggaaagatttctatccaacattcttatt

SEQ ID NO: 119355 - DNA, 601 bp, Human
gttctatcttaaattatgagaagcacagggtatactgatccaagcccctaagggtgccttttaaaaagagaaaggcagaataaacagtgaaactttagaggaaaagctagaaatacatatccataataaatgaagaattctaagtgtaaatatagagaaatatatacagacacacatgaacatccattgtgaaaacttcaagtgtccaagttgctgtgctgaaattttgcttaataaactactacccaaaatgagtcaatggcctcaatgttacattgattattatcaaagactctttttkttctttttttttttttagacggagtctcactttgtcgcccaggctggagtgcagtggcatgatctcggctcactacaagctccacctcccaggttcacaccattctcctgcctcagtctcctgagtagctgggactacaggcgcccaccaccacgcctggctaattttttgtattttttagtagagacgggttttcaccgtattagccaggatggtctcgatctcctgaccttgtgatccgcccgcctcggcctcccagagtgctgggattacaggcgtgagccaccgtgcccggcctca

SEQ ID NO: 119356 - DNA, 601 bp, Human
ctagcaagttaatgacagagttcttacttttttttcttttcttcgaccgttttgctctgttgcccaggctggagtgcagtggcgcgatctcagctcactgcaacctccacctcccgggttcaagtgattctcatgtctcagcctcccgagtagctgggattacaggcacccgccaccacgcccagctaatttttgtatttttagtagagacagggtttcaccatgttggccaggatggtctcgatctcttgaccttgtgatctgccccccttggcctcccaaagtgttgggattacaggtktgagccactgtgcccggcctaatgacagagttttcttattcaatgtgcttttgcccttaggctagtatttattaaatgctatttcctaagcctttctcttggcatgtacctttcccacctccaatggccgtcactatttggggccatttcacaccagcatctggagttgactgacaagagcaaggtttcgcatttctgcaaatgaatgaatgctttaaactaaacatgacacataatattcttggttataaaatcatagttgcatttacttagatggagagtaaattttgtgccaaatgc

SEQ ID NO: 119357 - DNA, 601 bp, Human
ggtatgtaaaaggggaagaatcaatactgtagaacactcacacgctgatttatcactaggcacaaatctaaattcagtaataggttcaacatcatcatcactgtcttcctcttcttcatcagcaacaggttcttttgattcttctagaaaataaaatacccttttaatgtcattatttgactttaaaaaaatgaagcatattgaaaatctgaatattgcaattcaattttaatttccaattatggttgacaaatttatttccaattatggttgaaaaattctgattatacagtgagcatcmtagaaaagccttgcctcgatctcctgacctcgagatccacgcaccttggcctcccaaagtgctccctccgcgcctcaccgggaatgaatttttaaggttatttttaaggtaatctaatctcatcaacaatgagctaagggtcaacttttttttctgagactgggacttgttttgttgcccagactggacacccttgccctctcaggcccaagcgatcctcccacctcagcctactaagcagctgggactacaggcacttgccaccacaccctgctaatttttgtttttttgagatggggt

SEQ ID NO: 119358 - DNA, 601 bp, Human
agaccctgttgcaaaataataatagtaataataaaacaatataaatgatccaggttctcaaggtgtagagagagaagcttgttctctgggggcagctgcctcagcttaaaagactttcctgaccatccacttccctatctaccattttctttcctcccatatgctctacttacccattcttccccataacaatctctatttcttacactcaaaaatttgtctgttgcaaagggctttggcataaagtgttctaccgtgtcattctattttaataataatcttaccagccaggcacagtggytcacacctgtaatcccagcactttgggaggccgaggcaggcggatcacctgaggtcgggagttcaagaccagcctgaccaacatggagaaaccccatctctactaaaaatacaaaattagcctggcgtggtggcgcatgcctgtaatcccagctacttggaaggctgaggcaggagaatcgcttgaacctaggaggcagaggttgcagtgagccgagaccacgccattgcactccagcctgggcaacaaaagcgaaaactccatctcaaaaataataataataattttaccatactgcat

SEQ ID NO: 119359 - DNA, 601 bp, Human
cggtggctcatgcctgtaacccagcattctgggaggccaaggccagaggattgcttgggcccaggagttggagaccagcttgggcaatatggcaaagcccagtctttataaaaaatacacaaaaattagccaggcatggtggcgcaagcctgtagtcccaggtactcaagaggctgagctgggagaatcatttgagtccagcaggcagaggttgcagtgagcagaaatcacaccactgcacaccagcctgggcatcagagtgagaccctgttgcaaaataataatagtaataataaaacartataaatgatccaggttctcaaggtgtagagagagaagcttgttctctgggggcagctgcctcagcttaaaagactttcctgaccatccacttccctatctaccattttctttcctcccatatgctctacttacccattcttccccataacaatctctatttcttacactcaaaaatttgtctgttgcaaagggctttggcataaagtgttctaccgtgtcattctattttaataataatcttaccagccaggcacagtggctcacacctgtaatcccagcactttgggaggccgaggca

SEQ ID NO: 119360 - DNA, 601 bp, Human
aaaaaaaaaaaaattagaaattctggaacatacaaaaaggatgaaaaattttaaatcactcaaaaatctcagaaagataaggatatatttggatatatttaggtatgtgatggcggatcccagaaatgtgtttatctcaggccaggaagtgggtacatatgaaggaaagggctttggatacccagattggtgtacataagaccagtagggaaaagaaaagagaacagcaggtacttcaagctataaagactcttatcacgctagtgactgcattctggtctgggggaggcaatcggaaagrgctcttaaataaatgaagtatggttctgagaaaaagaaatgaccttggcagtgagctgtttgaaggaacatgttaaataaagatgcaggccaggcccggtggctcatgcctgtaacccagcattctgggaggccaaggccagaggattgcttgggcccaggagttggagaccagcttgggcaatatggcaaagcccagtctttataaaaaatacacaaaaattagccaggcatggtggcgcaagcctgtagtcccaggtactcaagaggctgagctgggagaatcatttgagtccagcag

SEQ ID NO: 119361 - DNA, 601 bp, Human
aaataagacagaatcatggccgggtgcagtggctcacgcctgtaatcccaatactttgggaggctgaggcgggcggatcacctgaggtcaggagttcgagaccagcctggccaacatggtgaaaccccgtctctacaaaaatacaaaaattagctgggcacgatagtagtgggtaatccctgctactcaggaggctgaggtgggagaatcacttgaacctgggaggcagaggttgcagtaagccgaggtcacgttattgtactccggcctggacgacagagcaagactctgtctcaaacacacacacacacacacacacacacacacaatcagtgtatatacacacacaaaaggacacaagactgaaaggatatgcaacagaaaattaatagtaaatgcatctcagaattatatttatttttttctacctcttctttgcctgtgcatactttaagccaacatggtggaaccttgtctctactaaaaatacaaaaattagctgggagcggtggcaggcgccagtaccccagctattcaggaggctgaggcaggagaatcgcttgaacccaggaggcggaggttgtagtgagccaagatcgtg

SEQ ID NO: 119362 - DNA, 601 bp, Human
ataaataagacagaatcatggccgggtgcagtggctcacgcctgtaatcccaatactttgggaggctgaggcgggcggatcacctgaggtcaggagttcgagaccagcctggccaacatggtgaaaccccgtctctacaaaaatacaaaaattagctgggcacgatagtagtgggtaatccctgctactcaggaggctgaggtgggagaatcacttgaacctgggaggcagaggttgcagtaagccgaggtcacgttattgtactccggcctggacgacagagcaagactctgtctcaaacacacacacacacacacacacacacacacaatcagtgtatatacacacacaaaaggacacaagactgaaaggatatgcaacagaaaattaatagtaaatgcatctcagaattatatttatttttttctacctcttctttgcctgtgcatactttaagccaacatggtggaaccttgtctctactaaaaatacaaaaattagctgggagcggtggcaggcgccagtaccccagctattcaggaggctgaggcaggagaatcgcttgaacccaggaggcggaggttgtagtgagccaagatcg

SEQ ID NO: 119363 - DNA, 601 bp, Human
taaataaataagacagaatcatggccgggtgcagtggctcacgcctgtaatcccaatactttgggaggctgaggcgggcggatcacctgaggtcaggagttcgagaccagcctggccaacatggtgaaaccccgtctctacaaaaatacaaaaattagctgggcacgatagtagtgggtaatccctgctactcaggaggctgaggtgggagaatcacttgaacctgggaggcagaggttgcagtaagccgaggtcacgttattgtactccggcctggacgacagagcaagactctgtctcwaacacacacacacacacacacacacacacacaatcagtgtatatacacacacaaaaggacacaagactgaaaggatatgcaacagaaaattaatagtaaatgcatctcagaattatatttatttttttctacctcttctttgcctgtgcatactttaagccaacatggtggaaccttgtctctactaaaaatacaaaaattagctgggagcggtggcaggcgccagtaccccagctattcaggaggctgaggcaggagaatcgcttgaacccaggaggcggaggttgtagtgagccaaga

SEQ ID NO: 119364 - DNA, 601 bp, Human
aacctttcatggtcaagtgtgtctgcaagggtgtgagaattgcatggtgtgactgttctatggaataatcaatgaactctgttgccttttgacttctttttactttttctttttttcgaaataccttgtagcagaatggtaagagcacagtttctggagctagaatgcctggtagccttgggaagttacttaatctgtgcctcaattttctgatctgtaaaatgtgaataatattgtgcatatcctcatatttctggttccttaagaaggccctcatatttactactgtaaattgaattgyagctctgtagcatagaagaataattttgtaaattattatacatcaattagccacctcgatatatttaaggtcctaaccatcagccatgattccacaatctaaggaaaacacccactctttagctgagccaatgtttctgttccatcctacgaggtagagttttatgatttgattattccagaagagctctgtaattattgtttcagatgtagagaatcaggttggctgtagccctttaacaaccctatcttgaggagcttgcttggtcaggtctataagtataaacaataaaactatcaa

SEQ ID NO: 119365 - DNA, 601 bp, Human
ttcagttacttggctgggcttaaacagtcattggtagcagaattgccttttcaaccatttttatttttctggaaaggctttgcagcagggctgagagtttatatgatctgtggatgtatagttttggataagtagagaagacagcattccagacctagggtctgagttaactgcaaagtcaatgtgaataatatggcttctgaagataatgaggaacatttcattgaggaacctttcatggtcaagtgtgtctgcaagggtgtgagaattgcatggtgtgactgttctatggaataatcartgaactctgttgccttttgacttctttttactttttctttttttcgaaataccttgtagcagaatggtaagagcacagtttctggagctagaatgcctggtagccttgggaagttacttaatctgtgcctcaattttctgatctgtaaaatgtgaataatattgtgcatatcctcatatttctggttccttaagaaggccctcatatttactactgtaaattgaattgtagctctgtagcatagaagaataattttgtaaattattatacatcaattagccacctcgatatatttaaggt

SEQ ID NO: 119366 - DNA, 601 bp, Human
aagttggaatggttcagttacttggctgggcttaaacagtcattggtagcagaattgccttttcaaccatttttatttttctggaaaggctttgcagcagggctgagagtttatatgatctgtggatgtatagttttggataagtagagaagacagcattccagacctagggtctgagttaactgcaaagtcaatgtgaataatatggcttctgaagataatgaggaacatttcattgaggaacctttcatggtcaagtgtgtctgcaagggtgtgagaattgcatggtgtgactgttctrtggaataatcaatgaactctgttgccttttgacttctttttactttttctttttttcgaaataccttgtagcagaatggtaagagcacagtttctggagctagaatgcctggtagccttgggaagttacttaatctgtgcctcaattttctgatctgtaaaatgtgaataatattgtgcatatcctcatatttctggttccttaagaaggccctcatatttactactgtaaattgaattgtagctctgtagcatagaagaataattttgtaaattattatacatcaattagccacctcga

SEQ ID NO: 119367 - DNA, 601 bp, Human
ttagctaatcggtctggtgtgtgtgtgtgtgtgtgtgtgtgtgtgtgtgtgtgtgtgtgtgtgaaagagagagagagagagagagagtgttggggaaagggaaagagagtgtaatttaccattggttttttggttttttggttttttgttgttgttgtttttttttttgggtgggggggagttttactcctgttgcccaggctggagtgcaatagtgcaatctcagctcaccgcaacctccaccttccgggttcaagcaattctccgcctcagcctcctgagtagctgggattacaggcaygtgccaccacgcccggctaattttttgtgtttttagtagagatgggggttccaccatgctggtcaggctggtctcgaactcccgacctcaggtgatccacccacctcccaaagtgctgggattacaggcgtgagccaccgtgcctggccggggtatttttatataacaaacgcctagtaaacatctatagaaaatacacagatgagtgaatcgtggacagagtttactatttgtatggctggtagtcctaagcttcagggtgtccaattagagttctggtattacaaagtggaagggagt

SEQ ID NO: 119368 - DNA, 601 bp, Human; identical to SEQ ID NO: 26352

SEQ ID NO: 119369 - DNA, 601 bp, Human; identical to SEQ ID NO: 26353

SEQ ID NO: 119370 - DNA, 601 bp, Human; identical to SEQ ID NO: 26354

SEQ ID NO: 119371 - DNA, 601 bp, Human; identical to SEQ ID NO: 26355

SEQ ID NO: 119372 - DNA, 601 bp, Human; identical to SEQ ID NO: 26356

SEQ ID NO: 119373 - DNA, 601 bp, Human
ggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagctactcaggaggctgaggcaggagaatcgcttgaatctgggaggtggaggttgcagtgagccgagaacacaccattgcactacagcctgggcgacaagagtgaaactcatctcagggaaaaaaaaaaaaaagctctgggttgaaayccgggcgccgccaagatgccggctcattactcttctctcatggatcctgacaccaaactcatcggaaacatagcactgttacctatcagaagtcaattcaaaggacctgcccccagagagacaaaagatacagatattgtggatgaagccaactattacttcaaggccaatgtcttcttcaaaaactatgaaattaagaatgaagctgataggaccttgatatatttaactctctacatttctgaatgtctgaaaaaactccaaaagtgcaattccaaaagtcaaggtgagaaagaaatg

SEQ ID NO: 119374 - DNA, 601 bp, Human; identical to SEQ ID NO: 20153

SEQ ID NO: 119375 - DNA, 601 bp, Human
tttcacatgggcaaaatactgaaacagttgagcgaattttgtatatgcagagtaatgtcattgatgggaggagcagtactatggactttctaataagtctatggcttatgtcctgtggcagttcttcacctttttaataggcccattccaaaaaaacccacaaagatatgcaggggagaatggccttatattcaggatagcttcatacctattttagaatcacttagaaaatctgatgctttcactactagtattagtagtagagtccttgcaacatactttaccattaaacgggacttgrtcaggcatggtggctcacgtctgtaacccagcactttgggaggctgtggcaggcagatctcttgagctcaggagttcaagaccagcctgggcaacatagtggaaccctgtctctacaaaaaattaaaacgttagttgggcatggtggcgtgtacctgtggtcccacttactggggaggctgaggtgagaggattgcttgagctcaggaggtcgaggctgcagtgaactaaggttgtaccactgcactccagcctgggtgacagagcgacaccctgtctctaaataaataaataggactta

SEQ ID NO: 119376 - DNA, 601 bp, Human
agtactatggactttctaataagtctatggcttatgtcctgtggcagttcttcacctttttaataggcccattccaaaaaaacccacaaagatatgcaggggagaatggccttatattcaggatagcttcatacctattttagaatcacttagaaaatctgatgctttcactactagtattagtagtagagtccttgcaacatactttaccattaaacgggacttgatcaggcatggtggctcacgtctgtaacccagcactttgggaggctgtggcaggcagatctcttgagctcaggarttcaagaccagcctgggcaacatagtggaaccctgtctctacaaaaaattaaaacgttagttgggcatggtggcgtgtacctgtggtcccacttactggggaggctgaggtgagaggattgcttgagctcaggaggtcgaggctgcagtgaactaaggttgtaccactgcactccagcctgggtgacagagcgacaccctgtctctaaataaataaataggacttaaatagattgaaaatcgatgcaggtctagctgatagcaaggcattctctaaggagaaaagacaaagctcacttca

SEQ ID NO: 119377 - DNA, 601 bp, Human
tctatggcttatgtcctgtggcagttcttcacctttttaataggcccattccaaaaaaacccacaaagatatgcaggggagaatggccttatattcaggatagcttcatacctattttagaatcacttagaaaatctgatgctttcactactagtattagtagtagagtccttgcaacatactttaccattaaacgggacttgatcaggcatggtggctcacgtctgtaacccagcactttgggaggctgtggcaggcagatctcttgagctcaggagttcaagaccagcctgggcaacakagtggaaccctgtctctacaaaaaattaaaacgttagttgggcatggtggcgtgtacctgtggtcccacttactggggaggctgaggtgagaggattgcttgagctcaggaggtcgaggctgcagtgaactaaggttgtaccactgcactccagcctgggtgacagagcgacaccctgtctctaaataaataaataggacttaaatagattgaaaatcgatgcaggtctagctgatagcaaggcattctctaaggagaaaagacaaagctcacttcaaagagcttaggagggaactaaaa

SEQ ID NO: 119378 - DNA, 601 bp, Human
gttgggcatggtggcgtgtacctgtggtcccacttactggggaggctgaggtgagaggattgcttgagctcaggaggtcgaggctgcagtgaactaaggttgtaccactgcactccagcctgggtgacagagcgacaccctgtctctaaataaataaataggacttaaatagattgaaaatcgatgcaggtctagctgatagcaaggcattctctaaggagaaaagacaaagctcacttcaaagagcttaggagggaactaaaatcttccgtctggttaacagtttaactttcaaaaaaaaaaaacaaaacagtttaactttcaaagttatgggaaaactagcctttatactgtaagtagttttggttgctgtggtagttaacatggctgtcttattgaatgtttctacagctttcattttgcatttagtagtgtgggggtacaatggtagggaaaagtaatttgaaaaagagccaaaccaaaagaaaagagacaggtttaggttttttacgacacaaacagtagatagcaggttatgggaagttggtttttttattattgtttttgtttagaaggcaaagatgaggctgagtgtggtggc

SEQ ID NO: 119379 - DNA, 601 bp, Human
ccagtcaaaacatttttatgactagaagatgtttgagcgtgtagggcaatgagcaaatataggtggagcaaattggaagccagggttttaagtaaatggctgtattatagcagttaataacagtggcaggcttggttactggagtagatgtaatcactgtgtaaaatgaatagcagtacattattttctcctcttcccaaaaaagatttgatctggcttatggttaaaaaaaaaaaaagctgtgttacagaggacagtagaaacaaaatacgtggcagtcatttagaactggagaaatgatttcccccaagataaaaaaccattgttatcagtgtatacactggttttttccaaacttaaaattgcaaattggagaatccccctggtgttacaaatggagccattagccagctgtgatatcagattactatgtcacggatttagaacttgggacagtgatcctctggcacattagaatccatagtactgaaaaaagtcaaatacaattaacacacacttgattatttgagtgattttttttcaagaatagtctcatcagtatttcatgtctgtgccgcattaatgcacagtggttaggatc

SEQ ID NO: 119380 - DNA, 601 bp, Human
actttacaaaggaagttaattataagaatagttatattcgtgctaaattcgaaatagtacagaaggtcataatatgaaaagtaaattggatcgcatgagtccaggagtttgagaccagcctgggcaacaaagtgagatcccatctctacaaaaaatcaaattagctgtgtgtggtggtgcatactcaggaggttgaggcaggagggttgcttgatcccagaaggttaagtctgcagtgaaccgtgattgcaccactgtacttcaacctgggttatggagtgagatcctgtctcaaaaaaaraaagaaaaaagtaaatctccctaccccaacctctagtcccaaatcccaaatccaaatttaattttttgcatttttccagaaatcataatgcatatatatagatacagatttttttcaagctaagatcaagctattttatgcatgtcttttttttatatcttttaaaaaaattattttaggctttttttttttttttttttttttttgagacaggttctcactctgtcactcaggctggagtgcagtgttgtgatctcagcccgctgcaacctcagcctcccaggttcaagccaccctccc

SEQ ID NO: 119381 - DNA, 601 bp, Human
atttttttcaagctaagatcaagctattttatgcatgtcttttttttatatcttttaaaaaaattattttaggctttttttttttttttttttttttttgagacaggttctcactctgtcactcaggctggagtgcagtgttgtgatctcagcccgctgcaacctcagcctcccaggttcaagccaccctcccacctcagcctcctgagtagctgggactacaggcacatgccaccatgcccagctaatttttgtatttttagtagagatagggtttcaccatgttggccaggctgatctygaactcctggcctcaagtgatctgcctgcctcagcctcccaaagtgttagtattacaggtgtgagccactgtgcctggccaattttagccttttctctacatactatattattagattcattgggctatattctattaaaatggcatcctgagtcttagttaacactggagaatttgtcttatgttatatattagagaattggttagatttatgtaatacttttaagggtaataattttatcttctaattgaagctaaatttatggtttttagatgtggccaattagatagtgctttgca

SEQ ID NO: 119382 - DNA, 601 bp, Human
gtcgcgtgagaacacttgaaaataagaataacttactggaaattgaagtggtaagtactctttttttggtgggtgttctggtgagacaaatgaattatttcgtgataacatcagttatgtttcttgtctttttaaggaaggcttatgaagtttatatttttagtgctgttggcttcatataatgctataaactttacccttttttttttttttgagacggagtctcgctctgttgcccaggctggagtgcagtggcgcggtcttggctcactgcaagctccgcctcccgggttcacgccawtctcctgcctcagcctcctgagtagctgggactacaggcgccctccaccacgcccagctaattttttgtattttttagtagagacggggtttcaccgtgttagccaggatggtctcgatctcctgaccttgtgatcctcctgcctcggcctcccaaagtgctgggattacaggcgtgagccactgcaccctttttttttttttttcttttttttgagatggagtctcgctctgtcgcccaggctgtagtgcagttgcgcgatctcagctcactgcaaccttcgcctcccaggttcaggcg

SEQ ID NO: 119383 - DNA, 601 bp, Human
gagatggagtctcgcccttgttgcccaggctggagtgcaatggtgcgatcttggctcactgcaacctccatctccctggttcaagggattctcctgcctcagcctcctgaatagctgggattacaggtgcccaccaccaagcccggctaatttttgtatttttagtagagatgggatttcactatgttggccaggctggtctcgaactcctgacctcaggtgatctgcccgcttcggcctcccaaagtgctggggttactggcacccagcgtattttgttttatatgttgttttcatcttwgccttttttttttttgagacagggtctcactccatcgcccaggctagagtgctgtggagccgtcatggcttactgcagtctcaacctcttgggctgaagtgctcctcccatctcagcctcctgagtagttgagactataggcacacaccaccacacccagctgatttttaaaattttttgttgagacacgctatgtcgcccaggctggtcttaaactcctgggctctagcagtcctcccaaagtgctgggatttccgctgtgagccacagtgcctggcctgtttgcttttttagttcctc

SEQ ID NO: 119384 - DNA, 601 bp, Human
caagctggagtgtagtggcatgattatagcttactggagccttgaagttctgggctcaagtgatcttcctgcctcagccctctgagtagctaggactataggcatacgccaccacacctggctaattatttatttttatgtttactctttattttatttttttgagaaggagttttgcttttgttgcccaggcaggagtgcagtggcgctatctcggctcactgcaacctctgcctcccaggttcaagcgattcccctgccttagcctaccatgtagctgggagtacaggtgtgcaccacyatgcctggctaattttttgtattttagtagagatgggttttcacagtttttgccagggtggtctcgatctcctgacctcaggtgatccgcccacctcagcctcccaaagtgctgggattacaggcgtgagccaccgtgcctggcctctattctattttttaaacaattccaaagtcctgcataggttcaaggggagggaaaatggataccatctcttaatggaacacagcaaggttctgcaagagcttatgggtctggaaatattgctgtggctgttactgggaaatatagcctgttata

SEQ ID NO: 119385 - DNA, 601 bp, Human
accatgcctggctaattttttgtattttagtagagatgggttttcacagtttttgccagggtggtctcgatctcctgacctcaggtgatccgcccacctcagcctcccaaagtgctgggattacaggcgtgagccaccgtgcctggcctctattctattttttaaacaattccaaagtcctgcataggttcaaggggagggaaaatggataccatctcttaatggaacacagcaaggttctgcaagagcttatgggtctggaaatattgctgtggctgttactgggaaatatagcctgttataatagtctctttctctgaatgcagtggttgggacatagaatatgagctttgttatcttttttagatattgctaaattgctctctgaaatggttgtaccagtttattttcctgccagtagtgtatgataattcttatttttctagattatttccagtgcttggtattgtcaagccttttaatttttcaagtgtgattaagaggaaatggttatacgtattgcatccatcttcttttggtatttttatgggatacaagttttgggtgttttttgtttgtttgtttttgagatggagtcttg

SEQ ID NO: 119386 - DNA, 601 bp, Human
tggttgggacatagaatatgagctttgttatcttttttagatattgctaaattgctctctgaaatggttgtaccagtttattttcctgccagtagtgtatgataattcttatttttctagattatttccagtgcttggtattgtcaagccttttaatttttcaagtgtgattaagaggaaatggttatacgtattgcatccatcttcttttggtatttttatgggatacaagttttgggtgttttttgtttgtttgtttttgagatggagtcttgctcttgttgtacaggctggagtgcartggcgcaatcttggttcactgcaacctctgcctcccggcttcaagcaatctcttgcctcaacctcctgaatagctgggattacaggcacccaccaccatgcctcactaattctttttgtatttttactagagacagtttcaccatgttggccaggctggtcttgaactcctgaactcaggtgattcacccgcctcagtctaccaaagtgttgggattacaggtgcgagccacggcgcccagcccagaattacctcttacgtaatatatggtatgagtaggaattgaacttgatcctccct

SEQ ID NO: 119387 - DNA, 601 bp, Human
ctagattatttccagtgcttggtattgtcaagccttttaatttttcaagtgtgattaagaggaaatggttatacgtattgcatccatcttcttttggtatttttatgggatacaagttttgggtgttttttgtttgtttgtttttgagatggagtcttgctcttgttgtacaggctggagtgcaatggcgcaatcttggttcactgcaacctctgcctcccggcttcaagcaatctcttgcctcaacctcctgaatagctgggattacaggcacccaccaccatgcctcactaattctttytgtatttttactagagacagtttcaccatgttggccaggctggtcttgaactcctgaactcaggtgattcacccgcctcagtctaccaaagtgttgggattacaggtgcgagccacggcgcccagcccagaattacctcttacgtaatatatggtatgagtaggaattgaacttgatcctccctgcctccaatgattaaccagttgtcccagaatcatttttaaatagattttccttcccttactgacttctgttgtacattttatttccttctcgtgtaaatctcctttgaggctctga

SEQ ID NO: 119388 - DNA, 601 bp, Human
tggtctcggactcctgacctcaggtgatctgcccgcctcagcctcccaaggtgctgggattacaggcgagagccactgcgcctggcctctttctttcctttttgagatggaatcttgttctgtcgcccaggctggagtgcagtggcatgatcttggctcactgcaacctccacttcctgggttcaaacaattctcttgcctcagcctcctgagtagctggggttacaggcgcgtgccaccatgcctagctaatttttgcatttttagtagagatgagatttcaccatattggccaggctgrcctcgaaatcctgacctcaagtgatccacttgcctcagcctcatgaaaggctgggattacaggaatgagcccctgtggctggctcgatattgttatttcttaaattttacatattatctataattgtggtgggtgaagatctaggtcctagctgaagatgaagatctagatcctaactgtgattctgggtgtatgttttcttcagatttgaaggctttgttttattgcctatgacatgatcaattcttttcctttctctcccctcccatggctttcaaagtttcaagcctgcagaaaaat

SEQ ID NO: 119389 - DNA, 601 bp, Human
agacggagttttgctcttattgcccaggctggagtgcaatggcacgatctcagctcaccacaacctccgcctcccgggttcaagcaatgctcccgcctcagcctcccaagtagctgagattacaggcgcacaccaccccatgcccagctaatttttgtatttttagtagaaacggggtttcaccatgttggtcaggctggtctcgaactcctgacctcgtgatccacccgcctcggcctcccaaagtgctaaggattacaggcttgagccaccatgcccggcctctcctgtgtaatctcartgtacttttcatcctcaggaaatttaacattgatataatactaatatgtaaatacattctgtctatattcaaatgttgccagttgtctaaataatatcctttatagatgtattgttttttgctttttaatccagaatccaatcaaggatcacacattgcatttattgttatcatttctttgagacaggatctcactctgtcacccaggctggagtacagtaggcatattcatagctcactgcagcctcaacctccagggctcaagtgatcctcttacctcagcctctccgactgctgaga

SEQ ID NO: 119390 - DNA, 601 bp, Human
ctgggctctgattacttaaggaatttcaaccagttttctgtggtcagccctgtgcctcaaccctgtccatctctaaacctgggtttcaaggtgggcatctctcacagttatgctgacatcagcctgcttttcatcagcatttctggattcaggcacttggggttgtatccacttccaccctgctaaggcacttttttcctttttctttttttttttttttttttttttgagacagagtcttgctctgtcaccttggctggggtgcagtggcaccatctcggttcactgcaacctctgcctyccaagttcaagcaattttcctgcctcagcctcctgagtagctgggactacaggcacgtgccaccacacctgactaatttttgtatttttagtagagacggggtttcgctatgttagccaggctggtcttgaactcctgacctcagatgatccacctgcctcggcctcccaaagtgctgagattacaggtgtgagctaccacgcccggccagcactttgtttcttttcaattttctaagactttattgaaatctctcacctgttactgtcacctcgtttgttttctctttaatttcttcat

SEQ ID NO: 119391 - DNA, 601 bp, Human
ctctaaacctgggtttcaaggtgggcatctctcacagttatgctgacatcagcctgcttttcatcagcatttctggattcaggcacttggggttgtatccacttccaccctgctaaggcacttttttcctttttctttttttttttttttttttttttgagacagagtcttgctctgtcaccttggctggggtgcagtggcaccatctcggttcactgcaacctctgccttccaagttcaagcaattttcctgcctcagcctcctgagtagctgggactacaggcacgtgccaccacaccygactaatttttgtatttttagtagagacggggtttcgctatgttagccaggctggtcttgaactcctgacctcagatgatccacctgcctcggcctcccaaagtgctgagattacaggtgtgagctaccacgcccggccagcactttgtttcttttcaattttctaagactttattgaaatctctcacctgttactgtcacctcgtttgttttctctttaatttcttcattgttagtttagtggactctgagggtgaagagaagaaaattctgttattaatttgtcatctttaaccagaa

SEQ ID NO: 119392 - DNA, 601 bp, Human
ctaaacctgggtttcaaggtgggcatctctcacagttatgctgacatcagcctgcttttcatcagcatttctggattcaggcacttggggttgtatccacttccaccctgctaaggcacttttttcctttttctttttttttttttttttttttttgagacagagtcttgctctgtcaccttggctggggtgcagtggcaccatctcggttcactgcaacctctgccttccaagttcaagcaattttcctgcctcagcctcctgagtagctgggactacaggcacgtgccaccacacctgrctaatttttgtatttttagtagagacggggtttcgctatgttagccaggctggtcttgaactcctgacctcagatgatccacctgcctcggcctcccaaagtgctgagattacaggtgtgagctaccacgcccggccagcactttgtttcttttcaattttctaagactttattgaaatctctcacctgttactgtcacctcgtttgttttctctttaatttcttcattgttagtttagtggactctgagggtgaagagaagaaaattctgttattaatttgtcatctttaaccagaaat

SEQ ID NO: 119393 - DNA, 601 bp, Human
gggtgtgagccaccgcatccagctttattttgaaataatatcaaatgtacagaaaccattccagaaattgagaattgtcccattccctttacattgaatcaccagttctctattgacctttctctttcatgacattggcatttttgaaggctataggcagttattttgtagactgtacctcagttgatagaataacgtttaattttgtggtataatttttttttgtttttccttgtagcttttaggagagtatgagtcccttggaaaagaacacaggagagtaaaggtaaggggtaatggytcatgttctagatttcatgcagaggcagaaacattggattgggaatcaagggatctgactcttctcctccttgcaccccttcctgaacctccgtagctgttgaactggaaccttgcttatcctgtttcagtatccttattttcaaatacctgccccatttaactcacaagtttgttagattcattaatctgacaaatatttattgaatggctattgcatttgaaatgaaattgttcaaaagagtataaggtaccatacagatgcaaattattatttaatactgtttgttttgtgacaccc

SEQ ID NO: 119394 - DNA, 601 bp, Human
ttttcaaatacctgccccatttaactcacaagtttgttagattcattaatctgacaaatatttattgaatggctattgcatttgaaatgaaattgttcaaaagagtataaggtaccatacagatgcaaattattatttaatactgtttgttttgtgacacccaggttggagtgcagtggtgtgatctcggctcaccacaacctctgcctcctgggttcaagcgattcttctgccttagcctcctgagtagctgggattacaggtgtgcgccaccatgcccagctaatttttatatttttartagagacaggatttcaccatgttggccaggctggtctccagttcctgacctcaagtggtccacctgtgtcagcctccctgagtgctgggattatgggcatgagccactgcacccagccatttaatactgattaaatatcaagctttgattttcactgcattagcttttggtagggttgagtttatcaattatgtttgaattctttttgaaagctctgtttggagactacatatttgcattcagtaaaacccttcgacgatggtgtaagtggggcccaagtatttctgttgcatagaatgg

SEQ ID NO: 119395 - DNA, 601 bp, Human
tgtttgttttgtgacacccaggttggagtgcagtggtgtgatctcggctcaccacaacctctgcctcctgggttcaagcgattcttctgccttagcctcctgagtagctgggattacaggtgtgcgccaccatgcccagctaatttttatatttttagtagagacaggatttcaccatgttggccaggctggtctccagttcctgacctcaagtggtccacctgtgtcagcctccctgagtgctgggattatgggcatgagccactgcacccagccatttaatactgattaaatatcaagstttgattttcactgcattagcttttggtagggttgagtttatcaattatgtttgaattctttttgaaagctctgtttggagactacatatttgcattcagtaaaacccttcgacgatggtgtaagtggggcccaagtatttctgttgcatagaatggagggttgtggttattgaagctcagcaaaaaggcctgcatagcttggctgccaaagcattctgagggttcgggagcagatcccatgatatctaaatctcattgaaaatatttgttttaccatccttctgaggttttagtcaagt

SEQ ID NO: 119396 - DNA, 601 bp, Human
gttattttaacactgatttgtttctaattaagcaaagtataaagggctgtatctgttacccaggggacttacacagagggacttgtgtaggccggtgctttgctctcatttgttttccttgaactgttggtcctggctgtatggttgatgccatacttgctgagtatggtttgtagctagttggtttagccttagattcattttcttttatgcattttaaaataattcatgtgaatatttgtcttcagttatctgaatttctcctttatttccataggatgcattaaatacaactgagaayaaattgcttgatgcatatactcagatttctgatttgaaaaggtaaaatgtattaacttactaatgtacacatacctcaattgttcttttatgtgtctgtattgaacatgatgagaaggaagtttttcttgaggatttttaagcagtttgagaactagttttgtcttaattttcccttgacatggaaataggtttcattttagccaaacaagatttcttctctctctctctcttttttttttttttttttttaaagagacagggtctcactatgttgcctagattggctgtgaattcctgg

SEQ ID NO: 119397 - DNA, 601 bp, Human
gaatatttgtcttcagttatctgaatttctcctttatttccataggatgcattaaatacaactgagaacaaattgcttgatgcatatactcagatttctgatttgaaaaggtaaaatgtattaacttactaatgtacacatacctcaattgttcttttatgtgtctgtattgaacatgatgagaaggaagtttttcttgaggatttttaagcagtttgagaactagttttgtcttaattttcccttgacatggaaataggtttcattttagccaaacaagatttcttctctctctctctcttttttttttttttttttttaaagagacagggtctcactatgttgcctagattggctgtgaattcctgggctcaagcagtcttcctgccttggcttcctgaatagttgggactacaggcactcatcatcatgcctggctgattttttgttgttgttgttgttgatacagagtcttactctgtcacgcaggctggagtgcagtggcacaatcttggctcactgcaacctcctcctcttgggttcaagcaattctcctgcctcagcctcccgagtagctgggactacaggagtgtaccaccac

SEQ ID NO: 119398 - DNA, 601 bp, Human
gatgcatatactcagatttctgatttgaaaaggtaaaatgtattaacttactaatgtacacatacctcaattgttcttttatgtgtctgtattgaacatgatgagaaggaagtttttcttgaggatttttaagcagtttgagaactagttttgtcttaattttcccttgacatggaaataggtttcattttagccaaacaagatttcttctctctctctctcttttttttttttttttttttaaagagacagggtctcactatgttgcctagattggctgtgaattcctgggctcaagcartcttcctgccttggcttcctgaatagttgggactacaggcactcatcatcatgcctggctgattttttgttgttgttgttgttgatacagagtcttactctgtcacgcaggctggagtgcagtggcacaatcttggctcactgcaacctcctcctcttgggttcaagcaattctcctgcctcagcctcccgagtagctgggactacaggagtgtaccaccacacccagctaattttttgtatttttgatagagacagggtttcgccatgttggccagactggtcttgaactcctgacctc

SEQ ID NO: 119399 - DNA, 601 bp, Human
ttgatagagacagggtttcgccatgttggccagactggtcttgaactcctgacctcaagtgatccgcctgcctcggcttgccaaggtgctgggattcaggcataagccacggagcccggcaagcctggctgatttttaaaaactttttttagaagtaagatcttgctgtgttgccctgactggtctcagatctctcgacctcaagtgatcctctcgtctcatccacaaaaagtgctgggattacaggcatgcgctactgcacctggcttcaaacaacatgttttaagtaattaaaatgtaytgatggttgtgcctcagaggtggatattttcccaaacattatgtattttctcagcataggttaaaatccaaatgatatttaaccactggcaagaactttaagaagcagcctagttcacagaattattttggtgcttcaaaaagaaaacagcattaacaccaaaattatggtcatctactttcagaaagaccggttggagactgtattaatgatctgatttgtttaattaggtagggacagaatcgtaaatggtagtatccattgcaaatgattagaaatatccaaactgggctgggtgca

SEQ ID NO: 119400 - DNA, 496 bp, Human
ctgaggcaggagcatctcttaagcacaggggtttgaggctgcagcaagcaatgatcatgccagtgcactccagcctgggtgaccgagcgagacctcatctcttaaaggggggaaaaaagaacagcatgaatgccaggatatctttaaaatagtcagttggccagagtagttatttcctgttggtaaacttgaaaataggcttttattttgaacatggcacaaatcagatgaaatacctataggttgtttgcaatattttagccttggcctctttttaaaaattagaaaggttttttttttgttttgaaatttttttggtaaaagttctgtttttggaagttaagcctgcttccttgtttgtgaaagtgttacctattgtatgcatggttatatacatattaggattaaacacattagaatgcagtttatttgacaattttatgtttatttataaatgttatgttttgatctgtatagtgatgaactactcgccagc

SEQ ID NO: 119401 - DNA, 601 bp, Human
atgataaattttggagtcatgccgggtgcggtggctcacgcctgtaatcccagcactttgggaggccgagatgggcggatcacgaggtcaggagatcgagaccatcctggctaacatggtgaaaccccatctctactaaaaatacaaaaaattagccgggtgtggtggcgggcgcctgtagtcccagctactcaggagactgaggcaggagaatggcgtgaacccgggaggcggagcttgcagggagccaagatcgcgccactgcattccagcctgggcaactgagcaagactccgtctcaaaaaaaaaaaaaaattggagtcgtctctttctagatggtgcgtaaagttgtagaatggatgtaaactgagtgtgtttagtgagaagtaggcctggggcaagaactctgacactggtgttggatagagagagctggcaaaggaacccgagaaagcgctgccaaaaagctagaggaaaacaagcagccaccggtattgagtgcaaaacccaacttgtgtttccctgtgctctcacaccagcacaacaaaaatagactcagaagacttttgtgacccagaatgtgtgacatttctcctcacca

SEQ ID NO: 119402 - DNA, 601 bp, Human
atagactcagaagacttttgtgacccagaatgtgtgacatttctcctcaccagcaagcgagcaatcagttcttcatgggacctagctgggtggcctcccattcatctctgatactatctacccagagatagggtcagatcccataagctgagggctcagtccccaagacttcccatttcagacaccatttgcaagtccaggcctccaaaacgtctaaccaactggcttcaagttgaggttcccacagccctctctttgggtttgattaatttgccagagtggcttatagaactcagagaawcatgtttaccaacttattacagatgatattttaaaggatacaaataaacaaccagttgaagagatacagagtaaggtctggaaggatctccagcacaggagtttctttcccagtagagctggggtgtgatgccccctcagtgcgtggatgagctcttgttcagctctccagaagctctggagccctgtccttttgggcattttatggaggtttcattggacaggcctgattgaagcttggacgactgtgttgaaatgtgattggacagaaaggatgtgatctaaacccagcaaggccttt

SEQ ID NO: 119403 - DNA, 601 bp, Human
gggtcagatcccataagctgagggctcagtccccaagacttcccatttcagacaccatttgcaagtccaggcctccaaaacgtctaaccaactggcttcaagttgaggttcccacagccctctctttgggtttgattaatttgccagagtggcttatagaactcagagaatcatgtttaccaacttattacagatgatattttaaaggatacaaataaacaaccagttgaagagatacagagtaaggtctggaaggatctccagcacaggagtttctttcccagtagagctggggtgtgaygccccctcagtgcgtggatgagctcttgttcagctctccagaagctctggagccctgtccttttgggcattttatggaggtttcattggacaggcctgattgaagcttggacgactgtgttgaaatgtgattggacagaaaggatgtgatctaaacccagcaaggcctttctgttcagatccttcttggcctctttgtgcagcattccttcccccagaggatgaggcaggaccctctctgattcgaacaagagtcttatgacccataatcagattagagtcctaccctggtaaggtaaaa

SEQ ID NO: 119404 - DNA, 601 bp, Human
tgatccgcccgcctcagcttcccaaagtgctgggattacaggcgtgagccactgtacctggccccggctgatattttgtatttttaaagtgaacaggaacgaataaaggaaaagtatccagaagatgaaagaactcttacaaatcaataagaaaaagataactttctcaacaaaaaatggtaaaagaatataacaagcagcgcacagatccctgatggctaataaaaatgagaacatgttaattgtcatgaaaatgcacattaaaacaataagatacaattcacaccatcggacaggttakatttaaaattgaaacactttaacgtttggcaaagatatggagagacaggaactctcaaagtaatgattgacagttgatacagcttgtctggagagtgatttggcaacagtcagagaggttgaagatgtgcaccaaatcccacagttgcatgttaagatgtttgccttagaggaattttcacacgtgttaattttagcattgtcgaaaggctgcatattaaaaaccatatttccactgccgggagaaaggacaaatatattcatactatgggtaaatgataaaaatgaatagagcttatat

SEQ ID NO: 119405 - DNA, 601 bp, Human
cagcttcccaaagtgctgggattacaggcgtgagccactgtacctggccccggctgatattttgtatttttaaagtgaacaggaacgaataaaggaaaagtatccagaagatgaaagaactcttacaaatcaataagaaaaagataactttctcaacaaaaaatggtaaaagaatataacaagcagcgcacagatccctgatggctaataaaaatgagaacatgttaattgtcatgaaaatgcacattaaaacaataagatacaattcacaccatcggacaggttatatttaaaattgaamcactttaacgtttggcaaagatatggagagacaggaactctcaaagtaatgattgacagttgatacagcttgtctggagagtgatttggcaacagtcagagaggttgaagatgtgcaccaaatcccacagttgcatgttaagatgtttgccttagaggaattttcacacgtgttaattttagcattgtcgaaaggctgcatattaaaaaccatatttccactgccgggagaaaggacaaatatattcatactatgggtaaatgataaaaatgaatagagcttatatgtactaacacagat

SEQ ID NO: 119406 - DNA, 601 bp, Human
aagtgctgggattacaggcgtgagccactgtacctggccccggctgatattttgtatttttaaagtgaacaggaacgaataaaggaaaagtatccagaagatgaaagaactcttacaaatcaataagaaaaagataactttctcaacaaaaaatggtaaaagaatataacaagcagcgcacagatccctgatggctaataaaaatgagaacatgttaattgtcatgaaaatgcacattaaaacaataagatacaattcacaccatcggacaggttatatttaaaattgaaacactttaacrtttggcaaagatatggagagacaggaactctcaaagtaatgattgacagttgatacagcttgtctggagagtgatttggcaacagtcagagaggttgaagatgtgcaccaaatcccacagttgcatgttaagatgtttgccttagaggaattttcacacgtgttaattttagcattgtcgaaaggctgcatattaaaaaccatatttccactgccgggagaaaggacaaatatattcatactatgggtaaatgataaaaatgaatagagcttatatgtactaacacagataaatttcaaa

SEQ ID NO: 119407 - DNA, 601 bp, Human
ccaaatcccacagttgcatgttaagatgtttgccttagaggaattttcacacgtgttaattttagcattgtcgaaaggctgcatattaaaaaccatatttccactgccgggagaaaggacaaatatattcatactatgggtaaatgataaaaatgaatagagcttatatgtactaacacagataaatttcaaacataatattgaacagagaaagcattaaaggccaggtgtggtggctcacgtctataatttcagcattttgggaggccaaggtggggaaattgcttgagcccaggagttygagaccagcctgggcaacatggcaaaaccctgtctctacaaaaaatataaaaagttagcggctagacacagtggctcacgcctataatcccagcactttggtaggctgaggcaggtggatcatgaggtcaagagtttgagaccagccttaccaacatggtgaaaccccgtctctactaaaaatacaaaaaaattagccagatgtggtggcacgcagctgtcatcccagctactcacggggctgaggcaggagaatggtttgaacctgagaggcggaggttgcagtgagccgacatcgagc

SEQ ID NO: 119408 - DNA, 601 bp, Human
ggtggggaaattgcttgagcccaggagttcgagaccagcctgggcaacatggcaaaaccctgtctctacaaaaaatataaaaagttagcggctagacacagtggctcacgcctataatcccagcactttggtaggctgaggcaggtggatcatgaggtcaagagtttgagaccagccttaccaacatggtgaaaccccgtctctactaaaaatacaaaaaaattagccagatgtggtggcacgcagctgtcatcccagctactcacggggctgaggcaggagaatggtttgaacctgagargcggaggttgcagtgagccgacatcgagccactgtactccagcctgggtgacagagcgagactctgtcttaaaaaaaaaaaagctgggtgtggtggttggtggtacgcgcctgtagtcccagctgctcgggaggctgaggtgggagaatcacttgagcctgaggggtcgaggctgtactgagccatgatcatgccactgcactttagcctgggggacagggtaaaaccctgtctcaaaaaaaaaaaaagacatttaaaaatgtgtattaatacattatgccttctgtgtaattaaatata

SEQ ID NO: 119409 - DNA, 601 bp, Human
acatgtgatttttaaattagtgtacaaatgtgtaaatactgtttgagagcagattgttttatatgcacatgcagtctgaaatgaagtgcagacctttataatgcctgaccgttttcattctaatagcacactagcaacttcagacgtcagcaggcggaaatggctgattccaggtgcagagtattccatctttactggccagcctctggacacccaggacagtaacgtggataaccagctggaggaaacctgtagcctagggtgagataactttgctaaagattctatttagggatgttaygttttcttagagatttcaattgcttttaaaagtttgggaagccctctctttggttctttaatgtcttaattttgagaacctgacttttattttactttgaaaggctactacttttagaatattttacttccatgagctctgccaagcttccccacctgtgctcagtggcacagtatgggtttgtgattaggataggatgtcgatcctcaggccaggtgtggtggctcacgcctgtaatcccaacactttgggaggccaacgtggaggatcgcttgagcctaggagttcgagaccagcttg

SEQ ID NO: 119410 - DNA, 601 bp, Human
cgtcagcaggcggaaatggctgattccaggtgcagagtattccatctttactggccagcctctggacacccaggacagtaacgtggataaccagctggaggaaacctgtagcctagggtgagataactttgctaaagattctatttagggatgttatgttttcttagagatttcaattgcttttaaaagtttgggaagccctctctttggttctttaatgtcttaattttgagaacctgacttttattttactttgaaaggctactacttttagaatattttacttccatgagctctgccragcttccccacctgtgctcagtggcacagtatgggtttgtgattaggataggatgtcgatcctcaggccaggtgtggtggctcacgcctgtaatcccaacactttgggaggccaacgtggaggatcgcttgagcctaggagttcgagaccagcttgggcagcatgacaaaatcccacctctacaaaaaataaatatattagccgggcatggtgacatgcgcctgtagttttagctacttgggaggctgaggtgggaggattacttgagcctggggagctcaaggctacagtgagctatga

SEQ ID NO: 119411 - DNA, 601 bp, Human
ttccccacctgtgctcagtggcacagtatgggtttgtgattaggataggatgtcgatcctcaggccaggtgtggtggctcacgcctgtaatcccaacactttgggaggccaacgtggaggatcgcttgagcctaggagttcgagaccagcttgggcagcatgacaaaatcccacctctacaaaaaataaatatattagccgggcatggtgacatgcgcctgtagttttagctacttgggaggctgaggtgggaggattacttgagcctggggagctcaaggctacagtgagctatgattgygccactgcactccagcctgggtgacagagtgagaccttgtctaaaaacaaacaaaagatgtagatcctctcccacttcagatggctctggccagcccgagccccgagcctgcgtgagcagcctcagccgcttactccagggtgctgtgcagatgctgttcctctaagtgtaggactagaaggatgggaaagcactgtatgcaggtttaatttatttgcattgcaaagcatgctcattgtggagtataattgtcaactctgttattcccctaacaaccccagtaaagtgtgtgttttagct

SEQ ID NO: 119412 - DNA, 601 bp, Human
cgttttcacaccagctgaggagattcttattattgtgttataggaatgttcagtagtgtactgctgtttccatcttatttccagtcgacttctaaaatcctgaaaaaccagttttgagtcagagtgctgaaagtactgtctgatatactacagtgttacagtggttacctctaggtgttaggattatgagtgattttatttttttgtacactcttatttctctctcaaagttttacgttgaaattatattcctttcaaaattagaaaaaaaatactgaataagaaactgttatgctgatasatatagaaggaaaagaatatttcctcttcattttcttctatagcaaaaagagagattatgctaacaccagtgactgtggcttatagtccaaagcgatcccctaaagaaaacttgtccccaggatttagtcatctgcttagcaaaaatgagagcagtccaattcggtaagttctctaaaattgtagaataaagtttactatattagtgatttttttctaaatgttgacttatgtctctagctatcactaatttttcagttaccagtgggaactctgtgaatttcatttaaatcataagtga

SEQ ID NO: 119413 - DNA, 601 bp, Human
acattaactgtttagtgttggtgtatgtccactaaatgtgatgtattatttagtttttaagcttttttttttttttttgctttaagtttacttaaagttcatttatgtttacatgaagtttgcttaagttcattaagggaagttgcaaagattgtcaaacagagggcaaagctttcagaattctttggagaaaaaagcactgagtaaataagattgattattgtatctcttttcattacttttttgggccacatagcagctatatccagaaagtgaaattgggcaacatatttaatatatrtgcaacctacacgaaaaattgataagaaatataagcaatttctctcctctctgacagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaagg

SEQ ID NO: 119414 - DNA, 601 bp, Human
tgggtgcagtggttcacgcctgtaatcccagcactttgggaggctgaggtgggcagatcagatcacctgcagtcaggagttcaagaccagcttggccaatatggcgaaaccctgtctctactaaaaatatgaaaatgagccgggcatggtggtgggcacctgtaatcccagctacttttgaggctgagggaggagaatcgcttgaacctgggaggcagaggttgcagtgagctgagattgtgccactgcactccagtctgggcaacagagcgagactccgtctcccccaaccaaaaaaaawaaaataaaataaaagtggtatgcatatatatgtatgcagaaaaaacaggaaagaggaacagtttttttttcttttttgcttatttgtcttctaaattttctatattctaagtgttctataatccttttataattaaagaaaaaaattttaagttttatttcaggacaccattggaattaatactgaataaattaactaaaatgaggctgggtatagtggcttatgcctataatcccagcactttgggaggccgaggtgggtggatcacttgaggccaggagttcgagaccagcctgggtg

SEQ ID NO: 119415 - DNA, 601 bp, Human
gtatgcatatatatgtatgcagaaaaaacaggaaagaggaacagtttttttttcttttttgcttatttgtcttctaaattttctatattctaagtgttctataatccttttataattaaagaaaaaaattttaagttttatttcaggacaccattggaattaatactgaataaattaactaaaatgaggctgggtatagtggcttatgcctataatcccagcactttgggaggccgaggtgggtggatcacttgaggccaggagttcgagaccagcctgggtgacatagtgagatcttgtmtctgcaaaaaaaaaaatgtttaaaatcagccaggtgtggtggtgcctgcctgtagtttcagatactcgagaggctaaggtggaaggattgcttgagtccaggagtttgaggctgcagtaagctatgatcatgccattgcagttcagctttgggtgacagagcaagaccctgtctcaacaaaaacacagaagtatgtataatgatatatagtccaggtattatttaacagtaatattgtttattttaaaatagcaattgttaattcattgtgaaatctattttttttttaagaaaagtatc

SEQ ID NO: 119416 - DNA, 601 bp, Human
ttggtatagaattctaattaaacttttcccattgttttcacctaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatrgccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtacct

SEQ ID NO: 119417 - DNA, 601 bp, Human
gaccttctcttgggaagcactgcctctaacaaatggagaaactgaggactggagggcggggagcctgtctgaggtcacacagccaggagtggcacagctggggctggcacgaagtccagtggggaggacagaaaaggggaggtgaggagcagtgggcagagcagttggggaagaggacgggggcacaccgagggaatgcgagggtgcgtgggaagtggccagcacccctcctgccagggcgctgggatcttgcaaacgcctggggtgctgtgcgcgatgctacccccagcgactggccctsgagccagagaggtgtagtgaccaggatcagaacccaggtctgtgccggcagagcctgtgttcgccatgccatgcttgctgccacatcagaagctcaggaaactggggtttggctgatgtagttagggggctctgggggacatcaccctgcccaattcctgcagtggccatggacgtgccagatatcgtgggcgttgtgcgtccccctcccaagcaacccgcccctatagcgcacgtgtctcatcatccgcatgtgtctcatcatccccacgtgggaggcgtggaaactgaggctcggagt

SEQ ID NO: 119418 - DNA, 601 bp, Human
gggttgggccctgttggtgggaggatgagagaagggaatgcattccaggctctggctgggccatggcggatcgctgtggtcctggtggcccaggtgtggcctcttgtctccccactggcttggaggcttggcacctgggatgtgccctcccatccatctgcatcctgggaaatgctgtttggactcttttgtgccaaaatgagctgtttcccctgttttgttcattggagataataaagttgcttcctggagacgactgggtggcctccctgagtgtgtgaggataggagggtgaggaccrtctccctaacttgtagttgtcccctagaatgggacgtgccttggcccagctgaggtggctgccccagaagtctgaggctgggctgcgttccctatcctgaccggcccggggccctctccacccacctgcctgtggccttggggtcaggctgctgaacccttttttttttttttcccccgagatggagtctcgctctgttgcccaggctggagtgcagtggagtgatcttggctcactgcaacttccacctcctgggtccaagcagttctcctgcctcagcctcctgagtaactgggacta

SEQ ID NO: 119419 - DNA, 601 bp, Human
gttgtgggtcgaattatgtccccccaaaagatatgttcaagtcctaacttctggtacatgtgtacatgatcttttttggaaatagaatcacaagtaagaagagattgaccaggtgtggtggctcatgcctgtaatcccaacactttgggaggctgaggtgggcggatcacgaggtcaagagatcgagaccagcctggccaacacggcgaaaccccgtctctactgaaaatacaaaaattagctgggtgtggtggtgcatgcctgaaataccagctactcgggaggctgaggcaggagaatygcttgaactcgggagagagaggttgcagtaagccaaaatcatgtcaatgcactccagcctgggcgacaaaactagactctgtctcaaaaaaaaaaaagaaaagaaaaagaaaataactgaaggctgggtgcagtggctcatgcctgtaatcctagcactttgggaggccgaggcgggaggatcacttgaggtcaggaattagagatcagcctgaccaatatggtgaaaccctgtcactaccaaaaatacaaaaattagccaggtatggtggcacgcgcctgtgatcccagctactcggga

SEQ ID NO: 119420 - DNA, 601 bp, Human
aatatggcctgtttctcttaaataaatacttcaggtagaaaacagaacactggtggctgggcgtggtggctcacgtcccagcactttgggaggccgaggcaggcagatcacctgtggtcaggagtttgagaccagcctggcttacgtggcaaaaccctatctctacttaaaatacaaaaattagctgggcgtgttggcacgtgcctgcagtcccagcttctcgggatgctgaggtgggaggactgcttgagcccaggaggtggaggctgcagtgagctgagatcgtgccactgcactctarcctgggtgacaaagactccatctcaaaaaatagaccaacacactggtaaatttcaccctactggaaaaaaaacttaaatctattaaaatttctaattggcgaaaagtgacaatataaataaaagtgaaagaaaacaagttacaaactggaaaaaaccagttgcaacacatggcaagtaatgggttaatcctttaatataaaagactgtccataaatcattaatttaaaaaaaaccacacactatgaatatccaaagaaagaagtgggtgatgtcccaagagagaaatacaaatggccacg

SEQ ID NO: 119421 - DNA, 601 bp, Human
cctttcttgaatgtgacttgctatcacagcaagtttgttggaacgattcatgaataaatgcgaatttcccagcaccatcacggcatctatgcatttggataaagtgaactgttggaaaaaaaaagacattagaaaaacaaattagctatccaaataaccatgtcaggtcttgacataattaagatgtcgtttaggctgggtgcagtggctcaagcctgtaatcccagcaccctgagaggccaaggtgggaggactgcttgagttcaggagtttgagaccagcctaggcaacataatgaaaycttagctctataaaaaaaacaaaactagctaggcatggtggtgtgcacctgtagtcttagctactctgaaggctgaggtggcaggatcgcttaagccctggagagccaggctgcagtgagccaagattgtaccactgtactgcagcctggacaacagagctagaccctgtaacaaacaaacaaaaaaaagacttcatttaaattttagacaattattcactgttaaaaatttgctcaggagctcccctcctccaaagccataaacaaaaacacttgaaaactatagttttctaattgtac

SEQ ID NO: 119422 - DNA, 601 bp, Human
ctggtacagaaaacattttcttttgcaacatggagtaggaacaatacatgccaactggcacagaaaactcatgaatattaagcactgaagagcaaaagcaatcacaatggtcatacctttcttgaatgtgacttgctatcacagcaagtttgttggaacgattcatgaataaatgcgaatttcccagcaccatcacggcatctatgcatttggataaagtgaactgttggaaaaaaaaagacattagaaaaacaaattagctatccaaataaccatgtcaggtcttgacataattaagatktcgtttaggctgggtgcagtggctcaagcctgtaatcccagcaccctgagaggccaaggtgggaggactgcttgagttcaggagtttgagaccagcctaggcaacataatgaaaccttagctctataaaaaaaacaaaactagctaggcatggtggtgtgcacctgtagtcttagctactctgaaggctgaggtggcaggatcgcttaagccctggagagccaggctgcagtgagccaagattgtaccactgtactgcagcctggacaacagagctagaccctgtaacaaacaaacaaaa

SEQ ID NO: 119423 - DNA, 601 bp, Human
gtgtagtggctcatccctgcagtcccagcacttggggaggctggggtgaaaggactgcttgagcccaggagagcaaggccagcctgggcaacatagtgagaccccatctctacaaaaaatacaaaaattagctgagtgtggtggtgcacacctgtagtcccagctacttgggagactgaggcaggaggtccagtcacttatgtccagaaggtcagacgctacagtgacccatgatagtgccactgcactctagcctgggtgacagagcaagatcctgtctccaaaaaaaaaaaaaaaaaaagacatagaagagctgtgtcttacatggtaattcaactcttctgtcagtgcataatgtgagaagtaaatatggcccaaattattcacaaaaactttgctgtatctgcggtcacatttacacatcagctgcaggctatgcaccatcttgcagtgagtctaacacagccagttttcacactagtgttagaagcgaccactgtttcttctgccaagcaccagatggagtagttggcttgggtttagaagccaacgttataagaaaaatccttatttcaaagcaccaggttcactcacagagcag

SEQ ID NO: 119424 - DNA, 601 bp, Human
tttttttttgagacacagtctcgctgtgtcgcccaggctggagtgcagtggtgcagtctcagctcactgcaacttccacctcccgggctcaagtgattttcgtgcctcagcctcccaagtagctggaattacaggagtgtaccaccacgtccagctaattttttgtatttttagtagagatggggtttcactatgttggctgctatgtatggctggtctcaaactgacctcaagtaatctgcctcagcttcctgaagtgctgggattacaggcgtgagccaccgagcccggcctcgtgacktcgtgacttttttttttttttttttttgagacagggtcttgctctgtcgcccaggctgcagtgcagtggcacgacctcggctcactgcaagctccacctcccgggttcacgacattctcctgcctcagcctaacgagtagctgggactacaggtgcccgccaccatgcccggctaattttttttgtatttttagtagaaacggggtttcaccatgttagccaggatggtcctgatctcctgatctcgtgatccgcccgcctcggcctcccaaagtgctgggattacagacatgagccacc

SEQ ID NO: 119425 - DNA, 601 bp, Human
ggtccctgaaaagattctcccagtgattcatgactctttttttttttgagacacagtctcgctgtgtcgcccaggctggagtgcagtggtgcagtctcagctcactgcaacttccacctcccgggctcaagtgattttcgtgcctcagcctcccaagtagctggaattacaggagtgtaccaccacgtccagctaattttttgtatttttagtagagatggggtttcactatgttggctgctatgtatggctggtctcaaactgacctcaagtaatctgcctcagcttcctgaagtgctgrgattacaggcgtgagccaccgagcccggcctcgtgacttcgtgacttttttttttttttttttttgagacagggtcttgctctgtcgcccaggctgcagtgcagtggcacgacctcggctcactgcaagctccacctcccgggttcacgacattctcctgcctcagcctaacgagtagctgggactacaggtgcccgccaccatgcccggctaattttttttgtatttttagtagaaacggggtttcaccatgttagccaggatggtcctgatctcctgatctcgtgatccgcccgcctc

SEQ ID NO: 119426 - DNA, 601 bp, Human
tacaaggctctgaggcccccttgccctccctctcccaccatcccctccttcccatcactctccgtgctcagccagtgcggggaagactggagaagctctttcctcgagccatgagaagcagggaggagtttgccacttgtttggtgccttgggtgaaaaaagtcactcaagatatcaaaaccctaaaactgcagttcaagagggcaaggagctcagattgacactctgtgcaagccagcttagagctggtccaggagaactgacacctcatgggtgaggtcagaccagaaaaggtcttgarcactatactgtgaagctgagctgagacttaatcctggaggccagtgactctcaaggtgagattctggaaccagctataggggcaccacctggcactgtaatagaaatagaaattctcaggacctccctagatccagtgaatcagaaactgagtggggcctgacactgtttcaacaagccttccagctgattttttaacaggtttataatgtacaaaccataaattctggtctaaaagtacttttgggtatgcaattcaattatttttagtaaatttacaattatgcaatcatcatcacaa

SEQ ID NO: 119427 - DNA, 601 bp, Human
tcttctatcgctctcagaattttagttttccttatcatcagttttacacattgcttgttaaatgaatcctggatagttaacattttttgctcctactataaatgcgttttatttcccattatgttttcttttttttttctttttgagacggagtctcactctgtcacccaggctagagtgcagtggtgtgatctcggctcactgcaacctccagctcactgcaacctctgcctcccaggttcaaacgattctcctgcctcgggatcccaagtagctgggactataggcatgcaccaccacrcccagctaatttttgtattttgagtagagacggggtttcaccatgttggccaggctggtcccgaactcctgacctcaagtgatctgcccacctcggcctcccaaagtgctgggataacaggtgtgagccaccacacctggtctcccgttatgttttctaattatagttgtcatataaaaaagtaatgatttttttatcttaccaatatccttgatttcatttcctgattgtctacaaagagaaaaaagcagaaaaaaatttaactaaatcttactaatcatatatggtttcctaaccaat

SEQ ID NO: 119428 - DNA, 601 bp, Human
cacactcacacgtatcaagatgattacttagcattctgcaacctgctttttcagtccacaatatatgtgggaaaaaatattctaatgtcaatgaattataatatatactatgctccttgcggacttcataaatttccactatttaagcagtttccagttctcagttttaaacaataccctgatgataccctcatataccatctgcacagctctctaattacctccggaaaataagcagtgattactaaagtatatgaacatttaattttgacacagattaccaaaatgcaccccagaaaaratttttaccaatttatcctcctatcagcaacccatgagaataagcaatccccaacatcaccatcaaccctgggaactgccagctttttcatttgtgctaagcaacaaacaatgaatatctcgttacttggcacttcttttttttttttttgagacagagtctcgctctgttgcccaggctggagtgcagtggcgcaatctcggctcactgcaacctctgcctcctgggttcacgccattctcctgcctcagcctcccgagtagctgggactacaggcgcccacgacattttttgtatttg

SEQ ID NO: 119429 - DNA, 601 bp, Human
tttacagcttcgccacagcaacaagataaagaaactgatgcaaggtttatacagcaaactgtcaaaccagggattcttggcatggggtccaaggatgggctaaaggttacctgaataccatgaaactctatgcaaaactgtggttgagtgcatattgttttgggaatgcatcagattctcaagtggtccaggacccaaaatagagaaaagactagaacataatacagattctggattccttgcccattcataagcctacgtagtcagaatacctcagagtagagcattcaaaaaatgaaaytgactccttcgttatgaaacaaatactttaaacggcaggctctcagttcacctgtttctgtgctgcaaagatgacattcatgaagttcatatactgcaacgcactgtcttctgcagccttaatcacctaaaaatcacagtcatgttaattccacccaggcacatgccagtcctctcacaccaatgtcacacaatatactgcgaaccacaaccaacattattccagtttgtcttcccatttatcattgttaaatgatacctaaagtataaagatgacagtaacatttcccccgaaatcccg

SEQ ID NO: 119430 - DNA, 601 bp, Human
gagcctttgaagcatgtaaattttcccattggacctcgctctccccatccttcatccccagcagtaacctaaattcagggtttgtcatagttttgtgcttgtaactgatcctttaggaaacaacatttgtggccaaaaaacatctaacaaaaactcagtaatttcttcagacttactttagggttttgtttccctttcgggttaaagtaaaattcagtttttgtcttttagtgctgcccaacggaaatataacgcaagcaatatgtaatttaaaattttccagtagctccatacgtaaggsggaaagacatagataaaattaggctgaataacatattttatttaacccaatatacccaaagctttcattttaaattgtaatcaatataaaaatcactaattgtcataaccaccgacacaaagcatggttttaaaacatacctgttggaggagccctgagtcggagtctaaaacacaggcatcaatcaaaatattctaaaagaaacattttgaaaatattacaggaataataacaataatgattaccctatactgagaacctactacatgccatactctatgcttaaaatagctcactcaa

SEQ ID NO: 119431 - DNA, 601 bp, Human
gctgttctgagaaccaactttcacatttttttttcttaagagggagacagggtttccctggagtgcagtggcatgatcgtagctgactgcagcttcgaactcctggctcaagcaatcctcctgcctccacctcccgaacagctgagactacaggcgtgcaccaccatgataggctaatttttttgtattgtttatagagatggtgtctcgccatgttgcccaggctggtcttaaacttctgagctcaagccatccacccgcctgagcctcccaagtgctgagattataggcatgagccacygagctcagccaggatatattttaaaggcagaatcaacaggatttgctcatggttatgaaaggagggaagagaagagacaaggaagagtcaggtttttgcttgagttgctgagtgaactgcactgccacttagggagatggggctaccagtggagcaggaagaggctgagaggacaaaccaagagctctctgcttttgacacatgacactgaagatgcctgccagacgtccaagaggaggtactacgtacacggctgattctgcaagtctggaactcaggagagtctgggactggactaga

SEQ ID NO: 119432 - DNA, 601 bp, Human
ctcacgcctgtaatcgcggatcacttgaggtcaggagttcgataccagcctaaccaatagagtataaaaccctgtctctactaaaaatacaaaaattagctgggcgtagtggcgggcacctgtaatcccagccgcttgggaggctgaggcaggagaatcgcttgaacccaggagttggggtttcagtgcaccgagatcgtaccattgcactccagcctgggcaacaagagtgaaactgtctcaaaaaattaaaaaattagccaggcattgtagtgcatgccagtggtcccagatacttggsagactgagtgggaagatcatttgagctggggaggataaggctgcagtgagccatgatcatgccactgcattccagcctgggcaagagcaagactctgtctaaaaataaaataaaataaaataaaaataaaactcttttgaatttggtcctctttttccaaacttttgctatcttcagagttttccaaagacacaaaacactcaagctctcctggttgctgacactaaggtttcctgtccatgttaatagtttttcccaacaatcattcatctattcatttcataaacacagctttctcgc

SEQ ID NO: 119433 - DNA, 601 bp, Human; identical to SEQ ID NO: 28838

SEQ ID NO: 119434 - DNA, 601 bp, Human; identical to SEQ ID NO: 28839

SEQ ID NO: 119435 - DNA, 601 bp, Human; identical to SEQ ID NO: 28840

SEQ ID NO: 119436 - DNA, 601 bp, Human; identical to SEQ ID NO: 28841

SEQ ID NO: 119437 - DNA, 601 bp, Human; identical to SEQ ID NO: 28842

SEQ ID NO: 119438 - DNA, 601 bp, Human; identical to SEQ ID NO: 28843

SEQ ID NO: 119439 - DNA, 601 bp, Human; identical to SEQ ID NO: 28844

SEQ ID NO: 119440 - DNA, 601 bp, Human; identical to SEQ ID NO: 28845

SEQ ID NO: 119441 - DNA, 601 bp, Human; identical to SEQ ID NO: 28846

SEQ ID NO: 119442 - DNA, 601 bp, Human; identical to SEQ ID NO: 28847

SEQ ID NO: 119443 - DNA, 601 bp, Human; identical to SEQ ID NO: 28848

SEQ ID NO: 119444 - DNA, 601 bp, Human; identical to SEQ ID NO: 28849

SEQ ID NO: 119445 - DNA, 601 bp, Human; identical to SEQ ID NO: 28850

SEQ ID NO: 119446 - DNA, 601 bp, Human; identical to SEQ ID NO: 28851

SEQ ID NO: 119447 - DNA, 601 bp, Human; identical to SEQ ID NO: 28852

SEQ ID NO: 119448 - DNA, 601 bp, Human; identical to SEQ ID NO: 28853

SEQ ID NO: 119449 - DNA, 601 bp, Human; identical to SEQ ID NO: 28854

SEQ ID NO: 119450 - DNA, 601 bp, Human; identical to SEQ ID NO: 28855

SEQ ID NO: 119451 - DNA, 601 bp, Human; identical to SEQ ID NO: 28856

SEQ ID NO: 119452 - DNA, 601 bp, Human; identical to SEQ ID NO: 28857

SEQ ID NO: 119453 - DNA, 601 bp, Human; identical to SEQ ID NO: 28858

SEQ ID NO: 119454 - DNA, 601 bp, Human; identical to SEQ ID NO: 28859

SEQ ID NO: 119455 - DNA, 601 bp, Human; identical to SEQ ID NO: 28860

SEQ ID NO: 119456 - DNA, 601 bp, Human; identical to SEQ ID NO: 28861

SEQ ID NO: 119457 - DNA, 601 bp, Human; identical to SEQ ID NO: 28862

SEQ ID NO: 119458 - DNA, 601 bp, Human; identical to SEQ ID NO: 28863

SEQ ID NO: 119459 - DNA, 601 bp, Human; identical to SEQ ID NO: 28864

SEQ ID NO: 119460 - DNA, 601 bp, Human; identical to SEQ ID NO: 28865

SEQ ID NO: 119461 - DNA, 601 bp, Human; identical to SEQ ID NO: 28866

SEQ ID NO: 119462 - DNA, 601 bp, Human; identical to SEQ ID NO: 28867

SEQ ID NO: 119463 - DNA, 601 bp, Human; identical to SEQ ID NO: 28868

SEQ ID NO: 119464 - DNA, 601 bp, Human; identical to SEQ ID NO: 28869

SEQ ID NO: 119465 - DNA, 601 bp, Human; identical to SEQ ID NO: 28870

SEQ ID NO: 119466 - DNA, 601 bp, Human; identical to SEQ ID NO: 28871

SEQ ID NO: 119467 - DNA, 601 bp, Human; identical to SEQ ID NO: 28872

SEQ ID NO: 119468 - DNA, 601 bp, Human; identical to SEQ ID NO: 28873

SEQ ID NO: 119469 - DNA, 601 bp, Human; identical to SEQ ID NO: 28874

SEQ ID NO: 119470 - DNA, 601 bp, Human
tccagcctgggtgacaaagtgagacactgtctcaaaaagaaaaaaaaaaaatcaaagttcatctaaattcaactgccagatttctaatattttacccttgacttcaaggctgtaatgtaaaatacagctttttttttttttttttttttttttgagatggactctcgctcttgttgcccaggctggaatgcaatggcacaatctcagctcaccacaacctccacctcctgagttcaagtgatgctcctgccccgagtagctggaattacaggcatgcgccaccacgcccagctaattttgtatttttggtagagatggagtttctccatgttggtcaggctggtctcaaactcccaacctcaggtgatccgcctgcctcgacctcccaaagtgctgggataacaggtgtgagccaccacacccagacttttttttttttttttttttttttgagacggagtctcgctcttgtcgcccaggctggagtgcagtggcacaatctcggctcactgcaacctccaccttctgggttcaagcaattctcctgcctcaacctccagagtagctgggattacaggtgcacaccaccacgcccagctga

SEQ ID NO: 119471 - DNA, 601 bp, Human
aagccagcttaccagtttgtttaaactcaggtccttggtattcgggacccgcccaatggcccagagcaggcagtcaacatctggaatcatggtcatgactggtagcctaccgggaactgcagtaaccatgctgacttccaagcccgacaaagtctttttaacctccttgacctattggcaaataaaatgtgttacacatgtgtggaggctcagggaggacaggggaagaaggaaagcaaatacagaggaaactagaatttttaacattaaagaaaatccctactgaatcccacatacaaasatagacataaacttttacccaaaggccaccaacacttgaactcccttaaaccaagcctgttccctgggttgacccaaatcttccagtcagtggctgggaatgtcagctcatgacaccattgtaatgcctcactttaaaaacaaagtattttaaagtgtacttctggaaaaatgtaataacattttaagtggtaaacctaagcatagtgctttgaaagtaggccacggcagcatcactaggaaacttttcaaaactgcacaattagtgcctctccctgggtatatacgtgtgtgtgtgtat

SEQ ID NO: 119472 - DNA, 601 bp, Human
aagctgaggtgggtggatcacttgagcctaggaggttaagactgcggtgagctatgatcacaccactgaactccagcctgggtgacagagcaagacctttctcaaaaacaaaaagaaaaaaacaaaaacagaaaagaaaggaaaaggaaagaagagaagagaaaacttttttttttaatttcaaaggaagaagcaatgaaatttgatcacaaactgaatacatgggaaaaagagaaaagaatccaatggaatccacccaagttttgggtgtctggggggaaaataaaaccataagactccyagtagattcacaaatgtttcgggcagaccaagccagcttaccagtttgtttaaactcaggtccttggtattcgggacccgcccaatggcccagagcaggcagtcaacatctggaatcatggtcatgactggtagcctaccgggaactgcagtaaccatgctgacttccaagcccgacaaagtctttttaacctccttgacctattggcaaataaaatgtgttacacatgtgtggaggctcagggaggacaggggaagaaggaaagcaaatacagaggaaactagaatttttaacattaaa

SEQ ID NO: 119473 - DNA, 601 bp, Human
accaaaccccaagctcccattctagattttacttcaacatttaaaagaacaagtaagaatgccaactgtccacaaatacagacagcacgggtagagccaagagagacagcttcacatctgttcccatccctgtgtacaatgtacaagacagttacccacccagcaatctggattacctactacagatgctaaaagatcagcataggacttgaaagagacattcacatagcaaaaacgaagtctgtaagagggaggccaataggaaactaggttagaggtggcaggccggctgggcatggargctcatgtttataatccgagcactttgggaggccgaggtggaaggatcacttgaggccaggagttcaagagcagcctgggcaacatagtaagactccatctctacagaaaacttaaaaattagccaggtgtggtggcacattcctgtagctccagctacttgggaagctgaggcagaaggatcagttgaccccaggaattcaagactgcagtgagctatgatcatgccactgtacactagcctgggtgacaaagcaagaccctgtctcaaaaaaaaaaaaaaaaaaaaggaaagaaaaca

SEQ ID NO: 119474 - DNA, 601 bp, Human
ccccccaaaaaaagttagcaaatttagttgaaaactggacctatcagtgcttacatctgtacaatggcaaaatatctcttgaaaggtgaaaagctgaatgaccagttttttgttgttgttgttttcttttggtgtttttttttggttttttttttttgagacggagttttgcttttgttgccagggctggagtgcaatggcgtgatctcggctcactgcaacctcagcctcctgggttcaagcgattctcctgcctcagcctcccaagtagctgggattacaggcatgcgtcaccatgccyggctaatttttgtattattagtagagacggcatttcaccacgttgcccaggctggtctcgaactcctgacctcaggtgatccacccgcctcagcctcccaaagagctgggattacaggtgtgagccacggcgcctggctgactagttttgttaatatgaaaataggcaattaattttactaaatgtcattgaataagattacaaacaatcaaaacatctccctgaatattttataagttaacatgcagaaaaatgaccttttacagaaacagaaaaggaatccacattacaacaggaact

SEQ ID NO: 119475 - DNA, 601 bp, Human
aggctgggtgcaatggctcatgcctgtaatcccagcactttgggaagctgaggtggaaggatcgcttgagcccagttcaaaattagcctgggtaatacagcgagaccttgtgtctacaaaaattttttttaaaaattagccaggtgtggtggaccacgcctgtagttcctactacttgggagactaaggtagaaggatggcttgagcccaggagtttgatgctgcaaggatgcagtgagccatgatggcaccactgtactccagcctaggtgacagagcaagaccctgtccaacccccccmaaaaaagttagcaaatttagttgaaaactggacctatcagtgcttacatctgtacaatggcaaaatatctcttgaaaggtgaaaagctgaatgaccagttttttgttgttgttgttttcttttggtgtttttttttggttttttttttttgagacggagttttgcttttgttgccagggctggagtgcaatggcgtgatctcggctcactgcaacctcagcctcctgggttcaagcgattctcctgcctcagcctcccaagtagctgggattacaggcatgcgtcaccatgcccggctaa

SEQ ID NO: 119476 - DNA, 601 bp, Human
atttagcaaatataggctgggtgcaatggctcatgcctgtaatcccagcactttgggaagctgaggtggaaggatcgcttgagcccagttcaaaattagcctgggtaatacagcgagaccttgtgtctacaaaaattttttttaaaaattagccaggtgtggtggaccacgcctgtagttcctactacttgggagactaaggtagaaggatggcttgagcccaggagtttgatgctgcaaggatgcagtgagccatgatggcaccactgtactccagcctaggtgacagagcaagaccctrtccaacccccccaaaaaaagttagcaaatttagttgaaaactggacctatcagtgcttacatctgtacaatggcaaaatatctcttgaaaggtgaaaagctgaatgaccagttttttgttgttgttgttttcttttggtgtttttttttggttttttttttttgagacggagttttgcttttgttgccagggctggagtgcaatggcgtgatctcggctcactgcaacctcagcctcctgggttcaagcgattctcctgcctcagcctcccaagtagctgggattacaggcatgcgtcac

SEQ ID NO: 119477 - DNA, 601 bp, Human
caggcctgtaaatcctagcacttcgggaggccaaggcgggcggatcacctgaggtcaggagtttgagaccagcctggccaacatggtgaaaccctgtctctactaaaaatactaaaaattcgccaggcatggtggtgcatgcccacctacttggcaagtcccagctacttgggaagctgaggcaggagaatcacttgaacccagggggcggagattgcagtaagctgagatggcaccactgactccagcctgggcaacagaaagagactctgcctcaaaaaaaaaaaaaaaaaaaaaaaaraaagagtacaacctttggtacagacagaccaaaattcaaatcctagctctgcaacttaccggttatgagaccttgtataaccacctgtttatcaacaaatatttaagcttctattacaaatgagactttgacttcatcactgagaataccatggtaagacagacattctccctacaccatagagtttacagcccagtaaattatctagtatctctgtgctcctggcttccttataccttgccggttgttggcaagattaaattagattagtaacatgttgacaagacctagcacatagta

SEQ ID NO: 119478 - DNA, 601 bp, Human
ccccaactgcatagatgcctttgacgttggtattctggaattcgtctacgatgatatgacccttgtcatcggtttgaatcccctaaaattacaaagagatatcatgtaaccacttggcccacctactaaaaaaggtagatcaaacctctggatctcccttcctcatttcacatgggaactgcagccagaatctccaagaaaccatgagactcagctgcaacacgaaaggcatttacagctggcaagtttcaagctgggtacagtgggcccacacctgtaatcccagaactttgagaagccraagagggaggatcccttaagcccaggagtttgagatcagcttgggcaacacagtgagaccctgcctctgttagaaattagaaaaaaaaaagttggcaagtttcatatcttgcttaacataaaaggtagtattttatccacttttgagatgttttaacaggatttgacattgcaatgtacaattcaactggccaggcagacatgaagaggatcactcaactatcaggtgtgccacttggaatccctctggagtccagcttttcaacttgtcccatggaagcactgctcctgaggaacactg

SEQ ID NO: 119479 - DNA, 601 bp, Human
tctacaaaaaatgcacctgtgatcctagctacttgggagtctgaggtgggaggatcacctgagcccaggaaggttgaaactgcagtgagcccgtgatcatgccactgcactccagcctgggtaacagagtgtctccaaaaaaaaaaaaaaatgccaatctaaattacttcttccaaatgccacttccttccactgccaccaagcacaagtctgctcctaagagagttccgcaacgggtgatcatattgtctacatgaaaacttcagtctgtgctaagcattttaagtcttttattcagataatgtcaggtatccaaccaatatctatttcaacacattgtaccattttgacaatataaagacactcatccttttaactttgcttaagcagactgcagatttgacagtgaagagccagatggatcatgtaacacgcagaccctccctcaccaagaagggaagagaccttacctggagtaagaagagcttttccacatacatccccaactgcatagatgcctttgacgttggtattctggaattcgtctacgatgatatgacccttgtcatcggtttgaatcccctaaaattacaaagagata

SEQ ID NO: 119480 - DNA, 601 bp, Human
ttccgtgtttcgacttgggtcgcatctgcaaaatatctcattatatatatgcaaatattccaaaatctgaaactgaaaacacttctggtcccaagcatttcagataagggatgctcaacctgtctggccccactcccaaaagacacattcacaagttctcacttacctggcagttaatctacttaatgaagatattagctttttaatacaatatttatggaacaagctatattagttttcagcatctttagttctattttataaccctaaagtgctgggattacaggcatgagccactgtrcctagaatctttattattattatcattattattatattattattttttttttttagacagagtctcgctcttgttgccaggctggagagcagtggcgccatctcagctcgctgcaacctctgcctcccgggttgaagcaattctcctgcctcagcctcccaagtagctgggactacaggcgtgtgccaccacgcccagctaatttttgtatttttagcagagatggggtttcaccatgttggtcaggaaggtctcgatctctggacctcgtgatctgcccacctcggcctcacaaagtgc

SEQ ID NO: 119481 - DNA, 601 bp, Human
attccgtgtttcgacttgggtcgcatctgcaaaatatctcattatatatatgcaaatattccaaaatctgaaactgaaaacacttctggtcccaagcatttcagataagggatgctcaacctgtctggccccactcccaaaagacacattcacaagttctcacttacctggcagttaatctacttaatgaagatattagctttttaatacaatatttatggaacaagctatattagttttcagcatctttagttctattttataaccctaaagtgctgggattacaggcatgagccactgygcctagaatctttattattattatcattattattatattattattttttttttttagacagagtctcgctcttgttgccaggctggagagcagtggcgccatctcagctcgctgcaacctctgcctcccgggttgaagcaattctcctgcctcagcctcccaagtagctgggactacaggcgtgtgccaccacgcccagctaatttttgtatttttagcagagatggggtttcaccatgttggtcaggaaggtctcgatctctggacctcgtgatctgcccacctcggcctcacaaagtg

SEQ ID NO: 119482 - DNA, 601 bp, Human
agaatcctatacattctattacaggttgagcatccctaatccagaaattcaaaatccaaaatccaaaatgttggagcaccatgatgccacaagcagaaaattccacacctgacctcatgtgaagggttgcagtcaaaaacgcagacaaaagtatgcctcatgcacacatttaaaatatcgtataaagttaccttccaactatgtgtataaggtgtatgtaaaacaaatgaattccgtgtttcgacttgggtcgcatctgcaaaatatctcattatatatatgcaaatattccaaaatctgmaactgaaaacacttctggtcccaagcatttcagataagggatgctcaacctgtctggccccactcccaaaagacacattcacaagttctcacttacctggcagttaatctacttaatgaagatattagctttttaatacaatatttatggaacaagctatattagttttcagcatctttagttctattttataaccctaaagtgctgggattacaggcatgagccactgtgcctagaatctttattattattatcattattattatattattattttttttttttagacagagtctcgct

SEQ ID NO: 119483 - DNA, 601 bp, Human
accaaaaagcaatgtaatctggggctgagataggtttcatcagctgacagagacctaatttaaagttgggggcaggggaaagaggaaggaaaccacaaatgaccttcagtttttaaatacctaccttccgtgagtcccactgtcccaataggggggtggctgaagaccacagttgggatgttgttataatctaatttggaatcttccttatattcaaaaagtcgatgggcaagttttcggccagcagctattgcaactatggagatattttaaaatcagtgtttatcttactgtctgtttkaacatagctaaattgttccactagccatttatccatctaccttaatgccctagttctgacagtttcacaccattgttcattacactatctagatagtttaatacagcgaagatatgtcatgcctcagcgaacaactcaaaatgattggcttatgagaatcctatacattctattacaggttgagcatccctaatccagaaattcaaaatccaaaatccaaaatgttggagcaccatgatgccacaagcagaaaattccacacctgacctcatgtgaagggttgcagtcaaaaacgcagac

SEQ ID NO: 119484 - DNA, 601 bp, Human
agtagagatggggtttcaccatgctgcccaagctactctcaaactcctgagctcaggcaatccgcctaccttggcctcccaaagtgttaggattataggcgtgagccacagcgcctggccctggcctctcctgttttgttttttttttttttttttttttgctttgagatggagtctcgctttgtctcccaggctggagtgcagtagcatgatcttggctcactgcaacctccgcctcccaggttcaagtgattctcctgcctcagcctcccgagtagctgggattacaggcacgcaccaycatgcctggctcatttttgtgtttttagtagagacagggtttcaccacgttggtcaggctagtctcaaactcctgacctcaggtgatatgcctgcctcggcctcccagcgtgctgggattacaggtgtgagccaccacgcctggcatcgtctttattttttaaaaggagtggaacctccttctagatgaaatattatgaagaaccccaaaatgcaggtaagacagatcaaagtgggcctgtccagttgaatcagaaggctcaactgcttggtctccctcctttccacccctgcaaaatac

SEQ ID NO: 119485 - DNA, 601 bp, Human
tttgtatttttagtagagatggggtttcaccatgctgcccaagctactctcaaactcctgagctcaggcaatccgcctaccttggcctcccaaagtgttaggattataggcgtgagccacagcgcctggccctggcctctcctgttttgttttttttttttttttttttttgctttgagatggagtctcgctttgtctcccaggctggagtgcagtagcatgatcttggctcactgcaacctccgcctcccaggttcaagtgattctcctgcctcagcctcccgagtagctgggattacargcacgcaccaccatgcctggctcatttttgtgtttttagtagagacagggtttcaccacgttggtcaggctagtctcaaactcctgacctcaggtgatatgcctgcctcggcctcccagcgtgctgggattacaggtgtgagccaccacgcctggcatcgtctttattttttaaaaggagtggaacctccttctagatgaaatattatgaagaaccccaaaatgcaggtaagacagatcaaagtgggcctgtccagttgaatcagaaggctcaactgcttggtctccctcctttccaccc

SEQ ID NO: 119486 - DNA, 601 bp, Human
tggttctcaacgaagtgtgaccagctcttctgaagaggtagggtgaatggcgactgtgttgtcaaagtctgccttcgttgctcccatcttcactgcaacagcaaaaccctgcagcatttcatcacacccaagtccctgcatatggatcccaaccacctgggaaaagaagagaaacattttcttttctttcttctttttttttttttttgagacggagtttcactcttgttgcccaggctggagtgcaatggcatgatctcggctcgctgcaacctccacctcccgggttcaagtgattctmctgcctcagcctcccgagtagctgggattacaggcgcgcaccaccacgcctggctaattttgtatttttagcagagagagggtttcaccatgttggccaggctggtcttgaactcctgggctcaagtgatccacccacctcagcctcccaaagtgctgggattacaggggtgagccacggtgtctgactgatattgtgatcttaattgaacttataaagagcctctggtgatggccagctcttcatattattcctctctatatagcagttcttagtcttgagaagaatgacaaataatgt

SEQ ID NO: 119487 - DNA, 601 bp, Human; identical to SEQ ID NO: 34060

SEQ ID NO: 119488 - DNA, 601 bp, Human; identical to SEQ ID NO: 34061

SEQ ID NO: 119489 - DNA, 601 bp, Human; identical to SEQ ID NO: 64330

SEQ ID NO: 119490 - DNA, 601 bp, Human; identical to SEQ ID NO: 64331

SEQ ID NO: 119491 - DNA, 601 bp, Human; identical to SEQ ID NO: 64332

SEQ ID NO: 119492 - DNA, 601 bp, Human; identical to SEQ ID NO: 64333

SEQ ID NO: 119493 - DNA, 601 bp, Human; identical to SEQ ID NO: 64334

SEQ ID NO: 119494 - DNA, 601 bp, Human; identical to SEQ ID NO: 64335

SEQ ID NO: 119495 - DNA, 601 bp, Human; identical to SEQ ID NO: 64336

SEQ ID NO: 119496 - DNA, 601 bp, Human; identical to SEQ ID NO: 64337

SEQ ID NO: 119497 - DNA, 601 bp, Human; identical to SEQ ID NO: 64338

SEQ ID NO: 119498 - DNA, 601 bp, Human; identical to SEQ ID NO: 64339

SEQ ID NO: 119499 - DNA, 601 bp, Human; identical to SEQ ID NO: 64340

SEQ ID NO: 119500 - DNA, 601 bp, Human; identical to SEQ ID NO: 64341

SEQ ID NO: 119501 - DNA, 601 bp, Human; identical to SEQ ID NO: 64342

SEQ ID NO: 119502 - DNA, 601 bp, Human; identical to SEQ ID NO: 64343

SEQ ID NO: 119503 - DNA, 601 bp, Human; identical to SEQ ID NO: 64344

SEQ ID NO: 119504 - DNA, 601 bp, Human; identical to SEQ ID NO: 64345

SEQ ID NO: 119505 - DNA, 601 bp, Human; identical to SEQ ID NO: 64346

SEQ ID NO: 119506 - DNA, 601 bp, Human; identical to SEQ ID NO: 64347

SEQ ID NO: 119507 - DNA, 601 bp, Human; identical to SEQ ID NO: 64348

SEQ ID NO: 119508 - DNA, 601 bp, Human; identical to SEQ ID NO: 64349

SEQ ID NO: 119509 - DNA, 601 bp, Human; identical to SEQ ID NO: 64350

SEQ ID NO: 119510 - DNA, 601 bp, Human; identical to SEQ ID NO: 64351

SEQ ID NO: 119511 - DNA, 601 bp, Human; identical to SEQ ID NO: 64352

SEQ ID NO: 119512 - DNA, 601 bp, Human; identical to SEQ ID NO: 64353

SEQ ID NO: 119513 - DNA, 601 bp, Human; identical to SEQ ID NO: 64354

SEQ ID NO: 119514 - DNA, 601 bp, Human; identical to SEQ ID NO: 64355

SEQ ID NO: 119515 - DNA, 601 bp, Human; identical to SEQ ID NO: 64330

SEQ ID NO: 119516 - DNA, 601 bp, Human; identical to SEQ ID NO: 64331

SEQ ID NO: 119517 - DNA, 601 bp, Human; identical to SEQ ID NO: 64332

SEQ ID NO: 119518 - DNA, 601 bp, Human; identical to SEQ ID NO: 64333

SEQ ID NO: 119519 - DNA, 601 bp, Human; identical to SEQ ID NO: 64334

SEQ ID NO: 119520 - DNA, 601 bp, Human; identical to SEQ ID NO: 64335

SEQ ID NO: 119521 - DNA, 601 bp, Human; identical to SEQ ID NO: 64336

SEQ ID NO: 119522 - DNA, 601 bp, Human; identical to SEQ ID NO: 64337

SEQ ID NO: 119523 - DNA, 601 bp, Human; identical to SEQ ID NO: 64338

SEQ ID NO: 119524 - DNA, 601 bp, Human; identical to SEQ ID NO: 64339

SEQ ID NO: 119525 - DNA, 601 bp, Human; identical to SEQ ID NO: 64340

SEQ ID NO: 119526 - DNA, 601 bp, Human; identical to SEQ ID NO: 64341

SEQ ID NO: 119527 - DNA, 601 bp, Human; identical to SEQ ID NO: 64342

SEQ ID NO: 119528 - DNA, 601 bp, Human; identical to SEQ ID NO: 64343

SEQ ID NO: 119529 - DNA, 601 bp, Human; identical to SEQ ID NO: 64344

SEQ ID NO: 119530 - DNA, 601 bp, Human; identical to SEQ ID NO: 64345

SEQ ID NO: 119531 - DNA, 601 bp, Human; identical to SEQ ID NO: 64346

SEQ ID NO: 119532 - DNA, 601 bp, Human; identical to SEQ ID NO: 64347

SEQ ID NO: 119533 - DNA, 601 bp, Human; identical to SEQ ID NO: 64348

SEQ ID NO: 119534 - DNA, 601 bp, Human; identical to SEQ ID NO: 64349

SEQ ID NO: 119535 - DNA, 601 bp, Human; identical to SEQ ID NO: 64350

SEQ ID NO: 119536 - DNA, 601 bp, Human; identical to SEQ ID NO: 64351

SEQ ID NO: 119537 - DNA, 601 bp, Human; identical to SEQ ID NO: 64352

SEQ ID NO: 119538 - DNA, 601 bp, Human; identical to SEQ ID NO: 64353

SEQ ID NO: 119539 - DNA, 601 bp, Human; identical to SEQ ID NO: 64354

SEQ ID NO: 119540 - DNA, 601 bp, Human; identical to SEQ ID NO: 64355

SEQ ID NO: 119541 - DNA, 601 bp, Human; identical to SEQ ID NO: 64330

SEQ ID NO: 119542 - DNA, 601 bp, Human; identical to SEQ ID NO: 64331

SEQ ID NO: 119543 - DNA, 601 bp, Human; identical to SEQ ID NO: 64332

SEQ ID NO: 119544 - DNA, 601 bp, Human; identical to SEQ ID NO: 64333

SEQ ID NO: 119545 - DNA, 601 bp, Human; identical to SEQ ID NO: 64334

SEQ ID NO: 119546 - DNA, 601 bp, Human; identical to SEQ ID NO: 64335

SEQ ID NO: 119547 - DNA, 601 bp, Human; identical to SEQ ID NO: 64336

SEQ ID NO: 119548 - DNA, 601 bp, Human; identical to SEQ ID NO: 64337

SEQ ID NO: 119549 - DNA, 601 bp, Human; identical to SEQ ID NO: 64338

SEQ ID NO: 119550 - DNA, 601 bp, Human; identical to SEQ ID NO: 64339

SEQ ID NO: 119551 - DNA, 601 bp, Human; identical to SEQ ID NO: 64340

SEQ ID NO: 119552 - DNA, 601 bp, Human; identical to SEQ ID NO: 64341

SEQ ID NO: 119553 - DNA, 601 bp, Human; identical to SEQ ID NO: 64342

SEQ ID NO: 119554 - DNA, 601 bp, Human; identical to SEQ ID NO: 64343

SEQ ID NO: 119555 - DNA, 601 bp, Human; identical to SEQ ID NO: 64344

SEQ ID NO: 119556 - DNA, 601 bp, Human; identical to SEQ ID NO: 64345

SEQ ID NO: 119557 - DNA, 601 bp, Human; identical to SEQ ID NO: 64346

SEQ ID NO: 119558 - DNA, 601 bp, Human; identical to SEQ ID NO: 64347

SEQ ID NO: 119559 - DNA, 601 bp, Human; identical to SEQ ID NO: 64348

SEQ ID NO: 119560 - DNA, 601 bp, Human; identical to SEQ ID NO: 64349

SEQ ID NO: 119561 - DNA, 601 bp, Human; identical to SEQ ID NO: 64350

SEQ ID NO: 119562 - DNA, 601 bp, Human; identical to SEQ ID NO: 64351

SEQ ID NO: 119563 - DNA, 601 bp, Human; identical to SEQ ID NO: 64352

SEQ ID NO: 119564 - DNA, 601 bp, Human; identical to SEQ ID NO: 64353

SEQ ID NO: 119565 - DNA, 601 bp, Human; identical to SEQ ID NO: 64354

SEQ ID NO: 119566 - DNA, 601 bp, Human; identical to SEQ ID NO: 64355

SEQ ID NO: 119567 - DNA, 601 bp, Human; identical to SEQ ID NO: 64330

SEQ ID NO: 119568 - DNA, 601 bp, Human; identical to SEQ ID NO: 64331

SEQ ID NO: 119569 - DNA, 601 bp, Human; identical to SEQ ID NO: 64332

SEQ ID NO: 119570 - DNA, 601 bp, Human; identical to SEQ ID NO: 64333

SEQ ID NO: 119571 - DNA, 601 bp, Human; identical to SEQ ID NO: 64334

SEQ ID NO: 119572 - DNA, 601 bp, Human; identical to SEQ ID NO: 64335

SEQ ID NO: 119573 - DNA, 601 bp, Human; identical to SEQ ID NO: 64336

SEQ ID NO: 119574 - DNA, 601 bp, Human; identical to SEQ ID NO: 64337

SEQ ID NO: 119575 - DNA, 601 bp, Human; identical to SEQ ID NO: 64338

SEQ ID NO: 119576 - DNA, 601 bp, Human; identical to SEQ ID NO: 64339

SEQ ID NO: 119577 - DNA, 601 bp, Human; identical to SEQ ID NO: 64340

SEQ ID NO: 119578 - DNA, 601 bp, Human; identical to SEQ ID NO: 64341

SEQ ID NO: 119579 - DNA, 601 bp, Human; identical to SEQ ID NO: 64342

SEQ ID NO: 119580 - DNA, 601 bp, Human; identical to SEQ ID NO: 64343

SEQ ID NO: 119581 - DNA, 601 bp, Human; identical to SEQ ID NO: 64344

SEQ ID NO: 119582 - DNA, 601 bp, Human; identical to SEQ ID NO: 64345

SEQ ID NO: 119583 - DNA, 601 bp, Human; identical to SEQ ID NO: 64346

SEQ ID NO: 119584 - DNA, 601 bp, Human; identical to SEQ ID NO: 64347

SEQ ID NO: 119585 - DNA, 601 bp, Human; identical to SEQ ID NO: 64348

SEQ ID NO: 119586 - DNA, 601 bp, Human; identical to SEQ ID NO: 64349

SEQ ID NO: 119587 - DNA, 601 bp, Human; identical to SEQ ID NO: 64350

SEQ ID NO: 119588 - DNA, 601 bp, Human; identical to SEQ ID NO: 64351

SEQ ID NO: 119589 - DNA, 601 bp, Human; identical to SEQ ID NO: 64352

SEQ ID NO: 119590 - DNA, 601 bp, Human; identical to SEQ ID NO: 64353

SEQ ID NO: 119591 - DNA, 601 bp, Human; identical to SEQ ID NO: 64354

SEQ ID NO: 119592 - DNA, 601 bp, Human; identical to SEQ ID NO: 64355

SEQ ID NO: 119593 - DNA, 601 bp, Human; identical to SEQ ID NO: 64330

SEQ ID NO: 119594 - DNA, 601 bp, Human; identical to SEQ ID NO: 64331

SEQ ID NO: 119595 - DNA, 601 bp, Human; identical to SEQ ID NO: 64332

SEQ ID NO: 119596 - DNA, 601 bp, Human; identical to SEQ ID NO: 64333

SEQ ID NO: 119597 - DNA, 601 bp, Human; identical to SEQ ID NO: 64334

SEQ ID NO: 119598 - DNA, 601 bp, Human; identical to SEQ ID NO: 64335

SEQ ID NO: 119599 - DNA, 601 bp, Human; identical to SEQ ID NO: 64336

SEQ ID NO: 119600 - DNA, 601 bp, Human; identical to SEQ ID NO: 64337

SEQ ID NO: 119601 - DNA, 601 bp, Human; identical to SEQ ID NO: 64338

SEQ ID NO: 119602 - DNA, 601 bp, Human; identical to SEQ ID NO: 64339

SEQ ID NO: 119603 - DNA, 601 bp, Human; identical to SEQ ID NO: 64340

SEQ ID NO: 119604 - DNA, 601 bp, Human; identical to SEQ ID NO: 64341

SEQ ID NO: 119605 - DNA, 601 bp, Human; identical to SEQ ID NO: 64342

SEQ ID NO: 119606 - DNA, 601 bp, Human; identical to SEQ ID NO: 64343

SEQ ID NO: 119607 - DNA, 601 bp, Human; identical to SEQ ID NO: 64344

SEQ ID NO: 119608 - DNA, 601 bp, Human; identical to SEQ ID NO: 64345

SEQ ID NO: 119609 - DNA, 601 bp, Human; identical to SEQ ID NO: 64346

SEQ ID NO: 119610 - DNA, 601 bp, Human; identical to SEQ ID NO: 64347

SEQ ID NO: 119611 - DNA, 601 bp, Human; identical to SEQ ID NO: 64348

SEQ ID NO: 119612 - DNA, 601 bp, Human; identical to SEQ ID NO: 64349

SEQ ID NO: 119613 - DNA, 601 bp, Human; identical to SEQ ID NO: 64350

SEQ ID NO: 119614 - DNA, 601 bp, Human; identical to SEQ ID NO: 64351

SEQ ID NO: 119615 - DNA, 601 bp, Human; identical to SEQ ID NO: 64352

SEQ ID NO: 119616 - DNA, 601 bp, Human; identical to SEQ ID NO: 64353

SEQ ID NO: 119617 - DNA, 601 bp, Human; identical to SEQ ID NO: 64354

SEQ ID NO: 119618 - DNA, 601 bp, Human; identical to SEQ ID NO: 64355

SEQ ID NO: 119619 - DNA, 601 bp, Human; identical to SEQ ID NO: 64330

SEQ ID NO: 119620 - DNA, 601 bp, Human; identical to SEQ ID NO: 64331

SEQ ID NO: 119621 - DNA, 601 bp, Human; identical to SEQ ID NO: 64332

SEQ ID NO: 119622 - DNA, 601 bp, Human; identical to SEQ ID NO: 64333

SEQ ID NO: 119623 - DNA, 601 bp, Human; identical to SEQ ID NO: 64334

SEQ ID NO: 119624 - DNA, 601 bp, Human; identical to SEQ ID NO: 64335

SEQ ID NO: 119625 - DNA, 601 bp, Human; identical to SEQ ID NO: 64336

SEQ ID NO: 119626 - DNA, 601 bp, Human; identical to SEQ ID NO: 64337

SEQ ID NO: 119627 - DNA, 601 bp, Human; identical to SEQ ID NO: 64338

SEQ ID NO: 119628 - DNA, 601 bp, Human; identical to SEQ ID NO: 64339

SEQ ID NO: 119629 - DNA, 601 bp, Human; identical to SEQ ID NO: 64340

SEQ ID NO: 119630 - DNA, 601 bp, Human; identical to SEQ ID NO: 64341

SEQ ID NO: 119631 - DNA, 601 bp, Human; identical to SEQ ID NO: 64342

SEQ ID NO: 119632 - DNA, 601 bp, Human; identical to SEQ ID NO: 64343

SEQ ID NO: 119633 - DNA, 601 bp, Human; identical to SEQ ID NO: 64344

SEQ ID NO: 119634 - DNA, 601 bp, Human; identical to SEQ ID NO: 64345

SEQ ID NO: 119635 - DNA, 601 bp, Human; identical to SEQ ID NO: 64346

SEQ ID NO: 119636 - DNA, 601 bp, Human; identical to SEQ ID NO: 64347

SEQ ID NO: 119637 - DNA, 601 bp, Human; identical to SEQ ID NO: 64348

SEQ ID NO: 119638 - DNA, 601 bp, Human; identical to SEQ ID NO: 64349

SEQ ID NO: 119639 - DNA, 601 bp, Human; identical to SEQ ID NO: 64350

SEQ ID NO: 119640 - DNA, 601 bp, Human; identical to SEQ ID NO: 64351

SEQ ID NO: 119641 - DNA, 601 bp, Human; identical to SEQ ID NO: 64352

SEQ ID NO: 119642 - DNA, 601 bp, Human; identical to SEQ ID NO: 64353

SEQ ID NO: 119643 - DNA, 601 bp, Human; identical to SEQ ID NO: 64354

SEQ ID NO: 119644 - DNA, 601 bp, Human; identical to SEQ ID NO: 64355

SEQ ID NO: 119645 - DNA, 601 bp, Human; identical to SEQ ID NO: 64330

SEQ ID NO: 119646 - DNA, 601 bp, Human; identical to SEQ ID NO: 64331

SEQ ID NO: 119647 - DNA, 601 bp, Human; identical to SEQ ID NO: 64332

SEQ ID NO: 119648 - DNA, 601 bp, Human; identical to SEQ ID NO: 64333

SEQ ID NO: 119649 - DNA, 601 bp, Human; identical to SEQ ID NO: 64334

SEQ ID NO: 119650 - DNA, 601 bp, Human; identical to SEQ ID NO: 64335

SEQ ID NO: 119651 - DNA, 601 bp, Human; identical to SEQ ID NO: 64336

SEQ ID NO: 119652 - DNA, 601 bp, Human; identical to SEQ ID NO: 64337

SEQ ID NO: 119653 - DNA, 601 bp, Human; identical to SEQ ID NO: 64338

SEQ ID NO: 119654 - DNA, 601 bp, Human; identical to SEQ ID NO: 64339

SEQ ID NO: 119655 - DNA, 601 bp, Human; identical to SEQ ID NO: 64340

SEQ ID NO: 119656 - DNA, 601 bp, Human; identical to SEQ ID NO: 64341

SEQ ID NO: 119657 - DNA, 601 bp, Human; identical to SEQ ID NO: 64342

SEQ ID NO: 119658 - DNA, 601 bp, Human; identical to SEQ ID NO: 64343

SEQ ID NO: 119659 - DNA, 601 bp, Human; identical to SEQ ID NO: 64344

SEQ ID NO: 119660 - DNA, 601 bp, Human; identical to SEQ ID NO: 64345

SEQ ID NO: 119661 - DNA, 601 bp, Human; identical to SEQ ID NO: 64346

SEQ ID NO: 119662 - DNA, 601 bp, Human; identical to SEQ ID NO: 64347

SEQ ID NO: 119663 - DNA, 601 bp, Human; identical to SEQ ID NO: 64348

SEQ ID NO: 119664 - DNA, 601 bp, Human; identical to SEQ ID NO: 64349

SEQ ID NO: 119665 - DNA, 601 bp, Human; identical to SEQ ID NO: 64350

SEQ ID NO: 119666 - DNA, 601 bp, Human; identical to SEQ ID NO: 64351

SEQ ID NO: 119667 - DNA, 601 bp, Human; identical to SEQ ID NO: 64352

SEQ ID NO: 119668 - DNA, 601 bp, Human; identical to SEQ ID NO: 64353

SEQ ID NO: 119669 - DNA, 601 bp, Human; identical to SEQ ID NO: 64354

SEQ ID NO: 119670 - DNA, 601 bp, Human; identical to SEQ ID NO: 64355

SEQ ID NO: 119671 - DNA, 601 bp, Human; identical to SEQ ID NO: 64330

SEQ ID NO: 119672 - DNA, 601 bp, Human; identical to SEQ ID NO: 64331

SEQ ID NO: 119673 - DNA, 601 bp, Human; identical to SEQ ID NO: 64332

SEQ ID NO: 119674 - DNA, 601 bp, Human; identical to SEQ ID NO: 64333

SEQ ID NO: 119675 - DNA, 601 bp, Human; identical to SEQ ID NO: 64334

SEQ ID NO: 119676 - DNA, 601 bp, Human; identical to SEQ ID NO: 64335

SEQ ID NO: 119677 - DNA, 601 bp, Human; identical to SEQ ID NO: 64336

SEQ ID NO: 119678 - DNA, 601 bp, Human; identical to SEQ ID NO: 64337

SEQ ID NO: 119679 - DNA, 601 bp, Human; identical to SEQ ID NO: 64338

SEQ ID NO: 119680 - DNA, 601 bp, Human; identical to SEQ ID NO: 64339

SEQ ID NO: 119681 - DNA, 601 bp, Human; identical to SEQ ID NO: 64340

SEQ ID NO: 119682 - DNA, 601 bp, Human; identical to SEQ ID NO: 64341

SEQ ID NO: 119683 - DNA, 601 bp, Human; identical to SEQ ID NO: 64342

SEQ ID NO: 119684 - DNA, 601 bp, Human; identical to SEQ ID NO: 64343

SEQ ID NO: 119685 - DNA, 601 bp, Human; identical to SEQ ID NO: 64344

SEQ ID NO: 119686 - DNA, 601 bp, Human; identical to SEQ ID NO: 64345

SEQ ID NO: 119687 - DNA, 601 bp, Human; identical to SEQ ID NO: 64346

SEQ ID NO: 119688 - DNA, 601 bp, Human; identical to SEQ ID NO: 64347

SEQ ID NO: 119689 - DNA, 601 bp, Human; identical to SEQ ID NO: 64348

SEQ ID NO: 119690 - DNA, 601 bp, Human; identical to SEQ ID NO: 64349

SEQ ID NO: 119691 - DNA, 601 bp, Human; identical to SEQ ID NO: 64350

SEQ ID NO: 119692 - DNA, 601 bp, Human; identical to SEQ ID NO: 64351

SEQ ID NO: 119693 - DNA, 601 bp, Human; identical to SEQ ID NO: 64352

SEQ ID NO: 119694 - DNA, 601 bp, Human; identical to SEQ ID NO: 64353

SEQ ID NO: 119695 - DNA, 601 bp, Human; identical to SEQ ID NO: 64354

SEQ ID NO: 119696 - DNA, 601 bp, Human; identical to SEQ ID NO: 64355

SEQ ID NO: 119697 - DNA, 601 bp, Human; identical to SEQ ID NO: 64330

SEQ ID NO: 119698 - DNA, 601 bp, Human; identical to SEQ ID NO: 64331

SEQ ID NO: 119699 - DNA, 601 bp, Human; identical to SEQ ID NO: 64332

SEQ ID NO: 119700 - DNA, 601 bp, Human; identical to SEQ ID NO: 64333

SEQ ID NO: 119701 - DNA, 601 bp, Human; identical to SEQ ID NO: 64334

SEQ ID NO: 119702 - DNA, 601 bp, Human; identical to SEQ ID NO: 64335

SEQ ID NO: 119703 - DNA, 601 bp, Human; identical to SEQ ID NO: 64336

SEQ ID NO: 119704 - DNA, 601 bp, Human; identical to SEQ ID NO: 64337

SEQ ID NO: 119705 - DNA, 601 bp, Human; identical to SEQ ID NO: 64338

SEQ ID NO: 119706 - DNA, 601 bp, Human; identical to SEQ ID NO: 64339

SEQ ID NO: 119707 - DNA, 601 bp, Human; identical to SEQ ID NO: 64340

SEQ ID NO: 119708 - DNA, 601 bp, Human; identical to SEQ ID NO: 64341

SEQ ID NO: 119709 - DNA, 601 bp, Human; identical to SEQ ID NO: 64342

SEQ ID NO: 119710 - DNA, 601 bp, Human; identical to SEQ ID NO: 64343

SEQ ID NO: 119711 - DNA, 601 bp, Human; identical to SEQ ID NO: 64344

SEQ ID NO: 119712 - DNA, 601 bp, Human; identical to SEQ ID NO: 64345

SEQ ID NO: 119713 - DNA, 601 bp, Human; identical to SEQ ID NO: 64346

SEQ ID NO: 119714 - DNA, 601 bp, Human; identical to SEQ ID NO: 64347

SEQ ID NO: 119715 - DNA, 601 bp, Human; identical to SEQ ID NO: 64348

SEQ ID NO: 119716 - DNA, 601 bp, Human; identical to SEQ ID NO: 64349

SEQ ID NO: 119717 - DNA, 601 bp, Human; identical to SEQ ID NO: 64350

SEQ ID NO: 119718 - DNA, 601 bp, Human; identical to SEQ ID NO: 64351

SEQ ID NO: 119719 - DNA, 601 bp, Human; identical to SEQ ID NO: 64352

SEQ ID NO: 119720 - DNA, 601 bp, Human; identical to SEQ ID NO: 64353

SEQ ID NO: 119721 - DNA, 601 bp, Human; identical to SEQ ID NO: 64330

SEQ ID NO: 119722 - DNA, 601 bp, Human; identical to SEQ ID NO: 64331

SEQ ID NO: 119723 - DNA, 601 bp, Human; identical to SEQ ID NO: 64332

SEQ ID NO: 119724 - DNA, 601 bp, Human; identical to SEQ ID NO: 64333

SEQ ID NO: 119725 - DNA, 601 bp, Human; identical to SEQ ID NO: 64334

SEQ ID NO: 119726 - DNA, 601 bp, Human; identical to SEQ ID NO: 64335

SEQ ID NO: 119727 - DNA, 601 bp, Human; identical to SEQ ID NO: 64336

SEQ ID NO: 119728 - DNA, 601 bp, Human; identical to SEQ ID NO: 64337

SEQ ID NO: 119729 - DNA, 601 bp, Human; identical to SEQ ID NO: 64338

SEQ ID NO: 119730 - DNA, 601 bp, Human; identical to SEQ ID NO: 64339

SEQ ID NO: 119731 - DNA, 601 bp, Human; identical to SEQ ID NO: 64340

SEQ ID NO: 119732 - DNA, 601 bp, Human; identical to SEQ ID NO: 64341

SEQ ID NO: 119733 - DNA, 601 bp, Human; identical to SEQ ID NO: 64342

SEQ ID NO: 119734 - DNA, 601 bp, Human; identical to SEQ ID NO: 64343

SEQ ID NO: 119735 - DNA, 601 bp, Human; identical to SEQ ID NO: 64344

SEQ ID NO: 119736 - DNA, 601 bp, Human; identical to SEQ ID NO: 64345

SEQ ID NO: 119737 - DNA, 601 bp, Human; identical to SEQ ID NO: 64346

SEQ ID NO: 119738 - DNA, 601 bp, Human; identical to SEQ ID NO: 64347

SEQ ID NO: 119739 - DNA, 601 bp, Human; identical to SEQ ID NO: 64348

SEQ ID NO: 119740 - DNA, 601 bp, Human; identical to SEQ ID NO: 64349

SEQ ID NO: 119741 - DNA, 601 bp, Human; identical to SEQ ID NO: 64350

SEQ ID NO: 119742 - DNA, 601 bp, Human; identical to SEQ ID NO: 64351

SEQ ID NO: 119743 - DNA, 601 bp, Human; identical to SEQ ID NO: 64352

SEQ ID NO: 119744 - DNA, 601 bp, Human; identical to SEQ ID NO: 64353

SEQ ID NO: 119745 - DNA, 601 bp, Human; identical to SEQ ID NO: 64330

SEQ ID NO: 119746 - DNA, 601 bp, Human; identical to SEQ ID NO: 64331

SEQ ID NO: 119747 - DNA, 601 bp, Human; identical to SEQ ID NO: 64332

SEQ ID NO: 119748 - DNA, 601 bp, Human; identical to SEQ ID NO: 64333

SEQ ID NO: 119749 - DNA, 601 bp, Human; identical to SEQ ID NO: 64334

SEQ ID NO: 119750 - DNA, 601 bp, Human; identical to SEQ ID NO: 64335

SEQ ID NO: 119751 - DNA, 601 bp, Human; identical to SEQ ID NO: 64336

SEQ ID NO: 119752 - DNA, 601 bp, Human; identical to SEQ ID NO: 64337

SEQ ID NO: 119753 - DNA, 601 bp, Human; identical to SEQ ID NO: 64338

SEQ ID NO: 119754 - DNA, 601 bp, Human; identical to SEQ ID NO: 64339

SEQ ID NO: 119755 - DNA, 601 bp, Human; identical to SEQ ID NO: 64340

SEQ ID NO: 119756 - DNA, 601 bp, Human; identical to SEQ ID NO: 64341

SEQ ID NO: 119757 - DNA, 601 bp, Human; identical to SEQ ID NO: 64342

SEQ ID NO: 119758 - DNA, 601 bp, Human; identical to SEQ ID NO: 64343

SEQ ID NO: 119759 - DNA, 601 bp, Human; identical to SEQ ID NO: 64344

SEQ ID NO: 119760 - DNA, 601 bp, Human; identical to SEQ ID NO: 64345

SEQ ID NO: 119761 - DNA, 601 bp, Human; identical to SEQ ID NO: 64346

SEQ ID NO: 119762 - DNA, 601 bp, Human; identical to SEQ ID NO: 64347

SEQ ID NO: 119763 - DNA, 601 bp, Human; identical to SEQ ID NO: 64348

SEQ ID NO: 119764 - DNA, 601 bp, Human; identical to SEQ ID NO: 64349

SEQ ID NO: 119765 - DNA, 601 bp, Human; identical to SEQ ID NO: 64350

SEQ ID NO: 119766 - DNA, 601 bp, Human; identical to SEQ ID NO: 64351

SEQ ID NO: 119767 - DNA, 601 bp, Human; identical to SEQ ID NO: 64352

SEQ ID NO: 119768 - DNA, 601 bp, Human; identical to SEQ ID NO: 64353

SEQ ID NO: 119769 - DNA, 601 bp, Human; identical to SEQ ID NO: 64330

SEQ ID NO: 119770 - DNA, 601 bp, Human; identical to SEQ ID NO: 64331

SEQ ID NO: 119771 - DNA, 601 bp, Human; identical to SEQ ID NO: 64332

SEQ ID NO: 119772 - DNA, 601 bp, Human; identical to SEQ ID NO: 64333

SEQ ID NO: 119773 - DNA, 601 bp, Human; identical to SEQ ID NO: 64334

SEQ ID NO: 119774 - DNA, 601 bp, Human; identical to SEQ ID NO: 64335

SEQ ID NO: 119775 - DNA, 601 bp, Human; identical to SEQ ID NO: 64336

SEQ ID NO: 119776 - DNA, 601 bp, Human; identical to SEQ ID NO: 64337

SEQ ID NO: 119777 - DNA, 601 bp, Human; identical to SEQ ID NO: 64338

SEQ ID NO: 119778 - DNA, 601 bp, Human; identical to SEQ ID NO: 64339

SEQ ID NO: 119779 - DNA, 601 bp, Human; identical to SEQ ID NO: 64340

SEQ ID NO: 119780 - DNA, 601 bp, Human; identical to SEQ ID NO: 64341

SEQ ID NO: 119781 - DNA, 601 bp, Human; identical to SEQ ID NO: 64342

SEQ ID NO: 119782 - DNA, 601 bp, Human; identical to SEQ ID NO: 64343

SEQ ID NO: 119783 - DNA, 601 bp, Human; identical to SEQ ID NO: 64344

SEQ ID NO: 119784 - DNA, 601 bp, Human; identical to SEQ ID NO: 64345

SEQ ID NO: 119785 - DNA, 601 bp, Human; identical to SEQ ID NO: 64346

SEQ ID NO: 119786 - DNA, 601 bp, Human; identical to SEQ ID NO: 64347

SEQ ID NO: 119787 - DNA, 601 bp, Human; identical to SEQ ID NO: 64348

SEQ ID NO: 119788 - DNA, 601 bp, Human; identical to SEQ ID NO: 64349

SEQ ID NO: 119789 - DNA, 601 bp, Human; identical to SEQ ID NO: 64350

SEQ ID NO: 119790 - DNA, 601 bp, Human; identical to SEQ ID NO: 64351

SEQ ID NO: 119791 - DNA, 601 bp, Human; identical to SEQ ID NO: 64352

SEQ ID NO: 119792 - DNA, 601 bp, Human; identical to SEQ ID NO: 64353

SEQ ID NO: 119793 - DNA, 601 bp, Human; identical to SEQ ID NO: 64330

SEQ ID NO: 119794 - DNA, 601 bp, Human; identical to SEQ ID NO: 64331

SEQ ID NO: 119795 - DNA, 601 bp, Human; identical to SEQ ID NO: 64332

SEQ ID NO: 119796 - DNA, 601 bp, Human; identical to SEQ ID NO: 64333

SEQ ID NO: 119797 - DNA, 601 bp, Human; identical to SEQ ID NO: 64334

SEQ ID NO: 119798 - DNA, 601 bp, Human; identical to SEQ ID NO: 64335

SEQ ID NO: 119799 - DNA, 601 bp, Human; identical to SEQ ID NO: 64336

SEQ ID NO: 119800 - DNA, 601 bp, Human; identical to SEQ ID NO: 64337

SEQ ID NO: 119801 - DNA, 601 bp, Human; identical to SEQ ID NO: 64338

SEQ ID NO: 119802 - DNA, 601 bp, Human; identical to SEQ ID NO: 64339

SEQ ID NO: 119803 - DNA, 601 bp, Human; identical to SEQ ID NO: 64340

SEQ ID NO: 119804 - DNA, 601 bp, Human; identical to SEQ ID NO: 64341

SEQ ID NO: 119805 - DNA, 601 bp, Human; identical to SEQ ID NO: 64342

SEQ ID NO: 119806 - DNA, 601 bp, Human; identical to SEQ ID NO: 64343

SEQ ID NO: 119807 - DNA, 601 bp, Human; identical to SEQ ID NO: 64344

SEQ ID NO: 119808 - DNA, 601 bp, Human; identical to SEQ ID NO: 64345

SEQ ID NO: 119809 - DNA, 601 bp, Human; identical to SEQ ID NO: 64346

SEQ ID NO: 119810 - DNA, 601 bp, Human; identical to SEQ ID NO: 64347

SEQ ID NO: 119811 - DNA, 601 bp, Human; identical to SEQ ID NO: 64348

SEQ ID NO: 119812 - DNA, 601 bp, Human; identical to SEQ ID NO: 64349

SEQ ID NO: 119813 - DNA, 601 bp, Human; identical to SEQ ID NO: 64350

SEQ ID NO: 119814 - DNA, 601 bp, Human; identical to SEQ ID NO: 64351

SEQ ID NO: 119815 - DNA, 601 bp, Human; identical to SEQ ID NO: 64352

SEQ ID NO: 119816 - DNA, 601 bp, Human; identical to SEQ ID NO: 64353

SEQ ID NO: 119817 - DNA, 601 bp, Human; identical to SEQ ID NO: 64330

SEQ ID NO: 119818 - DNA, 601 bp, Human; identical to SEQ ID NO: 64331

SEQ ID NO: 119819 - DNA, 601 bp, Human; identical to SEQ ID NO: 64332

SEQ ID NO: 119820 - DNA, 601 bp, Human; identical to SEQ ID NO: 64333

SEQ ID NO: 119821 - DNA, 601 bp, Human; identical to SEQ ID NO: 64334

SEQ ID NO: 119822 - DNA, 601 bp, Human; identical to SEQ ID NO: 64335

SEQ ID NO: 119823 - DNA, 601 bp, Human; identical to SEQ ID NO: 64336

SEQ ID NO: 119824 - DNA, 601 bp, Human; identical to SEQ ID NO: 64337

SEQ ID NO: 119825 - DNA, 601 bp, Human; identical to SEQ ID NO: 64338

SEQ ID NO: 119826 - DNA, 601 bp, Human; identical to SEQ ID NO: 64339

SEQ ID NO: 119827 - DNA, 601 bp, Human; identical to SEQ ID NO: 64340

SEQ ID NO: 119828 - DNA, 601 bp, Human; identical to SEQ ID NO: 64341

SEQ ID NO: 119829 - DNA, 601 bp, Human; identical to SEQ ID NO: 64342

SEQ ID NO: 119830 - DNA, 601 bp, Human; identical to SEQ ID NO: 64343

SEQ ID NO: 119831 - DNA, 601 bp, Human; identical to SEQ ID NO: 64344

SEQ ID NO: 119832 - DNA, 601 bp, Human; identical to SEQ ID NO: 64345

SEQ ID NO: 119833 - DNA, 601 bp, Human; identical to SEQ ID NO: 64346

SEQ ID NO: 119834 - DNA, 601 bp, Human; identical to SEQ ID NO: 64347

SEQ ID NO: 119835 - DNA, 601 bp, Human; identical to SEQ ID NO: 64348

SEQ ID NO: 119836 - DNA, 601 bp, Human; identical to SEQ ID NO: 64349

SEQ ID NO: 119837 - DNA, 601 bp, Human; identical to SEQ ID NO: 64350

SEQ ID NO: 119838 - DNA, 601 bp, Human; identical to SEQ ID NO: 64351

SEQ ID NO: 119839 - DNA, 601 bp, Human; identical to SEQ ID NO: 64352

SEQ ID NO: 119840 - DNA, 601 bp, Human; identical to SEQ ID NO: 64353

SEQ ID NO: 119841 - DNA, 601 bp, Human; identical to SEQ ID NO: 64330

SEQ ID NO: 119842 - DNA, 601 bp, Human; identical to SEQ ID NO: 64331

SEQ ID NO: 119843 - DNA, 601 bp, Human; identical to SEQ ID NO: 64332

SEQ ID NO: 119844 - DNA, 601 bp, Human; identical to SEQ ID NO: 64333

SEQ ID NO: 119845 - DNA, 601 bp, Human; identical to SEQ ID NO: 64334

SEQ ID NO: 119846 - DNA, 601 bp, Human; identical to SEQ ID NO: 64335

SEQ ID NO: 119847 - DNA, 601 bp, Human; identical to SEQ ID NO: 64336

SEQ ID NO: 119848 - DNA, 601 bp, Human; identical to SEQ ID NO: 64337

SEQ ID NO: 119849 - DNA, 601 bp, Human; identical to SEQ ID NO: 64338

SEQ ID NO: 119850 - DNA, 601 bp, Human; identical to SEQ ID NO: 64339

SEQ ID NO: 119851 - DNA, 601 bp, Human; identical to SEQ ID NO: 64340

SEQ ID NO: 119852 - DNA, 601 bp, Human; identical to SEQ ID NO: 64341

SEQ ID NO: 119853 - DNA, 601 bp, Human; identical to SEQ ID NO: 64342

SEQ ID NO: 119854 - DNA, 601 bp, Human; identical to SEQ ID NO: 64343

SEQ ID NO: 119855 - DNA, 601 bp, Human; identical to SEQ ID NO: 64344

SEQ ID NO: 119856 - DNA, 601 bp, Human; identical to SEQ ID NO: 64345

SEQ ID NO: 119857 - DNA, 601 bp, Human; identical to SEQ ID NO: 64346

SEQ ID NO: 119858 - DNA, 601 bp, Human; identical to SEQ ID NO: 64347

SEQ ID NO: 119859 - DNA, 601 bp, Human; identical to SEQ ID NO: 64348

SEQ ID NO: 119860 - DNA, 601 bp, Human; identical to SEQ ID NO: 64349

SEQ ID NO: 119861 - DNA, 601 bp, Human; identical to SEQ ID NO: 64350

SEQ ID NO: 119862 - DNA, 601 bp, Human; identical to SEQ ID NO: 64351

SEQ ID NO: 119863 - DNA, 601 bp, Human; identical to SEQ ID NO: 64352

SEQ ID NO: 119864 - DNA, 601 bp, Human; identical to SEQ ID NO: 64353

SEQ ID NO: 119865 - DNA, 601 bp, Human
ttttttctatgtcgaatttgtggaaagtaaattcattttatattaggtagcagacgcatattcttttttaggcgatgcaacaacaaaaatcctgcttagcaaacccaagatgtcaacgttcgttataaaaaaaaaaaagtaagttcttcagttcaaaaccgaacatgctaacaaatattaaaactttttaagtttcccagggaaactgccgctgcctacaaaattcacatgaaacgctgacgttggagttactgtacttatcagtcaggtttccgtgaaatttgtcaaaccggccagagcrctggtgtcttgacaattccttacgggaaagcccctcagcaccctccgggctgtggaggacctgattgggaccaacagccgaggggcccggaaggcggaggaccgagaggcgacggccaggctgcgtggccaagctgacggggaaccccggcctccatctgaggatactaagcggttccgacgccttccccgcggcagtcgggaccgggagaatcggacagaaaccagcctcagagtccggggcaggagccgttgacggctgcccctcaacgctgcgcttcgggttgggttaagtccccaa

SEQ ID NO: 119866 - DNA, 601 bp, Human
tcaaaacacaaatcgccctgatttgtaacctaaaactcaatgcaagtaaaatctcaatattctgatgttgtttcttgtatatctcattcaaccactaagccagatgcaaacaatttacttctctacaaaatttatcttgtaaaaaagcacgatggaatacatctttaatcaacctttaaccatatgcatgtgcgtctatgcgtttgcgttaattgggagaagttgagtgtagaaatgtaccgaaaggactagaaaatcaaaccagagaactacaaaatgaactccaagaaacgtggttttsaatcccatctctctctcaccacctccctcaaaatgttgtaacattacaatacccctacgtttgtaatcgatcattttttttctatgtcgaatttgtggaaagtaaattcattttatattaggtagcagacgcatattcttttttaggcgatgcaacaacaaaaatcctgcttagcaaacccaagatgtcaacgttcgttataaaaaaaaaaaagtaagttcttcagttcaaaaccgaacatgctaacaaatattaaaactttttaagtttcccagggaaactgccgctgcctacaaaatt

SEQ ID NO: 119867 - DNA, 601 bp, Human
acattaaaggctccaattagctataaatcagttgtctttcctactgggggagaacaagagagaaaagagagagggggtagttagggagtaagagaactggaagagcttccaaattaaattctgaaaaacgtacctattgcatacctaaaatttctttcagaggctgttagaaaaatcccatcaaaaataagactaaaatcaaaccttcccaaatctgagggttaggtcttttctcctgtgtagatcttccattttaagacctttaaaaagagcctgaagaggttagagaccctcataaaayaaaacttctaagctgcatgctttccctgctcgttcctaaacccagacaagtgccacacattggcactattgttatgcaaacaatgcctaaaaggttataaccattaacgacctctcattaaaacggctttgaaaaatttgtcacaccatctaaaaaagctagcaggtacattaaatccatctaaatcgacattcaaaacacaaatcgccctgatttgtaacctaaaactcaatgcaagtaaaatctcaatattctgatgttgtttcttgtatatctcattcaaccactaagccagatgca

SEQ ID NO: 119868 - DNA, 601 bp, Human
ggagcatttccactggacctctagcaggcaaaggcagtaacttttaattctggtcatctcccccattccctttattaaaaatgtgaaatacttctaggaggaggaggaagttggagcaaaaatacagaaaaatacaagatcacaagtacaaagttttctaagtgcacattacttgaaattctcatagtctggtcatttattttaagtaatgactctatgtgggtcccaatatcacactgaaaaatcatacagaaagtcatatccttcactaaagatgtatgtttagcaagacaaaaaacartaacatattgtcttacagtatcattttctgatgcaaatattgtgtttctttcaaatgtgatatttaacacgccctaacgcgtaatacttttgtagccattacccttttaaaatcccctatcgaatatggtatcactatgctaaaggactgtccattctatcttgttcactcttctgtttgaaattgctaatataatttccctcacttctggtcatgtttgtttttaaaaaactcactattaatcttatttttcctttaagtaaaaaaatcattaccctgggataccaaaagagcagcttc

SEQ ID NO: 119869 - DNA, 601 bp, Human
tattttaaaaaatggaatgtaactgcctaaaagtccatacacaaccatgagtttagccctttcaacatccttagggaatgaactttaattctggagcatttccactggacctctagcaggcaaaggcagtaacttttaattctggtcatctcccccattccctttattaaaaatgtgaaatacttctaggaggaggaggaagttggagcaaaaatacagaaaaatacaagatcacaagtacaaagttttctaagtgcacattacttgaaattctcatagtctggtcatttattttaagtartgactctatgtgggtcccaatatcacactgaaaaatcatacagaaagtcatatccttcactaaagatgtatgtttagcaagacaaaaaacagtaacatattgtcttacagtatcattttctgatgcaaatattgtgtttctttcaaatgtgatatttaacacgccctaacgcgtaatacttttgtagccattacccttttaaaatcccctatcgaatatggtatcactatgctaaaggactgtccattctatcttgttcactcttctgtttgaaattgctaatataatttccctcacttc

SEQ ID NO: 119870 - DNA, 601 bp, Human
ttcatgttagttttcactcctccttgactaacaccatctagttttaaaaagcacattccttcataagggatcacttttaaaacttgggatccagcttgctgtattagggaaatacaaatagacatgttccaaaaatggtattgccattgatcattggtataatatggatactagaatttcagagtggtaagcgtattttaaaaaatggaatgtaactgcctaaaagtccatacacaaccatgagtttagccctttcaacatccttagggaatgaactttaattctggagcatttccactgracctctagcaggcaaaggcagtaacttttaattctggtcatctcccccattccctttattaaaaatgtgaaatacttctaggaggaggaggaagttggagcaaaaatacagaaaaatacaagatcacaagtacaaagttttctaagtgcacattacttgaaattctcatagtctggtcatttattttaagtaatgactctatgtgggtcccaatatcacactgaaaaatcatacagaaagtcatatccttcactaaagatgtatgtttagcaagacaaaaaacagtaacatattgtctta

SEQ ID NO: 119871 - DNA, 601 bp, Human
gtttccaaagacctgggaatctgttaagagatatcccctgcagtcaggggcggtcagtaaagtgctgagccttgactttgtaatgtgtgtattcctataatatcagttatacaaaattataaaagtcagactaataaaatagacaactcagaaaattttaaattcataaacacatcgctcaaggcaatcagaatgcagtcttcttaggatacaagcaaaggagagcgcattctcttggtaccaaattggtcccctcaatacttcatgttagttttcactcctccttgactaacaccatctagttttaaaaagcacattccttcataagggatcacttttaaaacttgggatccagcttgctgtattagggaaatacaaatagacatgttccaaaaatggtattgccattgatcattggtataatatggatactagaatttcagagtggtaagcgtattttaaaaaatggaatgtaactgcctaaaagtccatacacaaccatgagtttagccctttcaacatccttagggaatgaactttaattctggagcatttccactggacctctagcaggcaaaggcagtaacttttaattctggtc

SEQ ID NO: 119872 - DNA, 601 bp, Human
ccttcaaaaggttttgcaaggatcaaacaagatatatatgaaagtgctaggcagaccattaggccctataaaaatgtaagtggcattataattatcatcatcattattattacattgatcaactgaactactgctgtactaacaaccaatttttggcacacaaactttttaataagaccctaatctcccagaaggcagatgtttccagtctaacacagtgaaaagcacccctgttaggaacatggccactcaaatgccttttgaatttaattgaaatagaccccagaaaacagaagtttaratgaataaataaaaagacaaatctagactcacgatgcacattagctctgagttttaagttgattgcctttttgcctcttctattttagcaggtcattatgttataaataccctcttcctccctgtgtttcagccccatataatatcagatgcagaaaaaaaaaacataactctttgttactgttagttatgggcataaactctcactgaaaaagtgaccaagagaaagacagcacaacgatctgggggagggaggaaggaaaggagagaccggtacagccagaagagaagatagagccaa

SEQ ID NO: 119873 - DNA, 601 bp, Human
gccacagaccgttagaaaaagtgtatggtgatgaaaactatcaatttctttaaagtcaaggccaatgtctttcttatgaattattctatttatttctactctctctccttcaaaaggttttgcaaggatcaaacaagatatatatgaaagtgctaggcagaccattaggccctataaaaatgtaagtggcattataattatcatcatcattattattacattgatcaactgaactactgctgtactaacaaccaatttttggcacacaaactttttaataagaccctaatctcccagaagrcagatgtttccagtctaacacagtgaaaagcacccctgttaggaacatggccactcaaatgccttttgaatttaattgaaatagaccccagaaaacagaagtttagatgaataaataaaaagacaaatctagactcacgatgcacattagctctgagttttaagttgattgcctttttgcctcttctattttagcaggtcattatgttataaataccctcttcctccctgtgtttcagccccatataatatcagatgcagaaaaaaaaaacataactctttgttactgttagttatgggc

SEQ ID NO: 119874 - DNA, 601 bp, Human
gtttgactgacaatttatgaccaaaacagacaatgttaagtaaaggtttggaaggatctagatccacacctatcttttaagaaattattcctggcacaggcaagaatcttgccccagattaaaaaaaaaaatctcatagaaaaatcaaaaatagccatttaaagtattagaatcaaaagtcacaaaagatagctccttcttaagaggggtagactagttcatattttctccatggttgcgagagaagcaacacaaaatataaagatttaaactccttccctcaaaaaaaaaaaaaacaaamaaaaaaaaaaaacggaacaaaacgatgaaaaaacaacgtgccacagaccgttagaaaaagtgtatggtgatgaaaactatcaatttctttaaagtcaaggccaatgtctttcttatgaattattctatttatttctactctctctccttcaaaaggttttgcaaggatcaaacaagatatatatgaaagtgctaggcagaccattaggccctataaaaatgtaagtggcattataattatcatcatcattattattacattgatcaactgaactactgctgtactaacaaccaatttttg

SEQ ID NO: 119875 - DNA, 601 bp, Human
tgtagtttgactgacaatttatgaccaaaacagacaatgttaagtaaaggtttggaaggatctagatccacacctatcttttaagaaattattcctggcacaggcaagaatcttgccccagattaaaaaaaaaaatctcatagaaaaatcaaaaatagccatttaaagtattagaatcaaaagtcacaaaagatagctccttcttaagaggggtagactagttcatattttctccatggttgcgagagaagcaacacaaaatataaagatttaaactccttccctcaaaaaaaaaaaaaamaaaaaaaaaaaaaaaacggaacaaaacgatgaaaaaacaacgtgccacagaccgttagaaaaagtgtatggtgatgaaaactatcaatttctttaaagtcaaggccaatgtctttcttatgaattattctatttatttctactctctctccttcaaaaggttttgcaaggatcaaacaagatatatatgaaagtgctaggcagaccattaggccctataaaaatgtaagtggcattataattatcatcatcattattattacattgatcaactgaactactgctgtactaacaaccaatt

SEQ ID NO: 119876 - DNA, 601 bp, Human
ccaatcagtatttgtattttattgtccaactaagaaagactcagaactgataactctgggtgatgggacttgggatatttactgattttgtcatggttaaatcattgtgcttcattgatgcaacagagaactaactatgcatgatttgcctttcttaagcctggctatgaggaagtcagacctcacaaaacagtctcctcagagaatcctctactctgaaatacaaaaactatcattcatcattttatagaaataaagaacgaggagtccctcagcaaatgataattccacatggtaacayaggcccatgtagtggaagggatcagggcaggaccccaggagaattatctaattcaagtcctgtgatgaaattgtccagcttccctgtgttaaatggagatgatacaaacaccaaaaagctgcatagttatgaaaaagtatttaaaaaaaaaacctgaagtcctctattaacatgtagtttgactgacaatttatgaccaaaacagacaatgttaagtaaaggtttggaaggatctagatccacacctatcttttaagaaattattcctggcacaggcaagaatcttgccccagattaaaa

SEQ ID NO: 119877 - DNA, 601 bp, Human
gccgcagacagtatataactgaatgagtgcagttgtgttacaataaaactttatttataaaaccaggcagacagtccacagtttgctgacccctgatactgtcactaagataactcaagagacaaaaactccaatcagtatttgtattttattgtccaactaagaaagactcagaactgataactctgggtgatgggacttgggatatttactgattttgtcatggttaaatcattgtgcttcattgatgcaacagagaactaactatgcatgatttgcctttcttaagcctggctatgargaagtcagacctcacaaaacagtctcctcagagaatcctctactctgaaatacaaaaactatcattcatcattttatagaaataaagaacgaggagtccctcagcaaatgataattccacatggtaacacaggcccatgtagtggaagggatcagggcaggaccccaggagaattatctaattcaagtcctgtgatgaaattgtccagcttccctgtgttaaatggagatgatacaaacaccaaaaagctgcatagttatgaaaaagtatttaaaaaaaaaacctgaagtcctctattaa

SEQ ID NO: 119878 - DNA, 601 bp, Human
aaatgtaactgtccatgtagctgataagtacctttctgaccaggatttgatcaaaggcttattttaactcagagtctctctttttccaaatgaaggaagggcatgcaagttttttctaaaatgtgggctatatggtttctgtggctctgccattatagtcagaaagctgccgcagacagtatataactgaatgagtgcagttgtgttacaataaaactttatttataaaaccaggcagacagtccacagtttgctgacccctgatactgtcactaagataactcaagagacaaaaactccwatcagtatttgtattttattgtccaactaagaaagactcagaactgataactctgggtgatgggacttgggatatttactgattttgtcatggttaaatcattgtgcttcattgatgcaacagagaactaactatgcatgatttgcctttcttaagcctggctatgaggaagtcagacctcacaaaacagtctcctcagagaatcctctactctgaaatacaaaaactatcattcatcattttatagaaataaagaacgaggagtccctcagcaaatgataattccacatggtaacacag

SEQ ID NO: 119879 - DNA, 601 bp, Human
aaagtcagtgaagaaactctttaagatgccacacatatctttttttttttttttttttttttgtgctgttgcatccctaggacctggcatcatatcaggcactatgtgtcaaataaatgtaactgtccatgtagctgataagtacctttctgaccaggatttgatcaaaggcttattttaactcagagtctctctttttccaaatgaaggaagggcatgcaagttttttctaaaatgtgggctatatggtttctgtggctctgccattatagtcagaaagctgccgcagacagtatataaytgaatgagtgcagttgtgttacaataaaactttatttataaaaccaggcagacagtccacagtttgctgacccctgatactgtcactaagataactcaagagacaaaaactccaatcagtatttgtattttattgtccaactaagaaagactcagaactgataactctgggtgatgggacttgggatatttactgattttgtcatggttaaatcattgtgcttcattgatgcaacagagaactaactatgcatgatttgcctttcttaagcctggctatgaggaagtcagacctcacaaa

SEQ ID NO: 119880 - DNA, 601 bp, Human
gcagtgtaaatatataaggaggattccatagctacccagaatattgaactcttatgagtaatgcacataataaatgtaataaaaataattaaaagaatacataaaacagaccggttttataaaactttgttgatcatataatttttttgagatgaagtttcactcttgtcgcccaggctggagtgcaatggtatgatctgagcttattgcaacctctgcctcctgggttcaagtgattctcctgcctcagccttccaagaagctgggattacaggcgtgtaccaccacacagctaatttcrtatttttagtagagatggggtttcaccatgattggccaggttggtgtcaaactcctggcttcaggtgatccacccgcctcagcctcccaaagtgctgggattacaggtgtgagccactgcgcctggccagttgatcacataattctgatcttccttaaaattggtttccattaatttagatctctaaatatatatatagtcatcactttgcaaaaatgcaatagaattttggctatcattatatgccacttactttaacacacttttcatttagtccttttaaccccataaagtagatac

SEQ ID NO: 119881 - DNA, 601 bp, Human
ctgtcacagtcaataaagaaattaaagaaatgctaggagggctttcaaaatagccacggcctggtgcttttactttctggaaggtgactgctcctggaaaatgctctcaaaattccatatgttatcttggacagtcaggactagtaaaagtttcttcgtttttaaattatataaagtaagataccttcccactgtcaaaaggtatctaccttctgagaatgtccttgtatgctgcatacttcccacatttatgtatcaatatcttgtatttttatcctaactacttaaaataccagaaacrtctatttgcaacctggagtttaggctcagctaatcgggcatattgaagcatattcatgctatattttggcacaaatgtcaagatatctaattttattattaaaatactgtcagagaaaatgctttagtaacttttttagtaaagacaagaccttggtggaaaaccctcccaggaatcccatttggtaaaaacgcagtgtaaatatataaggaggattccatagctacccagaatattgaactcttatgagtaatgcacataataaatgtaataaaaataattaaaagaatacataaaaca

SEQ ID NO: 119882 - DNA, 601 bp, Human
cttgttgtaaataaacctgctgtaaataagctctaagattttgaaggaaaacaatttaaacataactcaatcttaaaggcagacagtagagaaataccagtgataagtaattcccaatgtgcataatctcatatatttaaaaggttaaatgaaatagatctcaaagatacaattaaaggcaattaaaaattaacccaggtgacattacagcaatcacctctacgtgaattagatttgctgtttggggggaaatgaatggctttgaaattacctgtcacagtcaataaagaaattaaagaamtgctaggagggctttcaaaatagccacggcctggtgcttttactttctggaaggtgactgctcctggaaaatgctctcaaaattccatatgttatcttggacagtcaggactagtaaaagtttcttcgtttttaaattatataaagtaagataccttcccactgtcaaaaggtatctaccttctgagaatgtccttgtatgctgcatacttcccacatttatgtatcaatatcttgtatttttatcctaactacttaaaataccagaaacgtctatttgcaacctggagtttaggctcag

SEQ ID NO: 119883 - DNA, 601 bp, Human
gataagaaacaggtgtttccagtttgacctaaacaaaagcttttctctttccagagttgtagtgataaagaaatactactttggctctccaaaggtcagacagtgatgaggaagggaaacagagcaggtaactacttctggaggtaacagagctgaactggagtaaaagaaaggcttccttctataataaaaattagaaagttcacacgcagacatactaatttttaaccacattctacagaggtcaattaatccccacgtttagccccagggaagtgttgtttagagcccagcagaagtstaggtggtgaaatcacccaattattattccaactggaattttcaaagcctggaagtgttttcatcatgtgatccaacagagacttgttgtaaataaacctgctgtaaataagctctaagattttgaaggaaaacaatttaaacataactcaatcttaaaggcagacagtagagaaataccagtgataagtaattcccaatgtgcataatctcatatatttaaaaggttaaatgaaatagatctcaaagatacaattaaaggcaattaaaaattaacccaggtgacattacagcaatcacc

SEQ ID NO: 119884 - DNA, 601 bp, Human
gtgggaaagagtcacacaacctataccactttctgactgtttaatctttaaggaatcactagaaatgatattaaaaaaaaaaaaaaaaacctaagagtcactggacttgaaattcaaagtccaatgaatagatggatgaaaataatgtaaaataaaatatattaaaatataactttttaatattttgaaaaatgtataatcaagattggaaagagttttcagattcatgatatgctaaattcttctagataagaaacaggtgtttccagtttgacctaaacaaaagcttttctctttccasagttgtagtgataaagaaatactactttggctctccaaaggtcagacagtgatgaggaagggaaacagagcaggtaactacttctggaggtaacagagctgaactggagtaaaagaaaggcttccttctataataaaaattagaaagttcacacgcagacatactaatttttaaccacattctacagaggtcaattaatccccacgtttagccccagggaagtgttgtttagagcccagcagaagtctaggtggtgaaatcacccaattattattccaactggaattttcaaagcctgga

SEQ ID NO: 119885 - DNA, 601 bp, Human
tatacatcctagatgctctctcaccaggtatatgaggagacatgatcaggaatgtccaatgcagcattactgcaataacaaaatgctggatgcatcataaatgtcaagagcagaaactaaaaattaggatatattcaaagaatggaatactctgcaacaattacaatgaactaattataagtacatccaacaacatggatgaatactgaacatatgtttaacaagctaatcaaattacagaaggatatatatatatatatggtacatatatataaaacatttatataaaagatgttaccaygcaaaacaatagcatgtattatttatggatacatatacctatagtgaagataaatgcctctggcaaaggaagagaaagaaagaaatgggggcttcaatttattccttttaaaaaattagaagcaaatactgcaaaacattaagaactaacaaatctaggtacaggtacacacatttgttatattactgctttacttttctgtatgattaaagcaattcattttctgtcaaatatgtctggcaatagtgtgctgttcttctgctgagctggaaacatctctatcttctgaatcctcattca

SEQ ID NO: 119886 - DNA, 601 bp, Human
tgaataagttataataatcatgttaccctagagttttatacagtggccgcctagaggtaagtttgtggaacacagcactgttcttagtttagggaaactagtgtgtattaaaaccatcaatcaaagtagtttctcctattttcccattatagagaagaccacacattctagacttcctaatctgattccaagacttcaaggaatacaatttttaaaaattatttaaacatcaatattgtttgactttccaatgctacatcatttgtctttattattgtccccatgcataagcaatgaccarttctaggaggtaaagacagaaatgcaaaaagcaaaaataaactttctgaagactacaaaaagaatgccttgaaaaatctgcaataggaatgcatttctgaaacaggactctaaaggaaaaatccttcttcctttgcatttaaaactgtatgacagttacacaagaaaaagaagagggaaagttacaagaggaaagaaaatgtttgcatagtaaataactgataaaaattataatcctgaatacatttataaaaactgataacaaatcagtaaatacacaacatagaaaaatgagcaaatg

SEQ ID NO: 119887 - DNA, 601 bp, Human
gttatatgtaagtatatacacagaaggggtagttttagttttaaggttggagaatttcacacttccacaatattttctttaaaattagagatacacatgtatgaaccaaatcactgatgaaattcaaacacaaaggtaaatatatacaacagctttgggtttagaacttaagttaaaatgttaacaaaataagaagtaatgttattttcagacctggtgcttaggaataatttaaattctcttcactaacaggatgaagtatattattcttgaataatgtagagttattcaaaaaaaaggtcttttagaaattctttttaaattatttgctacctatccatgttttctccaaatctatcagcagcacagagtaaataattcatcaatttatcttgacccttcaaaaatgagtgttgtatgtgtgtgagagacacagcgcgagcgcacatgagcaagagtacaaccacagctaatatttaagtacttattctgttccagataatgtaagaaaggtagggaaattaagtcttgacatgaataagttataataatcatgttaccctagagttttatacagtggccgcctagaggtaagtttgtg

SEQ ID NO: 119888 - DNA, 601 bp, Human
taatctagtacagtttagaagtagggagttacacagaaaaatataataccatgcaaaaattgtaccactgagaagtgcaaataagtaatatgaatgctcagagaatatacattcattatcaaaaaataagtgtgtagccaaaattgtcaggtgttatatgtaagtatatacacagaaggggtagttttagttttaaggttggagaatttcacacttccacaatattttctttaaaattagagatacacatgtatgaaccaaatcactgatgaaattcaaacacaaaggtaaatatatacamcagctttgggtttagaacttaagttaaaatgttaacaaaataagaagtaatgttattttcagacctggtgcttaggaataatttaaattctcttcactaacaggatgaagtatattattcttgaataatgtagagttattcaaaaaaaaggtcttttagaaattctttttaaattatttgctacctatccatgttttctccaaatctatcagcagcacagagtaaataattcatcaatttatcttgacccttcaaaaatgagtgttgtatgtgtgtgagagacacagcgcgagcgcacat

SEQ ID NO: 119889 - DNA, 601 bp, Human
caaaacagatcaaataaacaggtgttattaagggcagtgtgtgactacacaaccaatgaggattgaaaaacatcgttctttatcataacctaaaaaatcacatattcccaggtgatgtatacctaaagtgtcaaattgtatcaattctctcctttttttaaattcatactcccatttttgtctggttggaattgttgcttatgatagctgcggacaatactgagtggaattagacttaggatctgaatgaaatatgggatttgtagttgaggaactgggcttggggtttcctatgaaacaytcagcaaggctttaggttaatagtccaaattgtattgtctttgtagtggttattatgtttgtccttattgttacgagtagggaaggaggagtattgagtcctggaattgccacccactattgctgttgagcctgaaaaaactaactttaatatgcttgattttctcacttataaaatgaagatattaatacaatatccacatcgtagtgttgccccaagaatttaatgtaatcatatgtgaaaagtactctgaatattgtagtattaataataaaagccgtagctattaaaatataacaa

SEQ ID NO: 119890 - DNA, 601 bp, Human
tcgcccaggctgcagtgcagtggcgcaatctcggctcagtgcaacctctgcttcctgttaccaggaaatttaagtggcgtacccagtatcacaaagcattttcatatttccaggtcccattatagaatagataataaatgatcaagttattttgttcattcgctaattcaataagtatttattcaatgcctgcatatccaagaaactgttaaatgaacatacataagtgacagagctggggtcagaacacgggtcttctaatgccctgtccagtgccttgttcactgctctgcaaggtacwctgaaaggtttctatttcagaggaaggggtaaatgcgtggcaatgaagcagaagagttttccaaagtggatgtgtgtataccttctttaaaggaagcacatgaaagaaatttgtttcaaaacactttaccttggaattcactttctagtcctggcattttaactattaatgactctgcaaatgaaatcagacaatttattgtctaggatgtattcatttattcattcatcaaacacgaagatgtatggaccacactctgtgtcaaggcagccatgataccggctctcataaaaatttaag

SEQ ID NO: 119891 - DNA, 601 bp, Human
agtggcactgacctgcaaagtgctaagtctctattagactcaagtgaaaagctgtaagcttctgacaagttcccttgccaccacgcttcctcaccctccatggttttcatgagcttagcttggcaggaaagctgctcaaatggtctggaggagaaatgacaacaaatattttctgcctactactattacaaagtattaaaatcaattttcaccaagactcaaaggaggaagtctcttgggagtcactgctctaatttctaatatggtaagtccttagcaaatatgaaacattttgatttcygctggatctttatgacactgctagccactcatttatataacgagaatcattaacagggatttctgtggactactctttggtaaccatgagtacattgttgagacagtattttcaacaaaactgtttgagtgcaaattttcggccctaaaaagaccacaactaaatatgcaagcagttcagtattgtctttcagatgcccataatcccaagttctgggcccaggaaagtagagttctaattagtcagggtggggtaaagaaatcttatagcttttctaatccaacacttttaaaaagtagg

SEQ ID NO: 119892 - DNA, 601 bp, Human
ccggaatattaatttccagtttataaacagataaagtgataattcaacaaatcaagtgaatttgatacacaggttaagacctagttctagtcactaaagcctatttcaactaaggaaatttttctcatcacaaaaaaagtaaaaccaaaagtagcaactagcatcttcagttgaattagaagttaatgtctcaaaccactatgtttaaatgtgaatatcatctttcatttatgctgcaaagcaaacatctatgcaaggaagggctcgaacacctcaatgcatatcctaaggttgaagaagsctttgaaccaataaatgagtgatttctccacaggagactaaacatttgcttgtgacggtaaacaaaatgctgaattttatgtagcacaatcatttttacatatctgttgatataagtagttaaagaagaattattgaatttttttctgtcaaatgaaaaggtttgcacttgactcagatcttagcaaataatcgtatttaaagaattaaattattccttaaatgtgatgcttcctcttaccccaggaactggattataatattatttgcagtaagtcattcctaaaggaccctgacttaa

SEQ ID NO: 119893 - DNA, 601 bp, Human
cttcatcaaccggaatattaatttccagtttataaacagataaagtgataattcaacaaatcaagtgaatttgatacacaggttaagacctagttctagtcactaaagcctatttcaactaaggaaatttttctcatcacaaaaaaagtaaaaccaaaagtagcaactagcatcttcagttgaattagaagttaatgtctcaaaccactatgtttaaatgtgaatatcatctttcatttatgctgcaaagcaaacatctatgcaaggaagggctcgaacacctcaatgcatatcctaaggytgaagaaggctttgaaccaataaatgagtgatttctccacaggagactaaacatttgcttgtgacggtaaacaaaatgctgaattttatgtagcacaatcatttttacatatctgttgatataagtagttaaagaagaattattgaatttttttctgtcaaatgaaaaggtttgcacttgactcagatcttagcaaataatcgtatttaaagaattaaattattccttaaatgtgatgcttcctcttaccccaggaactggattataatattatttgcagtaagtcattcctaaaggacc

SEQ ID NO: 119894 - DNA, 601 bp, Human
gacaatcccaccatgttttcatggatgttgtatgtgttccaagaatggtaagtgaaaactaagacaaattccatttcattattgcacttagacttgctccctgcacaggcaaagtacttcatcaaccggaatattaatttccagtttataaacagataaagtgataattcaacaaatcaagtgaatttgatacacaggttaagacctagttctagtcactaaagcctatttcaactaaggaaatttttctcatcacaaaaaaagtaaaaccaaaagtagcaactagcatcttcagttgaaytagaagttaatgtctcaaaccactatgtttaaatgtgaatatcatctttcatttatgctgcaaagcaaacatctatgcaaggaagggctcgaacacctcaatgcatatcctaaggttgaagaaggctttgaaccaataaatgagtgatttctccacaggagactaaacatttgcttgtgacggtaaacaaaatgctgaattttatgtagcacaatcatttttacatatctgttgatataagtagttaaagaagaattattgaatttttttctgtcaaatgaaaaggtttgcacttgactc

SEQ ID NO: 119895 - DNA, 601 bp, Human
tctgcctatcttccctaggttcaattagtcttctgtctttctcagaattcagcctgttcatttgcaaatggaagacttcagaaaggctagtgggtgtgagtgtgggtcttgagggggaagggggctgaagtgtttattttcaaagccacgggggtccccatttgaaaaagcacccagcttatctcaatgtttttgtttgtatgattttgaattagaaggttggagcaattcatttaggagattaagctgtttttacaatgggcttagttgccctatttattcaatagtattgctagggttaaaaaaaaaaagtctttctactgtgctcttcattattccagtgtaccagttttaaagaattccttggtttttgcttttaatgccagttaattttacattaaaatgatgtttattaactggtcacagataaaaatcaccaatgatttctctaacagtttagagctgcccgttttagcaaataaaagtataattaaatatgaatttcagaaaaacagtaaataaaatttcagtttaagtatgggaaatcatagggtatactgatactaaaaaactaattcattatttacttaatcttcaaatt

SEQ ID NO: 119896 - DNA, 601 bp, Human
actttttattcattctgattctgaatataagcaatcaattcaaggcaatttatgagtactcttaaaaagctagtcactccttgttctgtctgagtattcgttcacttactctctgttgctactaagaccactttgctaaaccagcagagacagatagggtggggaaagaggtaaagatggtgaaggccatccaacacattaactggtctccccaaatgtctgatcactacccacttctgacactgccatagagacaggctaatgcaggctggttcaaacatggtaaggctacctggcctgkagagggtctgaacagcggtgtgggaaatgtactttgagagaagaaaactcaagagaaatggcttttatgtacccccctgtcttgaaaactgagaatgtaacatgatttctttttgtcttctgtttggaaacaaatgttcctctgcctatcttccctaggttcaattagtcttctgtctttctcagaattcagcctgttcatttgcaaatggaagacttcagaaaggctagtgggtgtgagtgtgggtcttgagggggaagggggctgaagtgtttattttcaaagccacgggggtcccca

SEQ ID NO: 119897 - DNA, 601 bp, Human
ttacggtgacctatgatgcagacctagtgttccatttgactcaggattccatgggttacagcaggatactcccacaacagatctaaaatgtccaattttcccagtctcccttaatcaaatgacaggtatgactaacacctgagctgagtctcatggaggtcttcttggactctattttttaaatgtttaaaatcttaatactctgttaaggtataataataagctgtatgtatctgatgagttttagcatatgtacacccatccccacagtcaagataatgaatatatccattccccaccscaccccacaaatttccttgtttccctttgtaatccctccctcttacccaccctgaccctcacattccaaacaaccactgatctgctttctggcactatagattattttgccttttctagaatttcatatgaatggaatcacatagtaagtacccttttctgttctttcactcagcgtattttacaatttatccatgttgttgaatgtatcttgtggtttggttcttttcactgctgaagagtattccatgttaggaatataccaaatcttctttaaccacagaaatttgatgaaggtgtc

SEQ ID NO: 119898 - DNA, 601 bp, Human
catagaacaacctagaatgggggaggtagagttgaaagatctccattttaatgccagtctgccttttgccacttgtgtaaatcctgagcaagctattaaactctctgagctttgtttcctcctccgtaaaaacagaaataagacctgtctgccttacagagctattgcacaattagtgagataaaatgtgaaatgtgcctgaagtatagctggttaaaatgggagtttctctcttccctaagttcttgaagaaaggtctgctggcttcatttggtttcccccacatcttaacagcacttawaatgcagtaggtgctcaaaggatatagtaaatcatgtttctagaaaaagtagtggggctgggataaggaattaagattggctgtcaacagcatcggattcttctaaaagttgctttaagttgctgtatacatctcaacagttagctggataaagattcaaaacagtgaaacttactagccatacagcctgccttgcttggccacttttgcaacaggaaaacaagagaggacaaactaggcttatcgcacttgtcagcccacagcaaaatggccataactatataggcaggctgccatgga

SEQ ID NO: 119899 - DNA, 601 bp, Human
tagatatctcacggtctccaaggaaggtagtctgacatgtgaatggtgcagatggttgtattcctgtgttaaaacagtaaagatcataaagtttggctttttgaaagccaattaaaagtgactacgctggtttatacaattttacttttcaaaagagagcatcaggatagcaaggtaacaagcaagtctgttcccccaagacaggtgtagagttgcttaatttattcatgcttgatggttgaatgttacaagggtcatatctatgtatgtaaaacaaagtaaagaaaaatcaagaaattcrttaaagattgaggtgattaatcttgtatgtattccttcatcttcctcatagaacaacctagaatgggggaggtagagttgaaagatctccattttaatgccagtctgccttttgccacttgtgtaaatcctgagcaagctattaaactctctgagctttgtttcctcctccgtaaaaacagaaataagacctgtctgccttacagagctattgcacaattagtgagataaaatgtgaaatgtgcctgaagtatagctggttaaaatgggagtttctctcttccctaagttcttgaagaaa

SEQ ID NO: 119900 - DNA, 601 bp, Human
agaacacgtggacacaggatggggaacaccacacacccggacctgtcaggggatggggggctaagtatggtacgtgtatacctatgtaacaaaaatgcatgttctgcacgtgtaccctagaacttaaagtataattaaaaaagaatatggtcactgctgtttggcccacaatttcttcttccacctaagggaattaaaataaaaattcataatggtactttattagagacactccacacatgcatttgaaaaaaatctgttaagtacaatttccttttgtcaatatttcaaagcgtcttakattctgggcaccatggcaggaaatgtcatatattttcttatctcagcaatttcaccttcctagtagaatgcttttaagaactctaataaggacaatactccctgcaacaaaggctttctgccaataagaaatgtcccttcccaaaccacaaaggaatagatatctcacggtctccaaggaaggtagtctgacatgtgaatggtgcagatggttgtattcctgtgttaaaacagtaaagatcataaagtttggctttttgaaagccaattaaaagtgactacgctggtttatacaatttta

SEQ ID NO: 119901 - DNA, 601 bp, Human
ctatgcagccataaaaaaggatgagttcatgtcctttgcagggacatggatgaagctggaaaccatcaatctcagcaaactaacacaagaacagaaaaccaaacaccgcatattctcactcataagcaggaactgaacaatgagaacacgtggacacaggatggggaacaccacacacccggacctgtcaggggatggggggctaagtatggtacgtgtatacctatgtaacaaaaatgcatgttctgcacgtgtaccctagaacttaaagtataattaaaaaagaatatggtcactgctrtttggcccacaatttcttcttccacctaagggaattaaaataaaaattcataatggtactttattagagacactccacacatgcatttgaaaaaaatctgttaagtacaatttccttttgtcaatatttcaaagcgtcttagattctgggcaccatggcaggaaatgtcatatattttcttatctcagcaatttcaccttcctagtagaatgcttttaagaactctaataaggacaatactccctgcaacaaaggctttctgccaataagaaatgtcccttcccaaaccacaaaggaata

SEQ ID NO: 119902 - DNA, 601 bp, Human
agcatatcaaatgccaaagtctttataaaatggtcactgctcaaagggctaatatccagaatctacaaacaacttcaacaaatctacaagaaaaaaacaaacaaccccattaaaaagtgggcaaagcatatgaacagagacttctcgaaagaagacatttatgcagccaacaaacatatgaaaaaatgctcatcattggtcattagagaaatgcaaatcaaagccacagagagatactatctcacaccagttagaacggcaatcattaaaaagtcaggaaacaatagatgctggagaggakgtggagaaacaggagcacttttacactgttggttggagtgtaaattagttcaaccactgtgggagacagtgtgtcgactcctcaaggatctagaactagaaataccgtttcacccagtgatcccattactgggtatatacccaaaggattataaatcatgctactataaagacacacgcacacgtatgtttattgcggcactattcacaatagcaaagacttggaaccaacccaaatgtccatcaatgatagactggataaagaaaatgtgaaacatatacaccatggaatactatgcag

SEQ ID NO: 119903 - DNA, 601 bp, Human
gcaaatccaagtgttagataaataaacttgtcaaaagaagtccaatggcttgaccaaggccacataccccggatttgtggcagaataaagaacgaaccccccatatcctgattcccacctcagtgctttttctaaacttaatttttgctgatgtctatttgaaaagaggacttgatggctgaccagatccgagtgatctttgctgcatctctatcatgatgcttcttttttatttaagttctgggatacatgtatagaatgtgtgcgtttgttacctaggtatacatgtgccatggtggtwtgctgcacctatcaacctgtcatctaggttttaaaccctgtgcacattaggtatttgtcctaatgctctccctctcctgcccccacccaccgacatgccccagtgtgtgatgttcccctccctgtgtccacgggttctcattgttcaactcccatttatgagtgagaacatccagtgtgtggttttctattcctgtatcatgatgcttcttagacactgttcagcacaaggaattctgtttgagtccttttacttcagcacaatcaacacaggtgccagtaaaataatttttcattttct

SEQ ID NO: 119904 - DNA, 601 bp, Human
tgctctaatgaatgagaatctttttctcggtctaaacatagtagaggctcctttggttaggaagagacagattcacagagctgtacagggtcttagatataatctctgcaaatccaagtgttagataaataaacttgtcaaaagaagtccaatggcttgaccaaggccacataccccggatttgtggcagaataaagaacgaaccccccatatcctgattcccacctcagtgctttttctaaacttaatttttgctgatgtctatttgaaaagaggacttgatggctgaccagatccgagygatctttgctgcatctctatcatgatgcttcttttttatttaagttctgggatacatgtatagaatgtgtgcgtttgttacctaggtatacatgtgccatggtggtttgctgcacctatcaacctgtcatctaggttttaaaccctgtgcacattaggtatttgtcctaatgctctccctctcctgcccccacccaccgacatgccccagtgtgtgatgttcccctccctgtgtccacgggttctcattgttcaactcccatttatgagtgagaacatccagtgtgtggttttctattcc

SEQ ID NO: 119905 - DNA, 601 bp, Human
cctccctgccaaaaaacggtttttgtttcctgttgtgaaattattcagtacaccaagatcatactttaacagccaagtcctattaaagcactattttaaaatgctctaatgaatgagaatctttttctcggtctaaacatagtagaggctcctttggttaggaagagacagattcacagagctgtacagggtcttagatataatctctgcaaatccaagtgttagataaataaacttgtcaaaagaagtccaatggcttgaccaaggccacataccccggatttgtggcagaataaagaaygaaccccccatatcctgattcccacctcagtgctttttctaaacttaatttttgctgatgtctatttgaaaagaggacttgatggctgaccagatccgagtgatctttgctgcatctctatcatgatgcttcttttttatttaagttctgggatacatgtatagaatgtgtgcgtttgttacctaggtatacatgtgccatggtggtttgctgcacctatcaacctgtcatctaggttttaaaccctgtgcacattaggtatttgtcctaatgctctccctctcctgcccccacccaccg

SEQ ID NO: 119906 - DNA, 601 bp, Human
ccatttgaataacagaatctccatgactgctgcagagtatgccctctgtgttctcaaatgtgactgccttcttttccaattatgtctaatattttaacacacaatgaatatactacaaagacatcatttgaaacggtgagattcaggtggaaaagagtcctacaacagacatttttaaacctatgccaagtcatcaccaagaacagctggaaaccctccctccctgccaaaaaacggtttttgtttcctgttgtgaaattattcagtacaccaagatcatactttaacagccaagtcctaytaaagcactattttaaaatgctctaatgaatgagaatctttttctcggtctaaacatagtagaggctcctttggttaggaagagacagattcacagagctgtacagggtcttagatataatctctgcaaatccaagtgttagataaataaacttgtcaaaagaagtccaatggcttgaccaaggccacataccccggatttgtggcagaataaagaacgaaccccccatatcctgattcccacctcagtgctttttctaaacttaatttttgctgatgtctatttgaaaagaggacttga

SEQ ID NO: 119907 - DNA, 601 bp, Human
tacatctgggttagtggatatagaacacatgtggccaccagtgggcgctcaataagaaagtgtatcagaagttctgtgataacataggtttgatttgttccttctctaaagagtgtatgttaacatttcatagccatttgaataacagaatctccatgactgctgcagagtatgccctctgtgttctcaaatgtgactgccttcttttccaattatgtctaatattttaacacacaatgaatatactacaaagacatcatttgaaacggtgagattcaggtggaaaagagtcctacaacaracatttttaaacctatgccaagtcatcaccaagaacagctggaaaccctccctccctgccaaaaaacggtttttgtttcctgttgtgaaattattcagtacaccaagatcatactttaacagccaagtcctattaaagcactattttaaaatgctctaatgaatgagaatctttttctcggtctaaacatagtagaggctcctttggttaggaagagacagattcacagagctgtacagggtcttagatataatctctgcaaatccaagtgttagataaataaacttgtcaaaagaagtc

SEQ ID NO: 119908 - DNA, 601 bp, Human
gccactggtatcctgctaaagcccttgcaaatgaaggtggttcacaaggaactgcttttctctggggcactggatcataacactggagttctcctgagtgacttgaagtctgaaaggccaaattgaattgcagtcttctcacctggccactatcaatgatgtcattttatagtttgttatttaaactgactgtgcattaggggcttatttataaggggatacccttataaaagtcttattttcttctacagcacaggaggaggaggaaaaggaagaggtgaagttgcttgtgttttagtcytggtttcatgctaagtatgtggcaagtcactcagcttctctagccctcaatttctttgtctatgagggtaccagacctggtgactgaaggaaggctaaccatggcacttatgatacaaatcttgtttccaggctcttgacaaacattaataatgaatcatgacactttccagctagacttttctgaatacttttcaatacggcacttcagaaagctactatcaatctaatggaagatgtcatttgttattaaatctattgccatcccttacaacccttgagttctaatattctgtacatc

SEQ ID NO: 119909 - DNA, 601 bp, Human
ccaacatctacataaggaacagtaaaatagtagatgcccaataaatgtttcctaagtattgatattacataagaagcaagtatgaattaaaaacgtacattgtttcttccagctaaaagcaaaacaatgtatgttttggattccaggagtcaagtttcttgaaatcctagaatcactttcatctcatgtcccagaaaagctgtctctcaatctacagtgaataccatctcatttatattgtaggcttcctacatttttcttgtctgaattgaagttaagacaaatagttttcatccagaayatgattctagataaagacactgtggtcaccaagactatggacgtatttactaaaataccagtgccactggtatcctgctaaagcccttgcaaatgaaggtggttcacaaggaactgcttttctctggggcactggatcataacactggagttctcctgagtgacttgaagtctgaaaggccaaattgaattgcagtcttctcacctggccactatcaatgatgtcattttatagtttgttatttaaactgactgtgcattaggggcttatttataaggggatacccttataaaagtctta

SEQ ID NO: 119910 - DNA, 601 bp, Human
tatacctacctatcatactgtcctgtaatactttacctaaaccctccactgtattgcttgctccttaagaacaaatactatgccactacgtcatctttacttttgtataaccaacatctacataaggaacagtaaaatagtagatgcccaataaatgtttcctaagtattgatattacataagaagcaagtatgaattaaaaacgtacattgtttcttccagctaaaagcaaaacaatgtatgttttggattccaggagtcaagtttcttgaaatcctagaatcactttcatctcatgtcycagaaaagctgtctctcaatctacagtgaataccatctcatttatattgtaggcttcctacatttttcttgtctgaattgaagttaagacaaatagttttcatccagaacatgattctagataaagacactgtggtcaccaagactatggacgtatttactaaaataccagtgccactggtatcctgctaaagcccttgcaaatgaaggtggttcacaaggaactgcttttctctggggcactggatcataacactggagttctcctgagtgacttgaagtctgaaaggccaaattgaat

SEQ ID NO: 119911 - DNA, 601 bp, Human
tacctaggatcaagtttagtttgtaaataggaacagtaagagattaacaactagtaatgaagtgaactccaacaccatatcgtagtaagttatgtaaacgtgatgtctctcaaaatatcttaccatactgtactcacctgactgtggaaagcaaaaccatgaatggggtggagggactactgtattaggatttgaacatatgatttttggcgagacacaaacattcagactgtagaagtcccaaccccctctcaaatcctatattaaaactaccaatttctaaacatgacatgaacttttrtgagtcaggatatttgaacatactgtttcctgccttctttaattgacaggacagtaaaatcttagtcatctttcaaaactgagttcatatacgacctcttgataaagccttcctaaatcccttcatacagagctaactgcaggtcctctgacatatacctacctatcatactgtcctgtaatactttacctaaaccctccactgtattgcttgctccttaagaacaaatactatgccactacgtcatctttacttttgtataaccaacatctacataaggaacagtaaaatagtagatgc

SEQ ID NO: 119912 - DNA, 601 bp, Human
tgggggatatgttccaaaactcccagtggatgcctgaaaccgcagacagtaacaaactactggtatagtaatacatactatgtttttctcctatacatacatacctaggatcaagtttagtttgtaaataggaacagtaagagattaacaactagtaatgaagtgaactccaacaccatatcgtagtaagttatgtaaacgtgatgtctctcaaaatatcttaccatactgtactcacctgactgtggaaagcaaaaccatgaatggggtggagggactactgtattaggatttgaacatwtgatttttggcgagacacaaacattcagactgtagaagtcccaaccccctctcaaatcctatattaaaactaccaatttctaaacatgacatgaacttttgtgagtcaggatatttgaacatactgtttcctgccttctttaattgacaggacagtaaaatcttagtcatctttcaaaactgagttcatatacgacctcttgataaagccttcctaaatcccttcatacagagctaactgcaggtcctctgacatatacctacctatcatactgtcctgtaatactttacctaaaccctc

SEQ ID NO: 119913 - DNA, 601 bp, Human
cctcttttacaaggacactaatcccactcatgagggctctgccctcatgacctaatcaattcccaaagttctcatctcctaatactatcacctttgtataggagtcctcctttatccatgggggatatgttccaaaactcccagtggatgcctgaaaccgcagacagtaacaaactactggtatagtaatacatactatgtttttctcctatacatacatacctaggatcaagtttagtttgtaaataggaacagtaagagattaacaactagtaatgaagtgaactccaacaccatatcrtagtaagttatgtaaacgtgatgtctctcaaaatatcttaccatactgtactcacctgactgtggaaagcaaaaccatgaatggggtggagggactactgtattaggatttgaacatatgatttttggcgagacacaaacattcagactgtagaagtcccaaccccctctcaaatcctatattaaaactaccaatttctaaacatgacatgaacttttgtgagtcaggatatttgaacatactgtttcctgccttctttaattgacaggacagtaaaatcttagtcatctttcaaaactg

SEQ ID NO: 119914 - DNA, 601 bp, Human
tagctctctcaggcctcttttacaaggacactaatcccactcatgagggctctgccctcatgacctaatcaattcccaaagttctcatctcctaatactatcacctttgtataggagtcctcctttatccatgggggatatgttccaaaactcccagtggatgcctgaaaccgcagacagtaacaaactactggtatagtaatacatactatgtttttctcctatacatacatacctaggatcaagtttagtttgtaaataggaacagtaagagattaacaactagtaatgaagtgaactscaacaccatatcgtagtaagttatgtaaacgtgatgtctctcaaaatatcttaccatactgtactcacctgactgtggaaagcaaaaccatgaatggggtggagggactactgtattaggatttgaacatatgatttttggcgagacacaaacattcagactgtagaagtcccaaccccctctcaaatcctatattaaaactaccaatttctaaacatgacatgaacttttgtgagtcaggatatttgaacatactgtttcctgccttctttaattgacaggacagtaaaatcttagtca

SEQ ID NO: 119915 - DNA, 601 bp, Human
cttacaaacaacagaaacttatttctcatagtcctggaagccgggaatttctagatcaaggcactggcagattcagtgtctggtgagggcccactttttggttcatagatggtgcattcttgccatttcctcacatggtagaatggacaagctagctctctcaggcctcttttacaaggacactaatcccactcatgagggctctgccctcatgacctaatcaattcccaaagttctcatctcctaatactatcacctttgtataggagtcctcctttatccatgggggatatgttccaaractcccagtggatgcctgaaaccgcagacagtaacaaactactggtatagtaatacatactatgtttttctcctatacatacatacctaggatcaagtttagtttgtaaataggaacagtaagagattaacaactagtaatgaagtgaactccaacaccatatcgtagtaagttatgtaaacgtgatgtctctcaaaatatcttaccatactgtactcacctgactgtggaaagcaaaaccatgaatggggtggagggactactgtattaggatttgaacatatgatttttggcgagaca

SEQ ID NO: 119916 - DNA, 601 bp, Human
agataatatattttatattctaattgtataaaatatcagagaggcaatttgtgtgtcttaaagaattccagccaaagcaaccacacctgcctgacagaagccaacagaacacctctctgcatattctgacgaagtggccttcatcaaagaaagcactggctctctgaatccacagctgaagaggcagaattgtttgataagtacattctttctcaagagctgtgctaatagaacacgtttactcaggtccaactataccatgaatcataaaacaacctgcagacagataatctagggagcrgaatttcctctaacccaaagtacatggataacacacattcagtaagtaattcagatacaacgaacgttatgaggggcccactatgtactgtgaactttcaccatttcatttcatctagataacaaatctacgatgtaggcattatttcctgtctaaaggaataagctaaagtttatgatgtaaatccaagttcacaccacaaataattgacagggcaaaaaacttgaacctttcctctcaacatctatggctgttccccgtctcctctgctaagatgtaactttaaattaaagatctata

SEQ ID NO: 119917 - DNA, 601 bp, Human
ttcacaagcacttattgaatacctactatgaatatgctccaaagataatatattttatattctaattgtataaaatatcagagaggcaatttgtgtgtcttaaagaattccagccaaagcaaccacacctgcctgacagaagccaacagaacacctctctgcatattctgacgaagtggccttcatcaaagaaagcactggctctctgaatccacagctgaagaggcagaattgtttgataagtacattctttctcaagagctgtgctaatagaacacgtttactcaggtccaactatacsatgaatcataaaacaacctgcagacagataatctagggagcggaatttcctctaacccaaagtacatggataacacacattcagtaagtaattcagatacaacgaacgttatgaggggcccactatgtactgtgaactttcaccatttcatttcatctagataacaaatctacgatgtaggcattatttcctgtctaaaggaataagctaaagtttatgatgtaaatccaagttcacaccacaaataattgacagggcaaaaaacttgaacctttcctctcaacatctatggctgttccc

SEQ ID NO: 119918 - DNA, 601 bp, Human
atgtgatattcacattcttgtgcatcataattctatttgcagacctagattatgcttttggttttggtcaatttctgcatttagctagtatcccacataattcagaagaaattgtactgtctggaagtgtgcaattccttgggtagcatcatccctatatgtgtacttaagccaaaaggttctaagaagccatgcaaattaaagcagaaataaagataagaggtccctggcaaccagcagtctttgatccacctagacaatgtataaaaaggactttgatatcagttgaactcaaaaagayacactttgtgttttttttagtaacacacatcgtaatctatctcccttgagattaatgtgtctctgtccaagtttgctaacatctgttaaactcagttttcccccgtggggccttccccttctttttttctctatcttcctgcctcttgaaatctacatctctgaaatcatgggatatgtctcttaagctatgggtttccctggtctcttcctactaacaccctcttcccctccctccctacttccttcccttcctttcttatctctttcaacagtatttactcagtgtcttctctattct

SEQ ID NO: 119919 - DNA, 601 bp, Human
aagaagaaagaaatggacatttagcttttctccccttctaccaaaagctcaaatgatgaaggtgccccttggattcttaacaacagcctctaccacagcactgtcctcaaagtaagtagaatatgtatttaagcagcaaggcccccaaatcacaaagaatgagagtaaataaatcagaaaactcatataggtagtagacagagtcatagaaagaagacctcagaaaagagaaaaaaagaattatgagaaaagagaaagaatttttaaggtatgttataaattaaccacacatttaggaagsacagttaaaaaatggagtgaaaaatactgtagaggaaacaggaagaagagacttttaaaagccaaggaaaataaatactgacagggctaagagaaagaagtggaactcatctcccatgaaacttcaaaatttaggcattcaatacttaaactattcaatgttgaataactagctttattttttttcatcatgaaagtattgttagaaaaaccattaaagcaagaccagcctgaaaacatggacagcccatgacatgaagaaataaatgtgatattcacattcttgtgcatcataattcta

SEQ ID NO: 119920 - DNA, 601 bp, Human
aatgcttcaatgacaagattactctaaggtaagttaaataacgtaagacactgtgatttagtgccaagatggatagtatagataagcagtgaaggagtttgcttcagagaaaagagaaatctgtgtggctgacatgttagaataacactttggggaaataagaaataattaggaagtatgacctggagtagggaatggggaagtacaagaaagaaactctatcctcagtagaattattcagccggcctgatcagcccttctttaactttagctcctctcagaagattatctgataccccgrtttaagaagtgtaacaaagaagaaagaaatggacatttagcttttctccccttctaccaaaagctcaaatgatgaaggtgccccttggattcttaacaacagcctctaccacagcactgtcctcaaagtaagtagaatatgtatttaagcagcaaggcccccaaatcacaaagaatgagagtaaataaatcagaaaactcatataggtagtagacagagtcatagaaagaagacctcagaaaagagaaaaaaagaattatgagaaaagagaaagaatttttaaggtatgttataaattaa

SEQ ID NO: 119921 - DNA, 601 bp, Human
tcttgctgaatgctttgtgagagcttgagaaaaatgtgcattttgctgatgctggacatagatttattttactagtcccagaactggtattggcattcacctctagagtaaacccagcttttgcattttcctttagctccctatcaatttccagatcactgttcttttaattaatcaatacattaaaaaataatgtatgcaaggatagctcttactacttctatttaatagtgtaataacatttgctattataatatgaaataaataggaggccaaagttttaaaataaaagaagtaatastatatttttagatgacattattgtctatgtagaaattccttaaaaaatctacaaaaattgctagaagtacaaatttagcacaaagtcccaggatacaagatcaatatataatcaatacactatcaacaaatcactggaaaataaaatttaattatgcacacacatatacacacaaacacatattcatgttcatacacatatttatccaagatctagatgcataatgacagaaagacactgggcagcaacttttggcagcaactattaaccttttaaaatacataaatttaaaaaataata

SEQ ID NO: 119922 - DNA, 601 bp, Human
tatacattggtggactcaatttgctaatattttgttgtggatttttgcatctatgttcatgagaggtaatagtttgtagtattccattctcgtaatctctttatctggttttgatattagggtaacgatggcctcataaaatgagttagtgctccctctgcttcaactttctggaagagactgtagataattggtatgtttgtttggtagaagtcaccagtgaaaccatctggacttagtgctttcttttttgaaaggttattaattattgattcaatttcttgaacagatacaggcctaktcatacatatttctctttgagttttggtagaatgcatctttcaatgaattggcccatttcacctaaattatcaaatttgtgggcaaagagttgtgtataatatttctgtattattcttctactgtccgtggcagtagtagcaatagtccctctttcatttctgatattagtaatttgtgtcttctctttttcttttagttagccaggctacatgtttagcaattttattaatttttttcaaagaaccagtctacagttttattgtctttattgttttcattttcaatttaatcgatctgt

SEQ ID NO: 119923 - DNA, 601 bp, Human
taatcccgtcagttctagatgtttttttcttttttggagggggattgattcttaaggattttctacatagaaaattatgttatctgtgaaaaaagacatttttccttcccagtctgtatacattttcttttcttactgcattaactagaacttctagtataatcttgaatagcagcagcaagagggggtagcctgtcttgatcccagtcatagtgggaaagcatctagtttctcaccattaaatattatgttagctataggttttatgtagatgtttttcatcaggttgaggagattctcstctattcataatttttgagagtcttccttctttatatgatgaatgggtgctgaattttgtcaaatactctttctgcatgtacagacatgatctcctgattttttctttgtcagcccattgataagacagactacattaattgaattttgaatgccaaatcagccttgtatgcctgaaataaatcctgcttggttatggtgtataattctttttatacattggtggactcaatttgctaatattttgttgtggatttttgcatctatgttcatgagaggtaatagtttgtagtattccatt

SEQ ID NO: 119924 - DNA, 601 bp, Human
tttaaaattaatcaatatcttaaacctcccccaaaacaatacaatgaccttacaacactaaatctaatcactcttctccagaagtttgtcataaattattttataccaaaaaaatgatttctcaattaactcaatattaaattgtgagttaatttttgtggaagttgtaagttcagtgttaggactctttttttttttttttttacatgtgaatatctagtttttccagcatgatttgttgaaaagacaatcctttctccactatgtgcttttgctcctttatcagggatcagttgactayatttgtgtgaatgtatttcttggttctcttctctatttcacttatttttctgtattttttttttgccagtaccatactatcttaattactgtagctttacagtaactcttcaaattggatagtatcagtcctcctcttttgttcttttccttcaatattgtgttggctattctaggtcttttgcctttccatataaactttataattagtttgttaatatctacaaaataacttactaggattttgattgggattgcattgaatctacatattaacttgggaagaaatgacatcttaata

SEQ ID NO: 119925 - DNA, 601 bp, Human
tttttttgtttattcatggtattttatcatgcatatttaacaacttcacctttaaaattaatcaatatcttaaacctcccccaaaacaatacaatgaccttacaacactaaatctaatcactcttctccagaagtttgtcataaattattttataccaaaaaaatgatttctcaattaactcaatattaaattgtgagttaatttttgtggaagttgtaagttcagtgttaggactctttttttttttttttttacatgtgaatatctagtttttccagcatgatttgttgaaaagacaaycctttctccactatgtgcttttgctcctttatcagggatcagttgactacatttgtgtgaatgtatttcttggttctcttctctatttcacttatttttctgtattttttttttgccagtaccatactatcttaattactgtagctttacagtaactcttcaaattggatagtatcagtcctcctcttttgttcttttccttcaatattgtgttggctattctaggtcttttgcctttccatataaactttataattagtttgttaatatctacaaaataacttactaggattttgattg

SEQ ID NO: 119926 - DNA, 601 bp, Human
ttattgttgctcattttataatgcagttactgccttctattggtttggaagttgcacactgtatttttttgtttattcatggtattttatcatgcatatttaacaacttcacctttaaaattaatcaatatcttaaacctcccccaaaacaatacaatgaccttacaacactaaatctaatcactcttctccagaagtttgtcataaattattttataccaaaaaaatgatttctcaattaactcaatattaaattgtgagttaatttttgtggaagttgtaagttcagtgttaggactctttttttttttttttttacatgtgaatatctagtttttccagcatgatttgttgaaaagacaatcctttctccactatgtgcttttgctcctttatcagggatcagttgactacatttgtgtgaatgtatttcttggttctcttctctatttcacttatttttctgtattttttttttgccagtaccatactatcttaattactgtagctttacagtaactcttcaaattggatagtatcagtcctcctcttttgttcttttccttcaatattgtgttggctattctaggtcttttgcctt

SEQ ID NO: 119927 - DNA, 601 bp, Human
aggtgagtgggggtgaagggagaggatgaagagaggtaggttaaaggatacctatagtaagatagaaggaataaattcattgtttgatagtagcttcggatgactatacttaacaaaaatgtactgtacttaagtgatggacacctttaatatccagacttgattaccacattatattcatgtaacacaacatctcatttacccccataaatatgtgcaaataaaaaatgcatttgtatgtattgggattatatttagtgttatatattctgttatatcaggacttgatgctttctatttsacatgctttattttaccttctattttctcctttcttgcctcttagttctagttgattaaagtatgttgttattgttgctcattttataatgcagttactgccttctattggtttggaagttgcacactgtatttttttgtttattcatggtattttatcatgcatatttaacaacttcacctttaaaattaatcaatatcttaaacctcccccaaaacaatacaatgaccttacaacactaaatctaatcactcttctccagaagtttgtcataaattattttataccaaaaaaatgatt

SEQ ID NO: 119928 - DNA, 601 bp, Human
aacttaaagtataattttaaaaaagacaaaaataacaaatgccagcaaggatgtggagaaaaggaaagtcttgtatatggctggtgggaatgtaaactaatacaaccactatggaaaacagtgtatgtggatttctcaaaaaactgaaaatagaactaccatttgatcaagcaatcccactattggttatctatccaaagcaaaagaaatcaatatatcaaagggatacctgcactagcatatttattgtagcactattcacaatagcaaagatacagaatcaaccaaagtgcccctcaacacacacacacacacacacacacacgtgcgtacccaacggaatattatttagccatagaaaagaaatgaatcatgtcatttgcagcaacgtagatgggactggaagtcattacaagtaaaataagccaggcataagaagacaaatattgcatgttctcatatgtgggatctaaaaaatatgaacacatagcggtaatgtaaaatagatcagagacactgggacaggtgagtgggggtgaagggagaggatgaagagaggtaggttaaaggatacctatagtaagatagaaggaataaattc

SEQ ID NO: 119929 - DNA, 601 bp, Human
catatacaccatggaatactatgcagccataaaaaatgatgagttcatgtcctttgtagggacatggatgaagctggaaaccatcattctcagcaaactattgcaaggacgaaaaaccaaacaccacatgttctcactcataggtgggaattgaacaatgagaacacatggacacaggaaggggaacatcacacaccggggcctggtgtggggtgggggaagggggtagggatagcattaggagatatacctaatgttaaatgagtagttaatgggtgcagcacaccaacatggcacatgyatacatatgtaacaaacctgcacgttgtgcacatgtaccctaaaacttaaagtataattttaaaaaagacaaaaataacaaatgccagcaaggatgtggagaaaaggaaagtcttgtatatggctggtgggaatgtaaactaatacaaccactatggaaaacagtgtatgtggatttctcaaaaaactgaaaatagaactaccatttgatcaagcaatcccactattggttatctatccaaagcaaaagaaatcaatatatcaaagggatacctgcactagcatatttattgtagcacta

SEQ ID NO: 119930 - DNA, 601 bp, Human
ccaacaatgatagactggattaagaaaatgtggcacatatacaccatggaatactatgcagccataaaaaatgatgagttcatgtcctttgtagggacatggatgaagctggaaaccatcattctcagcaaactattgcaaggacgaaaaaccaaacaccacatgttctcactcataggtgggaattgaacaatgagaacacatggacacaggaaggggaacatcacacaccggggcctggtgtggggtgggggaagggggtagggatagcattaggagatatacctaatgttaaatgagkagttaatgggtgcagcacaccaacatggcacatgtatacatatgtaacaaacctgcacgttgtgcacatgtaccctaaaacttaaagtataattttaaaaaagacaaaaataacaaatgccagcaaggatgtggagaaaaggaaagtcttgtatatggctggtgggaatgtaaactaatacaaccactatggaaaacagtgtatgtggatttctcaaaaaactgaaaatagaactaccatttgatcaagcaatcccactattggttatctatccaaagcaaaagaaatcaatatatcaaa

SEQ ID NO: 119931 - DNA, 601 bp, Human
caaggatggttcaacatacacaaatcagcaaacatgatacactgaaaatctacagaatgaaggaccaaaaccatataatcatctcaatagatgcagaaaaagcatttgataaaatcaacatcccactcctatcggtatgcttccaagatggccaaatagtaagagctctggtctgcagctcccagcaaggtgaacacagaagacaggtgatttctgcatttccaactaaggtacccggttcatttcactgggactggttcgacagtgggtgcagcccacagagggtgagccaacgcagggygggacatcacctcacccaggaagcacaaggggtcaggggatttccctttcctagccaagggaagccatgacagattgtacgtggaggaacagtacactcttgcccaaatactgtgctattcccacagtcttagcaagcagcagaccaacgtattccctcccatgccaggttcggcgggtcccatgcccacggagccttgctcactgctagtgcagcagtctgagattgacctccaaggctgcagcctggtcggaggaggggtgtctgccattgctgaggcttgagtagcaggtaaacaaa

SEQ ID NO: 119932 - DNA, 601 bp, Human
agataacacactatgataaagtaggatttttaccaggaatgcaaggatggttcaacatacacaaatcagcaaacatgatacactgaaaatctacagaatgaaggaccaaaaccatataatcatctcaatagatgcagaaaaagcatttgataaaatcaacatcccactcctatcggtatgcttccaagatggccaaatagtaagagctctggtctgcagctcccagcaaggtgaacacagaagacaggtgatttctgcatttccaactaaggtacccggttcatttcactgggactggttygacagtgggtgcagcccacagagggtgagccaacgcagggtgggacatcacctcacccaggaagcacaaggggtcaggggatttccctttcctagccaagggaagccatgacagattgtacgtggaggaacagtacactcttgcccaaatactgtgctattcccacagtcttagcaagcagcagaccaacgtattccctcccatgccaggttcggcgggtcccatgcccacggagccttgctcactgctagtgcagcagtctgagattgacctccaaggctgcagcctggtcggaggagg

SEQ ID NO: 119933 - DNA, 601 bp, Human
cagacaaggatacaacaacaaaataagaaaactacaagccaatatccctgatgaaatagacacaaaaatcttcaacaaaatactaacaaacctaaatcaacagcacattgaaaagataacacactatgataaagtaggatttttaccaggaatgcaaggatggttcaacatacacaaatcagcaaacatgatacactgaaaatctacagaatgaaggaccaaaaccatataatcatctcaatagatgcagaaaaagcatttgataaaatcaacatcccactcctatcggtatgcttccaakatggccaaatagtaagagctctggtctgcagctcccagcaaggtgaacacagaagacaggtgatttctgcatttccaactaaggtacccggttcatttcactgggactggttcgacagtgggtgcagcccacagagggtgagccaacgcagggtgggacatcacctcacccaggaagcacaaggggtcaggggatttccctttcctagccaagggaagccatgacagattgtacgtggaggaacagtacactcttgcccaaatactgtgctattcccacagtcttagcaagcagcagacc

SEQ ID NO: 119934 - DNA, 601 bp, Human
tttttttaagacagagccttgatctgtcacccaggctagagtgcagtggcactcaatctcagctcaatgcaacctctgccgcccggggttcaagtgattctgctgcctcagcctcccgagtagcagggattacaggcacccaccaccatgcccagctaatttttgtatttttagtagagacggggtttcaccttgttggccaggctggtcatgaacccctgacctcaggtgatctgcctgcctcccaaagtgctgggattacaggcgtgagccactgcacccggccccaagttcagttttyaggtttctctgtgcagcagttttaattatttgtaaagactgatatttcatgacttttgtttcttacaggttttccaaaaatcaaaaggaaaaaatacttatttttagtaagttaaactcattttcttcatcacttagtctattgatcattttataaatctaagatgcattataggatctaagatacattatgatattttagtgatcttatatttcctgtattttaaagtattttgctacttcatcatgctagaaattacttcatcatcactcatcaattatttctaattgtgctaaaaaa

SEQ ID NO: 119935 - DNA, 601 bp, Human
ctataactttcttttcccaaaggatttttaagataaaggaaaataccttaaatttgtagagcacttaacacagctgtattgatacaaacaaaatgaccttgtaattgtacattttacagtttataatacacagttcataaacacatgtaacaaaatttacccaataaatactcagataacttctagtcacaggaaaaataaagatggttaagagagttccagccctccagagtctgacagtctctagtagtttatttagtacttacaataaccccgtgaagcagggttttctctctattamacatgagaaaattgagaggcagggagcttgagtccaaagaagcaggttcttgttgtggctgactcaacaatgtgttctttccaatacacataatttccaggattagtcagcccaaagaaacagaactagttaatgtccaagcctgagctagttagaattcttaaattattggtctggttctcttttcattcactctatttaataaatttgctcacagctgatagctcattacattttcatgctcctttgaacacagtataaagtccaggtaacaaaaggagaaaattaaaaagttagttt

SEQ ID NO: 119936 - DNA, 601 bp, Human
taacagaatgggatctgtgacacaggtgataagcagccagtcaacggccaagtgttacggaactactatggtaataacacttgttgtataataaaagtatacaatttgaagtgttttaagagacccttctagactcaacgccaatttaggaatttcctctatatttttgctttaacatcatccaaaggctaactacagttcttacctttcatgaacctgtcaactaactaaagatacaaataaggatagagtgtctcacatacatacaatcatacactgatgctaaggcaagagttatcgrtagcccaagctctggctagtatccatgagggttaaatagcagatcaaacttacagtcatcaagccttagatcctactttctctgccacaggcctaagtgacttctcaaggaaacttgaatggtgctgcaataagcattcacctaatttatactcaggtcctgaacaatgactctaaccaaactaactagttagttcaacaagttatatgtgtaaatccaagttagatttatttccctttgctgaataggctatcttgcagagccaaaaaagatggggatggggagttagcaagtggggtg

SEQ ID NO: 119937 - DNA, 601 bp, Human
ccatccactgtcatgaaaaaagtgaagcatgagcatgtagtggtgtactgagagcatatgtttgctgctctgctgtttgaaggcagttatttcataggaaatcttttatctacaaaagacataccttgtctgcttcttgaacttcacacacctgttctcctgtggctggattatagacagggaacactctcccactctctgagttctgccactcgttgtttataaagatctaagggagtagataacagaatgggatctgtgacacaggtgataagcagccagtcaacggccaagtgttacrgaactactatggtaataacacttgttgtataataaaagtatacaatttgaagtgttttaagagacccttctagactcaacgccaatttaggaatttcctctatatttttgctttaacatcatccaaaggctaactacagttcttacctttcatgaacctgtcaactaactaaagatacaaataaggatagagtgtctcacatacatacaatcatacactgatgctaaggcaagagttatcgatagcccaagctctggctagtatccatgagggttaaatagcagatcaaacttacagtca

SEQ ID NO: 119938 - DNA, 601 bp, Human
cctaaatattcattgataccaggtggagatcccaaatgtatagtgcatacattcctaaatgctttcagtttccaaaaagtttatattctctaagaaattgacttttattttaaaaacagcaacaacaacaaaacccattagggcaggagaagttcgttatgtgaggaaaatcattgttttagtgaaaggaagttgctatctcctgctgtctctcctttctactggctcacagaatgacagggcaaacggagcagaagtgtatgagaggtccgtaccatcccctctggttctgaaggattcyttttactcaagagaggttaactctggggaggtaaaaacttgttctatttcattctcataagaatcatttgatactcgttttctgcaagcagcatggtgactctcttgttgcttgactgtttttaatttgtcatggggagggggagttttagaaaagaaggtacttaccagtcatggcaagctccagttttctcttcaaaattcagtgagaaaagatattcagctgatcctccatttctccttctccatctgatccccaaatccaaacatgtctcatttttcatatgtattacctattcct

SEQ ID NO: 119939 - DNA, 601 bp, Human
agaacatgtatatgtttacaagataggcattacattctctatacagctagcatagcaccgaaatctgcacagcttagagtgaatagtgtcaataaccagaatttgggctgcctaaatggtccctgtgagctgccgacaccagtcaaatccactgacaattgccagctctaggactattttcaattgtgtttactttggatgcaggattagcttcagttttccagtcaggagctcccctttcttccacaggctacctcttactaaaactcacttttctcatagcttgagagtgtttaaaacrggaatctcatttaggtgtggtaggaaaagagacctgatcagtgagacacagagaagaaaaagaaaggcatttgagttttattatatgaaaatataactggagaaattaattaatcatcttctagcacagtgttaatccaatgctatagatatcatatatctttagctcaattaaacagtcatttattgacaacctatgtgccctcatttgccatttatgtgctaagaaccatgctaggattaccaaaaaaaggtaaaatacaagtttaattctcaagaaaatgataatccagtgaaaaga

SEQ ID NO: 119940 - DNA, 601 bp, Human
catgaattttatcagcccagcctgcgtaatatcgaaaggttttgatgacgccctgcaaatccacataaaaagcttgcaggaatggtttgccaccatttagggattccatggtctgttggaagagaaatggagagatactaagtccccagaactttccagcgatacactaatttctagagcagaagaaaaaaggaagagagagaatacaaatgcatatggagttgcatacctggtcaactatgaattctcaaataaaaagatttctagtactgtcagtttggtctagttcctagtaaaaacyacaatgagtatatatgtgcatattcctgtgcttccagtaaccactatccaaatacgttaacacaatatttctttaactaatgataaagaaatgttctgcttgtcaaaacagcttccgttatattaatgatcagagctcactggggattttttggcatctacaccagtaatctgaatccataaagaggagcagaaacatgggctctttatgcaactgatgagaatagaaagtgttctccacagctgccaagacccctgctgagaaatggaatatccatggtgcacagcaagtttatttatt

SEQ ID NO: 119941 - DNA, 601 bp, Human
tttcacatacctacaggaatggtcatcccatgaattttatcagcccagcctgcgtaatatcgaaaggttttgatgacgccctgcaaatccacataaaaagcttgcaggaatggtttgccaccatttagggattccatggtctgttggaagagaaatggagagatactaagtccccagaactttccagcgatacactaatttctagagcagaagaaaaaaggaagagagagaatacaaatgcatatggagttgcatacctggtcaactatgaattctcaaataaaaagatttctagtactgycagtttggtctagttcctagtaaaaaccacaatgagtatatatgtgcatattcctgtgcttccagtaaccactatccaaatacgttaacacaatatttctttaactaatgataaagaaatgttctgcttgtcaaaacagcttccgttatattaatgatcagagctcactggggattttttggcatctacaccagtaatctgaatccataaagaggagcagaaacatgggctctttatgcaactgatgagaatagaaagtgttctccacagctgccaagacccctgctgagaaatggaata

SEQ ID NO: 119942 - DNA, 601 bp, Human
gttgattctgtcatgtaacctgaatcttaataataaaaaggggttaggattagtgttgtttgtatagattatgaaagtaattcacggccgttcgagaaatatagaaagtagagaaaaatattaaaaagacactgaaaatcagccataatctcaccactcagagacaactgttaacacttagaatatttccttccaaagagtagatcttatgtgtttcaggagggcaaggagcaagtcttaacctcgttggaattttccatgacttccctccacccaataatgccccttcatacctaccccrgcacctaatctagcacaatgctgaccacttaccagctgacaaatacatacctcttccttagatgaatgatgtattaagtggcatgcccctgtacttatatatttctatctatagaaaaagggatgttgtcagagtcagtgacataatttggttggttcttcactcagttctaactgctgtaagtgtgctcatatctgtattctgtgtgactgctgtttgtgtttggtggccaaagcgcatttctggtggtttcacgttttccttttcaacgtactcagatttcacatacctacaggaatg

SEQ ID NO: 119943 - DNA, 601 bp, Human
agctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaattcacggccgttcgagaaatatagaaagtagagaaaaatattaaaaagamactgaaaatcagccataatctcaccactcagagacaactgttaacacttagaatatttccttccaaagagtagatcttatgtgtttcaggagggcaaggagcaagtcttaacctcgttggaattttccatgacttccctccacccaataatgccccttcatacctaccccggcacctaatctagcacaatgctgaccacttaccagctgacaaatacatacctcttccttagatgaatgatgtattaagtggcatgcccctgtacttatatatttctatctatagaaaaagggatgttgt

SEQ ID NO: 119944 - DNA, 601 bp, Human
agtgcctttctcttggggttgctgtgaaagcactcaattggtattagctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaattcayggccgttcgagaaatatagaaagtagagaaaaatattaaaaagacactgaaaatcagccataatctcaccactcagagacaactgttaacacttagaatatttccttccaaagagtagatcttatgtgtttcaggagggcaaggagcaagtcttaacctcgttggaattttccatgacttccctccacccaataatgccccttcatacctaccccggcacctaatctagcacaatgctgaccacttaccagctgacaaatacatacctcttccttagatgaatgatgtattaagtggcat

SEQ ID NO: 119945 - DNA, 601 bp, Human
ccttctggagaacacaggtagaacacctggcacagtgctaagtggcatctagtatccactcaataaatgtgcatttcctttccttatgtctattcaccactccctatctctttcagtccatccctttcctataaggatatctcttcctcctaggatctattttgaattctctaatgaagtggttacaagcctaggttctaacgtcaaagttttagctctaaaacttatttactctgtgaattaggaaaactaattttacttcgccagacctctttccacttttgtaaactgaagatgtttrtaacagtgcctttctcttggggttgctgtgaaagcactcaattggtattagctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaa

SEQ ID NO: 119946 - DNA, 601 bp, Human
taaaagaattcatcattttttttccttcattgactgaacaacagttaatgagtaaagtggggaaagactactgtgagagccctatgagagccttttctatgccctgtatttataactcgtagataagcatccacaggatctccaaaacgcatcagatgaaaacagtgaggcttatgggccaaccacctctattgccagatcaagttacattaaagcttcaaacattatcagggatgtcaatcaatatttagctttatctaatcaggatcttccctcctgaggaagtaaaagaaaaccaagrtaccgttaggccaaatagagatctatgtgcattgccttctgtttcacaatcttcctcagagctttgtaaatagtttgaaaagatatttaaacacctgaaacatatttgttgttttaataatgaaatgacaggtggagtggggaccaaaaaaaccaacaactagggactttgatcttgtaaatttacctttctgtactgatacaggacaggcccacctaaaaagactgacatgtgtcccactgttgacaaaggttttaattctcaggccctctaataggtatgctcataacgaatagtgac

SEQ ID NO: 119947 - DNA, 601 bp, Human
atgaagctgatgttaaattatggagttacaaaagacaaatacaaatggattaatttactgaacaaatttgagaacaagtgaataattatgattacgatacccctttctgtgatcttcccctatgactcccctgatttagtccagctacattcactaagcactagactagctaaagacattgttggctgaattctaagtggcctctaggcaagcccaaatgtatctaaaactggaaaagagaggacagctgccaagttaacctctacctccatccttccctcatctgtttgagacaccatgsagagagctcttatgacccaaacttcagcctcctgagaattctgccaacaggcctgatggcagggagggtacctcatcctagtatgactctaaatgcactttcagaaaaactttttggggaaaaacagttacttagagtttaaaagaattcatcattttttttccttcattgactgaacaacagttaatgagtaaagtggggaaagactactgtgagagccctatgagagccttttctatgccctgtatttataactcgtagataagcatccacaggatctccaaaacgcatcagatgaaa

SEQ ID NO: 119948 - DNA, 601 bp, Human
ctaatgaaaaaaatcaccgatgacacaaatggaaaaacaccccatgttcatggattagaagactcaatattgttaaaatgaccatactttccaaagcaatatacagatttgatgcaattcctaaaatgtaattttgatcaaggcactcacctatttaatttggtgactcactattgcctacagaataaaacttgcagcatggctgacccagacttggggctctactgtctttcatatctgcttatacttttagatccactaactcatggtactctcctccctcatactttgtgccagctaytcccactgcctgtaatgtccctgactccatgttcacttaacttgtccttcaggttatcacttagacatcccaccaccctctccaggaagccttaatactaggagatgtctctcctatggtgtcccaccaaatttcatgcttccatatctaaatagatcacactatattgcagttgcttcgctacttgtttttcttactgtcctataaacatcttagttatttgcctttgtaaccccaatgcctaatacaggagctgaaacatagcagatgctaaaaaaaatctgttgaataaatgaatgt

SEQ ID NO: 119949 - DNA, 601 bp, Human
tgttgtaaaggaaacaacatcaagactcttgtgaatcaaactagtattgcataattgtgcaataacatccagctgtgggccttgagcgaaacagaatgaagagtggtgggagaaatttccaattcagagagagaagcagccacccactttttcattgctcaaaagtggtcatgagataacccttttgtctccttcccaagtattctagttgaaggctaccctttacggggagaaattaagcaggtatttgctctctctaactgattatccatctgtagtcaaagtgaaatctatcctttawggggagaaataaaacaagtacttgctgtctctaactgattatccatttgtagtcaaagtgctctttctaaaatgcaatttttcaaatagattcaacgggtttatgtgcagatttgttacatggatatattgcataactatgagccttgggcttctagtgcgcccatcaccagaatagtcaacgtggtacccaacaggtagttttcaatcctcagccccctctcactctccctccttttgaaggctcccaatgtgtattaggtctctccgtatgtccatgtttacctaccgcttagctctc

SEQ ID NO: 119950 - DNA, 601 bp, Human
acttctctggaccttctctgtaaaatcaggagatcagccttagggatccctgaggcccttttcagcttcaacctcttaaaaaggttccttgtgaagctgacttcatgacctcctgtcacaatcaattcaggtcccactaacaagcaagccctggttgttgttaggtgggcagagcaaatcacccctcactcttattctgatggaacaagaatacttcagatttcaccctatgcatttgttaatgacagtaaaccagatcaagctgattcaaggcaaaatcttaggatctgaatcactatcwttgtgtatttgtatcctattctttaacaggttaaactggaagagggtgaaatggaaagttatatatgacctgggtagtttttaaccttttctatatgctaacatatcgtaagtccattttaatatcagaattcagcttaaaacatggacatttttttctgcttacataaaatcagtaaaatcaacacttgctacagagaaaaatctaaggcaatacaaattaacttccatttctccctaagtaaatgaaaaccaagcgttgatccttccttcatcacaaagaggttgtagacgtgagaga

SEQ ID NO: 119951 - DNA, 601 bp, Human
ataccacattgtaggtcaataggtgagaacacaactatgatggagaaaactaaagaaaagatgagagatcaaaacaaatactaagtcacacgtgtaggacttttgatctctgtctcttttccctttcactcagaaggtaaaacgcagactaacagatattgctcttaaaggggggttattttaagacccagtcagaggtaacttttctgatgagttttgatacctgggtgcttttaatgaccaaatagtagtttacaacttatggaaaatataaaaatcttacaattaaatacttcattakgctatgaatttggctgagctgtgaattaaattttactgagtatgtgtgcattgagccatttctataattatattaagaaaagcccttgctgctagagatcaacagtacaataagcctctactatatttgcgaactactgagccactgttctatgttttttgatggggccttatcaaactacacagaagagagagaaatatttaattagaaaaatttaattatttggataattcattcaaggcaaacattacttcttaaatcagatcttacagttgcctgaaagaaactgatggaattttt

SEQ ID NO: 119952 - DNA, 601 bp, Human
ccttaaggaaaatctaaaatctaaaataacaggtttcatgggctggtaatattttcttctaatattcttcaaaccaaggaattaaaattaaaaaagtttacttgcttactgtatagaatcatcttgaatgctaccagtgctacacgggatgctatatggtgattctcaaacttgaatgtacacactaagcaactggagatctcgtgaatatacagattctgaatcaacaggtctaggatgggaccagagagtctgcatttctacatgctctcagctgaggctcatgcttctgatccacagrccacactctgagtagcaagatcaggagtgtaaaggggagtccacgtgtattatgatgccctatggttgcttcacagttgtctgccttcatttttatttattttttgtctctctaataactctactaattttcctgaaaggagtatatagtgtaggagaatctgatctgtatttttaatacttcaaaattgttaaaaaaaaaaaaaaaaaaaagaatgaaaacactattagaatttctgtagagccttataattttcacatccttatctcattttacactcaaaactctctgaaaaaaata

SEQ ID NO: 119953 - DNA, 601 bp, Human
gccattaacacaggaactaacacaggaacagaaaaccgaacatcacatattttcatgtattgggggagctgaacacacatggacacaggaaggggaacaacagacattggcacctttctggggaggggtgggggaaggcagaatatcaagataaatagctaatgcatgctgggcttaatacctaggtgatgggttgacaggtgcagcaaaccaccatggcacacgtttacctgtgtaacaaacctgcacaggtaatccagaactaaaataaaataaagggccctagaccttgtaatctcastttgcattttcacgtggatggtgaaaggtgacacccctagtctgatctggggtgtctgacaaacacaagagctaagccttctgtgggcaccttcagctagggctaacagcaccccagaagtcattcacagctactaagaccctactatgaatcccactgaacttctaaatcagggttaccgtaagaccagttataaaagccaccttcataatttttgccatttccaagtatcatttgctctgtcatttacttaatttctgttaaattaactcacctgttagaaatatgtaaatagctacc

SEQ ID NO: 119954 - DNA, 601 bp, Human
ctaaaccacaatgagaaaccatctcaccccactcagaagggcaattattaaaaagtcaagaaacaacagatgctggcaaaggtgtggaaaaataggaacactgttcctatttcccactttgtttacattcccactgttggtgggaatgtaaattagttcaaccattgtggaagacagtgtggcaattcctcaaagaccgagaaccagaaataccattttacccagcagtcccattactgagtatatacccaaaggaatataaatcattctgttataaagatacatgcatgtgtatgttcaktgcagcactattcacaatagcaaagacgtggaatcaacccaaatccccatcaatgatagactggataaagagaatgtggtatatatacatcaaggaatactatgcagccataaaaaggaatgggatcatgacctttgcagggacaatagatggagctggaagccattaacacaggaactaacacaggaacagaaaaccgaacatcacatattttcatgtattgggggagctgaacacacatggacacaggaaggggaacaacagacattggcacctttctggggaggggtgggggaaggc

SEQ ID NO: 119955 - DNA, 601 bp, Human
caaaagaagacagtcacgcagccaaaaaacatgaaaaaaagctcatcatcaatgatcattagagaaatgcaatctaaaccacaatgagaaaccatctcaccccactcagaagggcaattattaaaaagtcaagaaacaacagatgctggcaaaggtgtggaaaaataggaacactgttcctatttcccactttgtttacattcccactgttggtgggaatgtaaattagttcaaccattgtggaagacagtgtggcaattcctcaaagaccgagaaccagaaataccattttacccagcartcccattactgagtatatacccaaaggaatataaatcattctgttataaagatacatgcatgtgtatgttcattgcagcactattcacaatagcaaagacgtggaatcaacccaaatccccatcaatgatagactggataaagagaatgtggtatatatacatcaaggaatactatgcagccataaaaaggaatgggatcatgacctttgcagggacaatagatggagctggaagccattaacacaggaactaacacaggaacagaaaaccgaacatcacatattttcatgtattggggg

SEQ ID NO: 119956 - DNA, 601 bp, Human
taaaactggaccccttctttacatcttatacaaaaattacctcaagatgaattaaagacttaagtgcaaaacccaaaactatgaaaactctacaagaaaatctaggcaataccattcaggacatgggcataggcaagattgcatgatgaaaatgtcaaaagcaatcgcaacaaaagcaaaaattgacaatttggatctaattaaacaaaagagcttctgcacagcaaaaggaactatcagagtgaacagcctacagaatgggagaaattttttgcaatctatgcatctgacaaaggtctamtatccagaatctacaaggaatttaaacaaatttagaagaaaaaaataaccccattaaaaagtgggcaaaaggacatgaacagacacttctcaaaagaagacagtcacgcagccaaaaaacatgaaaaaaagctcatcatcaatgatcattagagaaatgcaatctaaaccacaatgagaaaccatctcaccccactcagaagggcaattattaaaaagtcaagaaacaacagatgctggcaaaggtgtggaaaaataggaacactgttcctatttcccactttgtttacattcccactgt

SEQ ID NO: 119957 - DNA, 601 bp, Human
tgccctctttcaccactcctattcaacatagtattggaagttctggccagttctttctcaggcaagagaaagaaataaagggcattcaaataggaagagagaaagtaaaactgtctctttttgcagatgacatggtcctatatctagaaaaccccattgtctcagcacaaaagcttcttaagctgataagcaacttcaactaagtctcaggatacagaatcaatgtgcaaaaatcacaaccattcctatacaccaacaatagacaagcagagagctaaatcatgaataaactcccattcayaattgatacaaacagaataaagtacctaagaaatacagctaataaaggaagtgaaggacctcttcaaggagaactaaaaaccactaatcagggaaatcagagaggatacaaacaaatggaaaaacattccatgctcatggataggaagaatcaataccatgaaaatggctataatgcccaaagtaatttaaaaattcaatgctattgtcattaaactaccactgacattcttcacagaattagaaaaaataactttaaatttcatatggaacctaaagagcccatatagccaagacaatc

SEQ ID NO: 119958 - DNA, 601 bp, Human
gcacatgtaggaacctggaatggttcagaaaaaaaaactcacaaggcaactacacaagcactgcatggcaattcataaaccatttccccctacacattttatgatgcttagacatttagttgttttacttaaataatatcacaagttaccgaaaaaagtgaaagggaagaaaatgtagacaaaaatcttaaaagtcggacctcatgaggaattgagtttgactccataattgtgtctcaagagaaactgagttatgaggaattaaaactctcttggataaaccgttcacatatttgaaaarcatttagctacaggctaacacagggaaagagacagaatcttctagtccctacagttagtctaagtagcaaattaaaaaataaacgctatttttgtgcttgaactcttcccaaaagagcactgagttgaagggacaaagaaaggaggctactttcaataaaattcaacattccttcaggttaaaaactctcaataaagtagaggcattgatggaacatacctcaaaataattaagagtcatttatggcaaactcacagccaatatcatactgaacaggcaaaagatggaagcattcccctt

SEQ ID NO: 119959 - DNA, 601 bp, Human
atcttctggatatcattctttacaagactacaaattaccatgcttcttcaatttgtaaatctctgaaaaggtttttcatgaggagcaacaccactgatcaataagctagagtttcatttacaagaaaatcttctgcaactgaactctctaagttggttaaggtgatgggttcaggtggatagtcacagaccacagaatcagagagtaatgtcaagaaagagtgcaaatggggctgaggaaaaaaattggaagatgaacagaagagtacacgtgtttattttagcagcacatgtaggaaccyggaatggttcagaaaaaaaaactcacaaggcaactacacaagcactgcatggcaattcataaaccatttccccctacacattttatgatgcttagacatttagttgttttacttaaataatatcacaagttaccgaaaaaagtgaaagggaagaaaatgtagacaaaaatcttaaaagtcggacctcatgaggaattgagtttgactccataattgtgtctcaagagaaactgagttatgaggaattaaaactctcttggataaaccgttcacatatttgaaaagcatttagctacaggc

SEQ ID NO: 119960 - DNA, 601 bp, Human
cacacaaaattgttttgacatattcaaaattatttattttttaaataattacattaaagtcttggcctctctctctctctctctctcttactctcccagtgtcactctctatcctctggatctctgatctctaccccctcttgccataattatctgtttcctcttttcaaggaacttttattcacatacaagtatttataggatccttttatcctctttttttttatacaaacgggatattattcagtcttttatattttgtttttccctcttttttttttttttcctgtaaagctaggasgtctttttagtggctgcaggttattccatgggctcaataaacaatgttactactgtaaaccctcctactaagggacatagaagtcactttcagtttaggctattataaataatgctgcaaagactatcattacaaacatatcttttcatatctgtggaatttcttgatctaagtgtatgtacatttcagattttcaaaaatattgccaaatcacccttcagaaaagtttaacaattcataatttcaacaacacgctatttttcctactctttaacactgaggtttttccaacattttcat

SEQ ID NO: 119961 - DNA, 601 bp, Human
cccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagcttttcattttaaatactgggcaaagtctttatttttccctccactgccggcccttaggccacttcactgatactygttttctctctcaaaagcagtcccctaaggcaagtgaaaacactcagctaatattcatgaaagcataactattataggtggaaatgaaggtggggacaggaggactgtgtgggtcgggaaaagagaagcgatatgaatcagattgtttatcactgtctctcaacacacctaaatcacatttatcacacaaaattgttttgacatattcaaaattatttattttttaaataattacattaaagtcttggcctctctctctctctctctctcttactctcccagtgtcactctctatcctct

SEQ ID NO: 119962 - DNA, 601 bp, Human
ggcatgtccagggctatttaaagaaggtaaaagtccatttctaaaaagaactccatcaataatccaaagcgtctgcccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagyttttcattttaaatactgggcaaagtctttatttttccctccactgccggcccttaggccacttcactgatacttgttttctctctcaaaagcagtcccctaaggcaagtgaaaacactcagctaatattcatgaaagcataactattataggtggaaatgaaggtggggacaggaggactgtgtgggtcgggaaaagagaagcgatatgaatcagattgtttatcactgtctctcaacacacctaaatcacatttatcacacaaaattgttttgacatattcaaaattatttatttttt

SEQ ID NO: 119963 - DNA, 601 bp, Human
gtggcagaggggacagctgaaaaatatgtaaaaattgaattttatgttaaatattaaaataacatgtagaacagttgtttgatttaaaaactgagtcaacaaacctttaaataactttctgaagtattaaaataaactaagtaaaatgctattgggcaaatttaaaatgctcggcaactggaaaaagtgaggagtaaaagatatatttcataactcaatccaggtgtcaaaatgtacttcctgggtagtgatgagacataggcatgtccagggctatttaaagaaggtaaaagtccatttmtaaaaagaactccatcaataatccaaagcgtctgcccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagcttttcattttaaatactgggcaaagtctttatttttccct

SEQ ID NO: 119964 - DNA, 601 bp, Human
gcatttgcagggaggctgttaaagatatgtcaacaacatgagctcagttttttttcctccagtaatggaaaacacacatcgctgaggaccatgttttatgtgtctttaagagaactgggtcaaatgaaaataaatacgaggtgcgaggaaatacactcactgggatgatctgtccacacactccaatgggttcatgtcttgtaaaggtaaaatagtctccatctgaaagaaaaaagcatggtcactcccagaaagtttagattaggaaaaaaaatgcaaagggagaactttggtggctgcaaaaaaaaaaaaaaaaaaacaaacagaaataaacttgaaaaaacatcctactcaaccgtgcatgaaagctggtagaagcctaacactggacatagcatatttctggatatatctctcagacacccaaatgcagtattgaggaaaggatctctaaggcaaaatgaatgacaaatttatgatacaagaagtcctcagggtggcagaggggacagctgaaaaatatgtaaaaattgaattttatgttaaatattaaaataacatgtagaacagttgtttgatttaaaaactgagtcaacaaacc

SEQ ID NO: 119965 - DNA, 601 bp, Human
ctgttaaaaataaatgccggagatgtaggtactaacatgacaaggtgttatctcttgtttgacatattatgctgtcatttttaatttaaaaagttacacaataggccggacaccgtggctcatgcctgtaatcctagcactttgggaggccaaggcaggtgaattacctgaggacaggagttcgagaccagcttggccaacatggcaaaacccccgtctctactaaaaatacgaaaattagccgggcatggtggtaggtgcctataatcccagctacttgggaggctgaggcaggagaatygcttgaacctggggggcggaggttgctgtgagacaagattgtgccacttcaatccagcctgggcaaaagagtgaaactccatctcaaaaaaaaaaaaaaaaaaaaattacacaatagaagcctcttgactgactcaatcaggaccattggttggtcaacagaaaaaggttaaagcagaaaaagatactttaaatatttcatttctccagtcttttgatatagaaccaagaactttacttaatcatgggtccacctgtctcttctgattaaatcacacccctaaattattatttatgattt

SEQ ID NO: 119966 - DNA, 601 bp, Human
agcaaagaacaaacatattttcaaattctacaacaaacaaaagattaacatacctaacctcttataaatgaaaccaatactctaaggccttcttggtaagcaagttgtaaatatgtttttattttgcaattccacttctagaaccatatccaactgagcatctaatatgtacacatatacgtgtgtgtatacgtatatacatatgtgtatacagttacagatttacaagtaaaatttttcttgggtctccaaaggtttttatttcagcagtctgtttaataggaaaaattagtggaaaaamcaccctcaagtgtacattaatacaggattaaatgatgatatactgatgcaagagtattctatgcagctgttaaaaataaatgccggagatgtaggtactaacatgacaaggtgttatctcttgtttgacatattatgctgtcatttttaatttaaaaagttacacaataggccggacaccgtggctcatgcctgtaatcctagcactttgggaggccaaggcaggtgaattacctgaggacaggagttcgagaccagcttggccaacatggcaaaacccccgtctctactaaaaatacga

SEQ ID NO: 119967 - DNA, 601 bp, Human
gcctatattatagtaacacatcttataaaacctagtaattaaggcagtctggtactagtgaaagaacagaaaaaattatgagctctaaaacagaaatttcctgtatagtttggtgcaaaagtcattgcagtttttgccattaatcaaattacttttgctccaacctgtatatatggaaatgcatcatgtaatgttatattcagatgagttgcaaaggggtagactgtttaataaattgttttgaagtaactaaacattcatttataaacaaacaaccctcacctttcattatacatgaaartaaattccaaccagattaaagatttaaacaacaaaaccataaaagtactgaaagaaaatattaagggccgtttgtataatcttaaaggggtttgttcaaaaatgacaggaaatccagaagctgtcagaaaaagactaaaggagaagactacatgagaatttaaaatctgcacatggcaaacaactgttttaaaaaaattaaaaagcaaagaacaaacatattttcaaattctacaacaaacaaaagattaacatacctaacctcttataaatgaaaccaatactctaaggccttcttggt

SEQ ID NO: 119968 - DNA, 601 bp, Human
cctagatgaggagtcaatatggtaaagatagcatttttcctcattttaatatggacatgtaatgttatgccaatcaaaattccaatcaaagttttttagagtaacataaggtacttagaaaatcggtttgaaatttcttctaaaagaataaatgggctttgaaaaaccaaataagagggtatgttgcctatattatagtaacacatcttataaaacctagtaattaaggcagtctggtactagtgaaagaacagaaaaaattatgagctctaaaacagaaatttcctgtatagtttggtgmaaaagtcattgcagtttttgccattaatcaaattacttttgctccaacctgtatatatggaaatgcatcatgtaatgttatattcagatgagttgcaaaggggtagactgtttaataaattgttttgaagtaactaaacattcatttataaacaaacaaccctcacctttcattatacatgaaaataaattccaaccagattaaagatttaaacaacaaaaccataaaagtactgaaagaaaatattaagggccgtttgtataatcttaaaggggtttgttcaaaaatgacaggaaatcc

SEQ ID NO: 119969 - DNA, 601 bp, Human
cgagatccagaccatcctggctaacatggtggaaccccgtctctgctaaaaataaatacaaaaaaattaaccaggcatggtagcgggtgcctgtagtcccagctactcggaaggctgaggcaggagaatggcgcaaacctgggaggcagagcttgcagtgagcctgagcaactactgcactccagcctgagcgacagtgaggctgacccctcaaaaaaaaaaaaaaaaaaaggtgaagacaaaatgaagccattttttagacaaacaaaagctgagagaagtcatcactagtagacctacrctacaagaaacgttaaagatcgttacagataaggaaaattatgccagaaggaaatgggcctacaacacaaacaaggaaggaggccaggaatagcaagtatgtgagtaaacagacaataattttgtattcttattcaaaaaacaaattttaaaacaaaaacagcagcaatgtattgtggggcatataacctatgtctaagtaaattatagggcaacaataacacaaaggatgagattggaacaatgctgctgtatggttaccacactgtatatgaagtaacataaagtatttaatggtaga

SEQ ID NO: 119970 - DNA, 601 bp, Human
aaaactgacaaaaagaaactctctcaaaagcagtctgggggaaaagaaacattacttaccgtaaaataaagataacaatgattgctgtatctcatcagaaacagtaaagtcagaaacatgccagaatgatatctttgaagtcttgaaagtaaaataaaacacaaactgtcacattagaattttatatccagaaaaaaaagttagttattaaaaagtgaagacaggccgggtacagtggctcatgcctgtaatcccagcactttgggaggccgaggcgggcggatcacgaggtcacgagatmcagaccatcctggctaacatggtggaaccccgtctctgctaaaaataaatacaaaaaaattaaccaggcatggtagcgggtgcctgtagtcccagctactcggaaggctgaggcaggagaatggcgcaaacctgggaggcagagcttgcagtgagcctgagcaactactgcactccagcctgagcgacagtgaggctgacccctcaaaaaaaaaaaaaaaaaaaggtgaagacaaaatgaagccattttttagacaaacaaaagctgagagaagtcatcactagtagacctacgctacaa

SEQ ID NO: 119971 - DNA, 601 bp, Human
tgtgggccaccacgcccggccacagacaaggattgtaaaatagatgtctacacaaatttaaaggaataaaggggtgtagcgaggaagaaaatataagatatttaaaaaatcatggaatttctagaacttaacaaaatctctgaagcagattaagcattacagaagaatatacgaacgtcaaagatgacaatgaaagttacctagccggaagcacaaaggaaaaaaatgctggaaataaaagagtcccagtgacccatgggataatgacaaatgacctaacatatctgtaaacagaaggcgraagtagaaagcaaaaaaaaaagatttgaaaaaataatggtcaaaatgtttcccagtttgatgaaaactataaactcacagatatacagaaattttaacgaaccaacaaaatacacaaaagtacatcacaatcaaattgctgaaaactgacaaaaagaaactctctcaaaagcagtctgggggaaaagaaacattacttaccgtaaaataaagataacaatgattgctgtatctcatcagaaacagtaaagtcagaaacatgccagaatgatatctttgaagtcttgaaagtaaaataaaa

SEQ ID NO: 119972 - DNA, 601 bp, Human
tgatggtctgaattctgaccagacagataagaaagatcttgttgaacactggggacattcaacagaaacctcagaaggatttcagcttattaataagaataaactagtcttaacaaagcttaaaggtaagttccaaaagagacaagctgaacctcaagtaacttaactaccttttaggaaaaaaaaagtttgacattctttaaagaaaaacaacaaaatctctaagttcagcaatataatggtcacaatgtccagtatcctttcaaaattaacagaaaagccaaaaaaaaaaaaaaaaaaaaaaggacccataaacaggaaaaactccagtcaaattcagagacgacagagaagttaaaagtaacagacaaggatttcattattatattattattattattagatggagtctcactcccgtcgcccaggctggagtgcggtggtgtgatcttggctcactgcaacctctgcctcctgggttcaaggaattctcctgcctcaacctcctgagtagctgagactacaggtgtgcaacaccacgcctggctagagatagagtttcactatgttggccgggttggtctcggattcctgacctcag

SEQ ID NO: 119973 - DNA, 601 bp, Human
accctcaaatccctctttctcttgaaaccttgatagaccacccaacccctagagctctctcccttcttgagatgctgatgtcatattacaaactaacatttgcttactgcttaaaatttcccaaactcatattgcatttaattcccatgaccctgagaaacaggtatgtatgctattattaaaccaattttgtacaaaaccaagtggctggtccataattatatagctatgaagtaaaaaatagtaaaccctatgcttatggtggcattttaaagcaggggagggttctactgatacctcrccttctagctctgagattaagtttttatttaccaaattcagtctttcctccttcatgtagcaacaaatatttactatgtatgtttactatacataagatactatttgaggtactgagaaggcctaagggatagactccaaagagaatgtcctccccacaaatcttcatatatgaccagaaactgccatcttttgaaagtaaaacttataaaaatcaagactaaactgataagcaaatcagctcaaagatgaaaaaggagttacttatgagagtaaagtactgcttaaatattcaatatta

SEQ ID NO: 119974 - DNA, 601 bp, Human
atccatcacaaccattacttctatctgaggacataaataccccaaaaagatacttcatattccatcagcagtcactttccattctcccagtcctttgaaaccactaatcaactttctgtttatagatttgcctattctggatatttcatacagtcacatgatacagtcttttgtaactggattctttcatttggtatagtgttttcaaggctcattcaggctgcagcatgtataaatacctcactcctttttatgggtgaacagtattccattgtatggatagaccactttttgttaatcmgcttatcatttaatggacatttgagttgtttccactttttggcaattaggaataatactgctgtgaacatttttgtacatgtttctgtgtggtattagattttgtcacgtttcttctgtgatgatcacctggtttttgtcctttattccattactatggagtattacattgatttttttacatatataaaaccaatcttgcattcctgggataaatcccacttggtcatggtatataatcatttttatatatttctggattttgtttgctactattttgtcgaggatttttccatctata

SEQ ID NO: 119975 - DNA, 601 bp, Human
tgaggagtactttgttttcttttaagagactctaagtaaaggatgaagagaaattaactcaggctgaactacattaatgctgtaaaaatcctaaagtaacgttaaactttatgggttggtctttgttgataattagcttaatcagattgatcatttactgttcagcttgggaattatctttgcttatgacaagccatctgcatagttttgtagatggacattacttgccctcaatgtggttaagaataatataatctgaagtgtaaaaagatgattcatgggaaatcactgttgaggaaarcctagtattttctccagcttttacacactttggtaccccctgactattaactactctcactagaacactgaggctacatgtttagcagtcactgagcatgtcatgttcagtgttggctcacctaccaagagttaacgaccctaggaaatcagacacacactacccttctcaacatgtcccatctggtatgatttaggttcttagggatgtgttgtttgtttttattttcccatctctataaggtttttcacatcctattaaagagacttctaaggatagacactgaattcaaaaaaaatc

SEQ ID NO: 119976 - DNA, 601 bp, Human
caacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagcaaacacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttactaat

SEQ ID NO: 119977 - DNA, 601 bp, Human
tcaacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagcaaccacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttactaa

SEQ ID NO: 119978 - DNA, 601 bp, Human
gattcaacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagaaaacacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttac

SEQ ID NO: 119979 - DNA, 601 bp, Human
gtttgaaggagtggccaccactctaggccacagcaagaaatcatgagtgagttccttaataggtaccaggcatcttcttccagcactgtattttttaaaattatactttgaattctgggatacatgtgcagaaagtggaggttttttacatgtgccatggtggtttgctgcacccatcaacccatcatctacattagctatttctcctaatgttatccctcccctagcccgacaggccccggtgtgtgatgttcccctccctgtgtccatgcatcctcattgttcaactcccacttatgartgagaacatatggtgtttggttttctgtttgtgttagtttgctgagaatgatggtttccagcttcatccaggtccctgtaaaggacatgaactcatccttttttatggctgcatggtattccatggtgtatatgtgccacattttctttatccagtctatcatcgatgggcatctgggttggttccaagtccttgctattgtgaatagtgctgcaataaacatacaagtgcatgtgtctttatggaagaatgacttataatcctttgggtatatacccagtaatgcgattgttgggtcaa

SEQ ID NO: 119980 - DNA, 601 bp, Human
tgagggtgagggacatattcattgtgaactctactgatggtttcacaggtagatggatacacatggccaagacttatcaaattgtacactttaaataagtgaaatctattgtatatcaattatactacaataaagctgttaataaaggtacattaaacaaaaatattacttcattacagaaattatgccatatatctctttgttgtcctttgcagactactggcagtagttggtctttgcacaactactgaaaaacaaaggaaactacgtaacatttttctgcaaagaaatttctccctayaccagaattccattctggcaaactcagtttgaaggagtggccaccactctaggccacagcaagaaatcatgagtgagttccttaataggtaccaggcatcttcttccagcactgtattttttaaaattatactttgaattctgggatacatgtgcagaaagtggaggttttttacatgtgccatggtggtttgctgcacccatcaacccatcatctacattagctatttctcctaatgttatccctcccctagcccgacaggccccggtgtgtgatgttcccctccctgtgtccatgcat

SEQ ID NO: 119981 - DNA, 601 bp, Human
gaaaatttatgcttgaaaaaagcaagcatcacaaaggcaattcagtggaggcagggtagtcttttcaagaaatggtgcaggaactattgtcattatccatctatctagcacttggatccttacctctcaacatacacaaaagttgaagtagatcataggcctaaatgtaaaacacaaaactataaaatttctagaaaaaaagcatatgagaaagtctttgtgatcttatgttaggcaaagatttcttagataccataccaaaagcctgatctataaaagaaaatgttaataaactggacawcaaaattaaaaactttaagagacactgggagaaattatttgcaaagcacaaaggacttttatccagaatatactaacaattttcataattcaacaatgaggaaaacaaacaacgcttgtctccaaagtgtgcaaagatttaaagatacttcaccagagaagatatgctgtggcaaatacacaaatgaaaagacactcaatggtagagaattggaaattaaaaccacattgagacaatgctatatacctatttgaatggctaaaatgtaaaagactaaccacatcaaatgttggtggggat

SEQ ID NO: 119982 - DNA, 601 bp, Human
aggcaggagaatggcataaacccgggaggcagagcttgcagtgagccaagatcgcgccactgcactccagcctgggtgacagagcgagactccatctcaaaaaaaaaaaaaaaaaaaaagaaagaaatagacccatataaatatggaaaatttatgcttgaaaaaagcaagcatcacaaaggcaattcagtggaggcagggtagtcttttcaagaaatggtgcaggaactattgtcattatccatctatctagcacttggatccttacctctcaacatacacaaaagttgaagtagatcayaggcctaaatgtaaaacacaaaactataaaatttctagaaaaaaagcatatgagaaagtctttgtgatcttatgttaggcaaagatttcttagataccataccaaaagcctgatctataaaagaaaatgttaataaactggacatcaaaattaaaaactttaagagacactgggagaaattatttgcaaagcacaaaggacttttatccagaatatactaacaattttcataattcaacaatgaggaaaacaaacaacgcttgtctccaaagtgtgcaaagatttaaagatacttcacca

SEQ ID NO: 119983 - DNA, 601 bp, Human
tgacttagcatagttagagaataaatcatggaatctcatccagcaggcagagactataccatacttattcttcagtcttcaagttttaagaattttttaaaaagagaagttttatgctaatagtttaaaacctacacaaccaaaggtttttccacatgaaactggttttttcaatattttcatgacattcaaactggtatttttaaataaaatactgaatgattcacgaatggactcacacaaccttagaaaaaggcctattagctgtttatagctaaaactgtagcaagccacttccccyaacctaaaatgaggggtgaagctaactaggagagagctgacctgattcatgactcaagcagtagagatggtgcttgtatcatgcaacatgacatttatctcacttaggaaataaaagaaccccagctgcgtaaattagaatgagtgataatacagctgttagctacaaacatttgtttggcacgaatcaatctggactctgctgtagtttgctttgatggtctctccactatcttgctgctaatgatgagatcattgtttgttaacctgagtaaagaaaacactataccaagcaaaatgc

SEQ ID NO: 119984 - DNA, 601 bp, Human
aatctttgacttagcatagttagagaataaatcatggaatctcatccagcaggcagagactataccatacttattcttcagtcttcaagttttaagaattttttaaaaagagaagttttatgctaatagtttaaaacctacacaaccaaaggtttttccacatgaaactggttttttcaatattttcatgacattcaaactggtatttttaaataaaatactgaatgattcacgaatggactcacacaaccttagaaaaaggcctattagctgtttatagctaaaactgtagcaagccacytcccccaacctaaaatgaggggtgaagctaactaggagagagctgacctgattcatgactcaagcagtagagatggtgcttgtatcatgcaacatgacatttatctcacttaggaaataaaagaaccccagctgcgtaaattagaatgagtgataatacagctgttagctacaaacatttgtttggcacgaatcaatctggactctgctgtagtttgctttgatggtctctccactatcttgctgctaatgatgagatcattgtttgttaacctgagtaaagaaaacactataccaagca

SEQ ID NO: 119985 - DNA, 601 bp, Human
ttatacaggacaaaaaggaacacaaaaggcttttcatgccctctttattcagggcagttgctccctgaacacagtttctaaagttgggtaaaatttttttttattaattactcaggtgagttcctactcagagctattttattacacatatcaaggtagatttttctcagcgatataacacctttttaaaaatggaaaaatctctactagagatcccagtaaactagtcaaagatgcctgtgtcttgtaatatcttttcataaatcccaaacagatttactctctgcttcttccctcttcwcctttcttaattttcattgttatgcttcctggttccaactgtgttgggaatagaaatgccaaaaatatggggattgggtgtttgtctttctgaagtacccagaaataacaggccaaattaatctgtccagatttccaccagaaacaaacaggaccaaggcatctaagcagttcctttaagtggtaacagcagtttaaacctttatctgtgaaattcagattatgaaggccagtataaccactatgtttccagccttctgtcccaccattcccaccaccactcacccacgactctaggcac

SEQ ID NO: 119986 - DNA, 601 bp, Human
ctggaatcatgttcacagcaatgcggcaatgtaggggaaagcaatttggggctttgcaagaaaaataatttgttatacaggacaaaaaggaacacaaaaggcttttcatgccctctttattcagggcagttgctccctgaacacagtttctaaagttgggtaaaatttttttttattaattactcaggtgagttcctactcagagctattttattacacatatcaaggtagatttttctcagcgatataacacctttttaaaaatggaaaaatctctactagagatcccagtaaactagtyaaagatgcctgtgtcttgtaatatcttttcataaatcccaaacagatttactctctgcttcttccctcttctcctttcttaattttcattgttatgcttcctggttccaactgtgttgggaatagaaatgccaaaaatatggggattgggtgtttgtctttctgaagtacccagaaataacaggccaaattaatctgtccagatttccaccagaaacaaacaggaccaaggcatctaagcagttcctttaagtggtaacagcagtttaaacctttatctgtgaaattcagattatgaagg

SEQ ID NO: 119987 - DNA, 601 bp, Human
attttcatggctatggtaactatacaaaagtaaaagtttcagtctatgatcatcagagaagaatacctaagaataattttccttgcatcaatgctttaccagcctttccttagaaaacaaatttgtgcgctgcacccactaactcggtaaacaccacaaggcaaatctcagatgaatgatacctttccccttcatctttggaagaaagtcgagttatagttcaagaaagaacgggatgtgttaggctatgggagaaccacttccatctggagtggcctcaggacaggacactcctaaacarccctggttttcaccaatgtccttcattcaacacatattcatagttctcctactatgtgccaggtacactgttgggcatagtcccttaccaataaggaattcacagctaaaaggactcccatgtaaacctagtagatgttcaataaatgtggctttgcagtccactagaaaaaaaaatctgggtctcatttaatattagatctgaacagattaaattacagttcctcagtactttgttataacccaaaggtttccgaagtcaaagcctgtgggattagaaagtataagaatgaacgaatta

SEQ ID NO: 119988 - DNA, 601 bp, Human
tccctgatattcatcagaccattctagaggttgatatttttttgccactagaaatgtcggccagtgattattttcatggctatggtaactatacaaaagtaaaagtttcagtctatgatcatcagagaagaatacctaagaataattttccttgcatcaatgctttaccagcctttccttagaaaacaaatttgtgcgctgcacccactaactcggtaaacaccacaaggcaaatctcagatgaatgatacctttccccttcatctttggaagaaagtcgagttatagttcaagaaagaaygggatgtgttaggctatgggagaaccacttccatctggagtggcctcaggacaggacactcctaaacagccctggttttcaccaatgtccttcattcaacacatattcatagttctcctactatgtgccaggtacactgttgggcatagtcccttaccaataaggaattcacagctaaaaggactcccatgtaaacctagtagatgttcaataaatgtggctttgcagtccactagaaaaaaaaatctgggtctcatttaatattagatctgaacagattaaattacagttcctcagtac

SEQ ID NO: 119989 - DNA, 601 bp, Human
ggtgatgtaaaggagacagctggaccttccaaagcaggtctcccgtagatctcccaaactgcctgtgctgttaactccttcagaaaaacaccggggaaactccaacttcccctcagtctccaatatcactcattaactgtaactctgcctcctcctaaaaaagattttgaaaatgtatccccatcctgagaaaagctaaccttagggggaaaaagtgatgtctctcaaagatgcagaactagagtttcttgatttgctgaaaacatgacttaccaaggtgttggaaaatgctaacacctgkccctgaagtttgatgggtgagctgtggccaacctgccagactgcccttcccccgcccttgccattttgtgtctcttccacttccacgcaaaggcctcaggaagacctggtctcagtaaaggccctgttctcacacagacatggtcctctgagaagaaaacaggcaaacacaaagggaaggagaatctggccctctcttctgggaatgctgaaaattatgactggtaagggggaactcacaccgaagggcaactggggaaacagcaatcctctgacttactgccagcactcagggaggggt

SEQ ID NO: 119990 - DNA, 601 bp, Human
ggagacaggttttgcaaatcctgcaggtgagacagtcaccggccaatgccagctcagggcatcaatgggatgcaacagtaacaaaccctaaaaggcaagccaacccagctcttgtcatcagcttgggttacaagatgtaagttagtggggtacagtttaatgtccatgctggagtgaactggaagacagctttagtttcgtgatggaaggactaaggaaaagggagttaaatctggaatcttaatcactgaaagatttctctaaagacaactggcaagaaaaatgtaactggagatttcartcactgcattgtggcctttagctttggactccggctccagaaaaaagccaactggtgccacttgaaagatatcatgaggataaaacaaattgttcatgtatctcctaaaatgccaggcatgctttttattacatgctccaaagagactatcaatattacacctttgcctctgcctagagctacagtaaaaggataccagacagttgagaatctctctttttgtgcaatcttgtaaatgccgtttatcttgaatccaagtaaacaagaggctgagttaggagaaagcacttgccaatgagt

SEQ ID NO: 119991 - DNA, 601 bp, Human
taatattaggacttttgcctccaagttccagagttactctcttcaaattacttcttccagctgcttcttggataagctttccaacctgaaagaagggaaatggagacaggttttgcaaatcctgcaggtgagacagtcaccggccaatgccagctcagggcatcaatgggatgcaacagtaacaaaccctaaaaggcaagccaacccagctcttgtcatcagcttgggttacaagatgtaagttagtggggtacagtttaatgtccatgctggagtgaactggaagacagctttagtttcrtgatggaaggactaaggaaaagggagttaaatctggaatcttaatcactgaaagatttctctaaagacaactggcaagaaaaatgtaactggagatttcaatcactgcattgtggcctttagctttggactccggctccagaaaaaagccaactggtgccacttgaaagatatcatgaggataaaacaaattgttcatgtatctcctaaaatgccaggcatgctttttattacatgctccaaagagactatcaatattacacctttgcctctgcctagagctacagtaaaaggataccag

SEQ ID NO: 119992 - DNA, 601 bp, Human
aaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcracaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgg

SEQ ID NO: 119993 - DNA, 601 bp, Human
tgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggkgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgt

SEQ ID NO: 119994 - DNA, 601 bp, Human
ttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacrgggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttct

SEQ ID NO: 119995 - DNA, 601 bp, Human
aatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgayagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaac

SEQ ID NO: 119996 - DNA, 601 bp, Human
aatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagytcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttct

SEQ ID NO: 119997 - DNA, 601 bp, Human
taagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagayattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatt

SEQ ID NO: 119998 - DNA, 601 bp, Human
tcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaarcatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcg

SEQ ID NO: 119999 - DNA, 601 bp, Human
ttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatrgttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgt

SEQ ID NO: 120000 - DNA, 601 bp, Human
gcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgsgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggccc

SEQ ID NO: 120001 - DNA, 601 bp, Human
tctatactgaatgagaagagcctgaagtaggatagatggctcaactggtagattctcaagactgtaaaatagaattcagttgcaattggcaattgctggtatctaggagtgaaggaaagaagaaagagaagaaggaggggaaggagggagaggaagaaggaagaaaggaagggaagaagaaaagaaatataaggtaaataaatccaaggtatggataactgggaaagttaggaaattatagtattgaagtgattttggcagtaagatgacaagctcatttctctctctctctctctctctmtctatatatatatatagatagatagatagattcatctatctatcattgaatttgtctggtgtgatagcaagatatctaaatagagatgtaaaacaggtaaagatccaaatgatataataattagatttgggggttattgttgaaaaggtgagaaagtcttaatagacattgaaaatgttgactatgaaatgattttaaaagagtcatttcatggtgtcacttagttcagaagccttcagaggcttaccattacctaattgcctgagctcttctagtcctgtcttaactaagttctgtcct

SEQ ID NO: 120002 - DNA, 601 bp, Human
atactgaatgagaagagcctgaagtaggatagatggctcaactggtagattctcaagactgtaaaatagaattcagttgcaattggcaattgctggtatctaggagtgaaggaaagaagaaagagaagaaggaggggaaggagggagaggaagaaggaagaaaggaagggaagaagaaaagaaatataaggtaaataaatccaaggtatggataactgggaaagttaggaaattatagtattgaagtgattttggcagtaagatgacaagctcatttctctctctctctctctctctatctatatatatatatagatagatagatagattcatctatctatcattgaatttgtctggtgtgatagcaagatatctaaatagagatgtaaaacaggtaaagatccaaatgatataataattagatttgggggttattgttgaaaaggtgagaaagtcttaatagacattgaaaatgttgactatgaaatgattttaaaagagtcatttcatggtgtcacttagttcagaagccttcagaggcttaccattacctaattgcctgagctcttctagtcctgtcttaactaagttctgtcctgtg

SEQ ID NO: 120003 - DNA, 601 bp, Human
ctagtttgattccatatctttgctattgtgaatagtgctgcagtgaatatataagtgcatgtgtctttttcttttttttttttaagacagagtttcactctgtagcctaggctggagtgcagtgatgcgatcttggctcactgaaacctctgcctccctggttcaagagattctcctgccacagcctcccgagtagctggggttataggcacctgccactacgcccagctaattttttgtatttttagtagagacagggtttcaccatgttggccaggctggtctcgaactcctgacctcrtgattcacccgccttggcctctcaaagtgttgggattacaggcgtgagccactgcacctgtccacatgtgtctttttggtagaatgatttatattcatttgggtatatacccagtaatgggattgctgagttgaatggtagttctgttttaagttctttgagaaatctccaaactgttttccacaatggctgaattaatttacgttctcactagcagtgtataaacattcccttttcttggcaaacttggcaacatctgttgttttatgactttttagtaatagccattctgactggtgt

SEQ ID NO: 120004 - DNA, 601 bp, Human
tctgcatttcacagatgaagaaacagaggtgagagaatttagtgatttgtcaagaccacataggtggtacgagctggagccggactccaaatcctagtcttctaacttaatccagtactttttctgccatcactttttaaatcttggcacacttataagctgcccttagcaatcctgcaccaattacgggaggtgatatcagtattttgactttgcttggctctaattttttcttgagactaaggagtaatgataaagataggtagctttatgtccaaagagtttcctttatggctatttsccattctagtgttttggccttagaagagataagactgtgtggcatctagaagcttgctttatttaaggaacaactcaacttggccataatatgcataagctgttgtgttctagaagagccatgagaagtgctatggaattttcacgtttaataaaaatgcagttctcatagattatcttggttaagtctaagaagattagtttgtttttatctaataaaaagtataaaggtgctttacaatgtaaaaagggtcagttgtttagtaatttaaatgtccagttgagggttctcaattatgaa

SEQ ID NO: 120005 - DNA, 601 bp, Human
tgaacagaaatccttaaaatctgtgagatggacttctaatgagaaagccaataaaatgggtcctttggttttgtctattgtttttgtttttatgagaaaaataatagactgttgtaaaacaaagtataaaagaataaatcaaataataatgatttttctttcacacaaaagatattattctttaagttgttttggaagtcaagtttgcagaaaatttgctttcattagtccttttttctttctctctctgcctggtcacttccttttgcccatcagcttctattgacttctcagttgtctrgctgtggaggacaggttcatgccaggaataaaggttcctaccttgtttcctagggaaaaaaaatgggcttacctgatatcgcagataaccaggaaattccacttcctctttcagatgtgtgcgtgatatgtccctattcattggttcaccttcccccttcaaaactaaaaatgaatgtgaacataccttattaagtaggatttttaaaggcacggcatcataaaacttgcaacttctgtaggaagagcctaggacatgtgttggaatcacaccagtgatttgtgttgtgtgttggtcagc

SEQ ID NO: 120006 - DNA, 601 bp, Human
gtttgtccacaatcatggcaggaggaaggtaatgttgttaattgctctctggctcttaacatctgccagagtgactggcatcacccctatgctcattcgattggccaaagccagtcagatggatgtgatgaacttcagtgagggtgaggtagtacagtcttaatatgtgtgaggatagctggaatatttggaagcagcctaatgacaactgtactttcccatgttgagtggctatgagtctcatcccatcaaatcttggtgataccaatgagaaccaatttactttctcatatacaaataygaagttgacattttttccaaacatctgggacaatgaatattgctcttgatcaaatttcaagttattttcatttaagaattagacagacatactgtgatctctttttatgttacacatttctctcatactggcattttatctgcacatgatctggtgaaagcttacttggtaatgatggcttgtcactttcttccctgtcttgcagagttcatggtctcttttcaggagccagtcattctaatatcctagttcaagaaaacatcttcttctgtttattagttgttcaatttctgtagtcct

SEQ ID NO: 120007 - DNA, 601 bp, Human
tcttttcacattttgcaagaatgaagttttagggaagttctggaaaattaatgggaaagtaattccctcaagagagtgagacacaaaaatgtggctcatccagggagcagcttcagattcttcccttgctaataagatgagagcaagatgatgtgtattgagaacctgccatattcaagacactctattaggttccaagggggctataaagataaagagggcacagtccctgccctccagaagcagtatatggtaactataattagaaaggaacacaaagtaattaaagaagtgtgccgasatgggaggtatggatgcctctgactgttatgtttttggagagttttgtgaaagaggtggcatccaggctgatactgaaagagatgtggggattgcagaatcggactgggtaggatgctgatgcagcatcttcattctggtactctgcatgctgccagtggacaggcaatgatggtgcagggcaggtatctcaagtcaacggggagaggatagtgtcacaaccataccatttgggggactgttgatgtttcttgatgaattgaaatacgggggctttcatttgttgggcaatggaaaaata

SEQ ID NO: 120008 - DNA, 601 bp, Human
gttttctcagcaccatttattgacaagcgtatcctttcctcaatctaactggaatttttaaccaggattcaacaatagctttatggaatctgtgtgtatgttgtgttatatgcagtattttggttatttgttcattcacatgggggagagagtccattgttttatttacttctcaaaaggttctgtaatccctaaagggccaagaaccacttatctgcaggatacaatttaaacatcttagcatgacatacaaagtcctcattatctggctggcctcagcccattgctttgattttctctyctgttacattctctgttgcttctatttctttatcctcttttcatgctccagtagtcaaagtactttgtttctctaaaagcacctaatggtttataatctcgacgtctttgctcttaacgttctttctgcccaacccttttctttgcttcttatcccaccatttcattggtttgctgaacacctactcatctatttagacttcactggtttaattcctatgtggatgtaatgattactgtgctatatcctcttggatatatccgtattgtactttatattctgatttcagcattgctggca

SEQ ID NO: 120009 - DNA, 601 bp, Human
agcaggtagaagaagggagataggttttgctgagtcttcttgctctctttctcttcctgtgtcagatgcttgtttcctctcctcaggaaggacatcagattctatgttcttcagccttggaatctgggacttaaaccagcagccttctgggggccctagggcctttggcttcagactgagggctgcactgttggcttctctggttttgaggttctcagacttggactgagtcatactactgtcctctctccctccccagcttagagacagcctatcaaggagacttctccttgtgattatwtcagccaattctccctcttttgtatacctatatatcctgttgtttgtgtctcactggagaaccctgattagtacacttattcattattggtccctaagcaggtacatagtggaccctcaacaatgtgtaaaaggcacagtgcatgagagctgtcttcagatatctgaagggttaccttgtgtttacatatgtctggggaacagaaccaagaccaaagagtagaagttacaggaagacagattataattcaatacattgtttatcagtgcacctatgggaggtgatatttgatagcaacag

SEQ ID NO: 120010 - DNA, 601 bp, Human
catgtgaagatcttggggaagagcatttcaggacaacaaaacagctactgccaagggcctgtcacaggagccacatggtgtgctggaagcacagctcggaggctgggcagaaggaatttagccaatataatttattatacaagccaaaattattagcaacaaaatgaaatatttattttgcagtttaagtatatatagccatgaacatttagatttcagaatttgtgccatgatttcatgactagattcagtaattatttaagattcacattggagaaaatcagtgttctgaagactatgmcgtatatcccgctttgaagttttggatttttcttgaataggataggccattaacaatattggaggaaaatatcatctagtgttatattcttaaattgaatttgccttggaagtaatcatgcatgcaatgaacatagtaagaaacagcttctttcatcctttaatgtaataattgctcccaaggattacaagagcttatagacagctggaacatccagctataatgttagctggacagggaagaaagttgttatggataaagcttcagattttcttggattttttggtatctgtataacag

SEQ ID NO: 120011 - DNA, 601 bp, Human
tttcatgactagattcagtaattatttaagattcacattggagaaaatcagtgttctgaagactatgccgtatatcccgctttgaagttttggatttttcttgaataggataggccattaacaatattggaggaaaatatcatctagtgttatattcttaaattgaatttgccttggaagtaatcatgcatgcaatgaacatagtaagaaacagcttctttcatcctttaatgtaataattgctcccaaggattacaagagcttatagacagctggaacatccagctataatgttagctgracagggaagaaagttgttatggataaagcttcagattttcttggattttttggtatctgtataacagagacctgatgagttgccagcacataacaagccagaaccctggatccagagagcatttgtgacattcagccaacacagaactgctttcccacccaaagggtggtctccaaatctgttgtagcttttggcaagatttttatatcacaattgaaaacagatgccctttctgccctttcccttgttgtctgagttactaccgttcaagagattgcaagccatggcaatctctcatgc

SEQ ID NO: 120012 - DNA, 601 bp, Human
aggattacaagagcttatagacagctggaacatccagctataatgttagctggacagggaagaaagttgttatggataaagcttcagattttcttggattttttggtatctgtataacagagacctgatgagttgccagcacataacaagccagaaccctggatccagagagcatttgtgacattcagccaacacagaactgctttcccacccaaagggtggtctccaaatctgttgtagcttttggcaagatttttatatcacaattgaaaacagatgccctttctgccctttcccttgytgtctgagttactaccgttcaagagattgcaagccatggcaatctctcatgcaccttcagaatgcccagcaagagtcctcgttagacattcctattcagaagtcctgctgtgacacacttcctctgcaagaagagaacagattcaggaaggtgccaggattgtgaggttctggtagtctgcagggtgtactgtgaatgctttttgtcaaaatcaaagcaccagtcctgggtttaatagaaaacatctctctggatagtttctattttaaaatatttaatcctaaaataaaatatttaatc

SEQ ID NO: 120013 - DNA, 601 bp, Human
tgtggaggggaaaaatgaaacctgaaactttaataagatttattggttcaaacaccacatgttctcactcgtagctgggaattgaacaatgagaacacatggacacagggaggggaacatcacacatgggggcctgtagtggggtgggggtaggggggagggatagcattaggagatatacctaatgtaaatgacgagttaatgggtacagcacaccaacatggcacatgtatacatatgtaacaaacctgcacgttgtgcacatgtaccctagagctcaaagtataatacaaataaatamataaataaacaagaaaaatcaagggcaaaaaaaaaattattggttcattagtagaaatgtaaaagtgcttcagaaaaagtaatcatagtttaggggagaggaacctaggggcagacccaggaggagagaaagtcatgtagaaaaggagattttgaaggatgttcagtgtccttcagtggaaagacactgccagctctaaatggctctgcaagggaggagccggggaataaatcctctgacatcactctcttccctcccatctattgctgatcttttcctgctctcaaatctagatggcaa

SEQ ID NO: 120014 - DNA, 601 bp, Human
aatgttgaaggatagatacttttggaagaagcccttcatagaattataaaatgttagggctgggagtatcctgagaagtgattctcaacctcattttagaggtgaggaaataaagggagcattatacaggtagcaatttgtgtacagctagttgtcacagatctgttaagaaattacagactttttgatatgaacagacacttctcagaagaagacatttatgcggccaaaaaacgtgaaaaaaagtgcatcatcactggtcattagagaaatgcaaatcaaaaccacaatgagataccayctcacaccagttagaaaggcggttattaaaaagtcaggaagcaatagatgctggagaggatgtggagaaataggaatgcttttacactgttgttgggaatgtaaattagttcaaccattgtggaagacagtgtggcgattcctcaaggatcttgaactagaaagaccatttgacccagcaatcccattactgggtatatacccaaaggactataaatcattctactataaagacacatgcacacatatgtttattgcagcactattcacaatagcaaagacttggaaccaacccaaatgc

SEQ ID NO: 120015 - DNA, 601 bp, Human
gtatatggaagggacaaatattgttcagttctggaaataagaggaagtggaattatttctgcagagatcaggaagaaatgtctttgcctggaaggaagtgggatggttggaatcccacctgaaaagctgcggaagggcatttgccagcttcctggaattctctaataaactttctcttcctagagtggtcaacctgtacttgttttcatggagcttacattctcgtggggaaagagagaaatgacaattaaaaataatttgaatggtagtgataagtgctatggaaaaaaatgagaaggamtagagactacaggtttgggtgggtactctttctgtggagtggttgaagaaggtcactctgacgaagagatctttgagcagaggcctgaaggaggtgaataaatgagaacagcaaatgcataggccctgaggtggatacttggctgtcaggtgtgaggctcagcaggatcagcatggcagagggccaggaaggaaggagaggtagtagatgaagtaaggaaggaagtggggagccacaccatataggccgtgtaggccatcggaaggcttctggctttgagaagagaaagggggcaatgga

SEQ ID NO: 120016 - DNA, 601 bp, Human
tgtaggtaagagttatcttagagtaccataaaatattagatcaggaaggggtcttagagatccaggaaggcactaagagatgaaataatttgagtaagtttcacatatgagttcattggaaagcctggctcccaatccaatgattttgccacacgtgcctctccccttgggttatactaagatgtgattacacttaaatgtgggtcatacatacgtgtgtgtacgtgtgtgtttgtaacctattttcatctcctagctttgaagctttatgatggaggcctttgttgtcatagtttccagyatttgaacattaagcaaagtcatgttgagcaggaacgtaatgtgtagagtaggatgaaaagtgggctggaagtgaggaagcttggattccgactctcttttcattctgagctctgtgagctggaactgttgcttcgctttgtgttctccattggctttttctgttctagcagtctacagacctatacatttaaaaaatatggttctagtgaaaaagcttatggctatgtcttaaatgggtttggaagagtaccttttatttatcttttcattttgtttgtttttggaaaatcctttctta

SEQ ID NO: 120017 - DNA, 601 bp, Human
gccccaggggaattaagttgatgcaggcattatgtccttccctccttcaatcaatacatattttcacatgggtatctttgtaccgtgtgaaattgcagtctattctctactttcaaaagctgtgactttctcttgccgggcccaattgctcacacctgtaatcccagcactttgggaggccaaggcgggcagatcatgaggtcaggagatcgagatcatcctggctaacacggtgaaaccccatctctattaaaaatacaaaaaattagccgagcgtggcggcatgcgcctgtagtcccarctactcgggaggctgaggcgggagaatggcgtgaacccgggaggcagagcttgcagtgagccgagatcgcaacactgccctccagcctgtgggacagagcaagactccatctcaggtaaaaaaaaaaaaaaaagaaaaaaaaaaaaagatgtctggaaagtaatgaggcaagaaggaggggttcagaagaatgcagaaattagtgggaataagataaaggatggataaaggatggggaagacagacggtacaagagtagcaggtagtaacatggggaaaggttcgaatgaacagtggagc

SEQ ID NO: 120018 - DNA, 601 bp, Human
ctttcaaaagctgtgactttctcttgccgggcccaattgctcacacctgtaatcccagcactttgggaggccaaggcgggcagatcatgaggtcaggagatcgagatcatcctggctaacacggtgaaaccccatctctattaaaaatacaaaaaattagccgagcgtggcggcatgcgcctgtagtcccagctactcgggaggctgaggcgggagaatggcgtgaacccgggaggcagagcttgcagtgagccgagatcgcaacactgccctccagcctgtgggacagagcaagactccrtctcaggtaaaaaaaaaaaaaaaagaaaaaaaaaaaaagatgtctggaaagtaatgaggcaagaaggaggggttcagaagaatgcagaaattagtgggaataagataaaggatggataaaggatggggaagacagacggtacaagagtagcaggtagtaacatggggaaaggttcgaatgaacagtggagctacttgtaagccctagttccttctgaagccttgtgactgtctcactgggtcaggcagagaaggtgttggacatactggaaggggtcctggcaaggcctggtgtgagcca

SEQ ID NO: 120019 - DNA, 601 bp, Human
gcgcctgtagtcccagctactcgggaggctgaggcgggagaatggcgtgaacccgggaggcagagcttgcagtgagccgagatcgcaacactgccctccagcctgtgggacagagcaagactccatctcaggtaaaaaaaaaaaaaaaagaaaaaaaaaaaaagatgtctggaaagtaatgaggcaagaaggaggggttcagaagaatgcagaaattagtgggaataagataaaggatggataaaggatggggaagacagacggtacaagagtagcaggtagtaacatggggaaaggttcraatgaacagtggagctacttgtaagccctagttccttctgaagccttgtgactgtctcactgggtcaggcagagaaggtgttggacatactggaaggggtcctggcaaggcctggtgtgagccactggtgccacagacacaacctctagcaaagtattgctttgtttaaaaaccaccaccacctccacaattaccctgccaccattaaaaatgttaacatcagtagggaaggtgtgactaagactgggcagcctgagcaggttgcttgttttccccaaaagagggaggaggagggaagct

SEQ ID NO: 120020 - DNA, 601 bp, Human
ctgccctccagcctgtgggacagagcaagactccatctcaggtaaaaaaaaaaaaaaaagaaaaaaaaaaaaagatgtctggaaagtaatgaggcaagaaggaggggttcagaagaatgcagaaattagtgggaataagataaaggatggataaaggatggggaagacagacggtacaagagtagcaggtagtaacatggggaaaggttcgaatgaacagtggagctacttgtaagccctagttccttctgaagccttgtgactgtctcactgggtcaggcagagaaggtgttggacataytggaaggggtcctggcaaggcctggtgtgagccactggtgccacagacacaacctctagcaaagtattgctttgtttaaaaaccaccaccacctccacaattaccctgccaccattaaaaatgttaacatcagtagggaaggtgtgactaagactgggcagcctgagcaggttgcttgttttccccaaaagagggaggaggagggaagctgaaatgggttcaaggaggagcactgccaaaaataatctttacatcaccctccctggtccacttatggcacttcaaaattcctttagtgtt

SEQ ID NO: 120021 - DNA, 601 bp, Human
aattaccctgccaccattaaaaatgttaacatcagtagggaaggtgtgactaagactgggcagcctgagcaggttgcttgttttccccaaaagagggaggaggagggaagctgaaatgggttcaaggaggagcactgccaaaaataatctttacatcaccctccctggtccacttatggcacttcaaaattcctttagtgtttctgaagggcttcttggaaactatttgtatgaaaagacaactaattgagtgagtaaattaacggcttgaatacctagaatacctaagttgctatacacmagcagaaaatcttacagtgatctgagctagactgaattaaaaaggcatctcctacttagcatataggacaatgtatagaacaactttgtgacccaagtggagagaaggggggttgggaaagagcaccactgctagctgtctttttcagttgaaccttttcctgctcttcaagagaaaatcagtttagaatctaaagaaaggagcagggaggatgaaggaaactatacttacagagtgaggcttttttaaaaaattaaattaatgttagaacttaaattatatgaaacaaagtaaataatg

SEQ ID NO: 120022 - DNA, 601 bp, Human
atagtaccctctgcacatgggtgctttaaggccaagacttatggctttcccagaacctcctctctgcctcctcctctttcattgtgtcacagcttaaagattgtccccatctgagaagccgtcccaggtttcatcaggcagtgaagaacaacttctaccacctgtatagctctgtcaaagcagtgaggttgcattttaattgtcttttcctatttctccagccatggggagaggcctggtatattgtaggtgcataaaaaatctctgttgaaagaatgaactgacactgcacaacaagackgtcacataaaaccacaggaatcactggatgcagatttcaagaatccctcaaaggctaaaatgcatccatatcctgtgtccctttccccttgcatcgtgtggtctgagggctagaaaagccatttaaacgtacttctaaaagtgcatacctttgccaaagcctctcacctcatcaatttatatctggaaacaaaggctttgccacagtcaggctgcacacacttgtacggccgctccctggagtgggaataattgtgaatcgtgaacttctccagggtgaggaacgtcttgccacataact

SEQ ID NO: 120023 - DNA, 601 bp, Human
ccttcctccagggtcactccaagatttcataatgtggtctatggtaataccagtcagatggaaaatctcacttgctaaagcctggctctctccaggcgtttgtatgtgaacagtcaaagttgaaacttcaaagtttatttcatgaaattaagggcaaatggtgcatttcccttaatcaagtatcaaaagcagcacgtgtgagtggacgcactatgtgtgtggctctgagtgtgcacagacacaacacacaccatgctcattaccagtcccagtaccgtgcagcacagccactgcatgtacmtggagtctttcctgtgatattaaaaagatccactggcggcagaaacgatatctaatgtattcatttccctcatggaagtaggtacctaacaggcactcaataaataacttagactaaatgtaattttttaaaaagactcatctgctaaaacagtgctttttatcctttggtgtgtcatgggtgcctttaaaactgatcaaatgcacatgctgctcatctgcatacccacctgaactccacttactagggtggctttccacccaagttgagaaactgtgttccaaacatttaaacttggag

SEQ ID NO: 120024 - DNA, 601 bp, Human
acaggcatcatcttttttttaaaagcaaaaccgaaagcatcctgccatctcacactcttccagtcctttactatatcactgcttcaggcaagagaggcgagaggcaagaaatgctgggggctgaggcagggaaggcggttcttgcataaagtacactgacagcttccctttttgcctctctttacacccttaactgaacaagccattttccttgctaagaacaactaccttctaaacatgacttaagacttctttttcagcgcagtttaccatagtaaattatttctcggaacatgcagggtactgattctacccctgtcatacccaaatacacatatactcaggtcctgcggtccaccctgtggaccacatgtgtatgaaaagtcagccttcggtatacacaggtttcacaccctgcaaatactgtactttcaatctgcatctggttgaaaaatatttgtgtataagcggacccgcgcagctcaaactcatgttgttcaagggtcaactgtaatcccaatagttctactccactaattcttcttttctaaacattgatctcttctatgtgtctcagtctttatctgcagttttagtgtcc

SEQ ID NO: 120025 - DNA, 601 bp, Human
attacaggcatcatcttttttttaaaagcaaaaccgaaagcatcctgccatctcacactcttccagtcctttactatatcactgcttcaggcaagagaggcgagaggcaagaaatgctgggggctgaggcagggaaggcggttcttgcataaagtacactgacagcttccctttttgcctctctttacacccttaactgaacaagccattttccttgctaagaacaactaccttctaaacatgacttaagacttctttttcagcgcagtttaccatagtaaattatttctcggaacatgcrgggtactgattctacccctgtcatacccaaatacacatatactcaggtcctgcggtccaccctgtggaccacatgtgtatgaaaagtcagccttcggtatacacaggtttcacaccctgcaaatactgtactttcaatctgcatctggttgaaaaatatttgtgtataagcggacccgcgcagctcaaactcatgttgttcaagggtcaactgtaatcccaatagttctactccactaattcttcttttctaaacattgatctcttctatgtgtctcagtctttatctgcagttttagtg

SEQ ID NO: 120026 - DNA, 601 bp, Human
cctacctcagcctcccgagtagctgggattacaggcgtgtaccaccacgcccagctaattttttgtatttttagtagagacggggtttcaccatggtggccaggattatctcgatctgttgacctcatgatccacccacctcggcctcccaaagtgctgggattacaggcatcatcttttttttaaaagcaaaaccgaaagcatcctgccatctcacactcttccagtcctttactatatcactgcttcaggcaagagaggcgagaggcaagaaatgctgggggctgaggcagggaaggcrgttcttgcataaagtacactgacagcttccctttttgcctctctttacacccttaactgaacaagccattttccttgctaagaacaactaccttctaaacatgacttaagacttctttttcagcgcagtttaccatagtaaattatttctcggaacatgcagggtactgattctacccctgtcatacccaaatacacatatactcaggtcctgcggtccaccctgtggaccacatgtgtatgaaaagtcagccttcggtatacacaggtttcacaccctgcaaatactgtactttcaatc

SEQ ID NO: 120027 - DNA, 601 bp, Human
gctttagtatgtcctagagtcagtacccaatgccaccatctttgggtatcatctggatcatgtcagtgattttagaattatttagaggttgattgctcacattaggacctccaaccttgccaaatcatcttttcttgcctgttgttgtctctaactggtttcattatatgctgtactgggacccacattctgttttctggttaagcaagtcagttattttttccttcaacctctgttgcctcatcatcctttttttgagatgcagtcccaccctgtcaccaggctgaagtgcagtggctcratgtcagctcactgcaacctctgcctcccgggttcaagcgatcctcctacctcagcctcccgagtagctgggattacaggcgtgtaccaccacgcccagctaattttttgtatttttagtagagacggggtttcaccatggtggccaggattatctcgatctgttgacctcatgatccacccacctcggcctcccaaagtgctgggattacaggcatcatcttttttttaaaagcaaaaccgaaagcatcctgccatctcacactcttccagtcctttactatatcactgcttcaggcaa

SEQ ID NO: 120028 - DNA, 601 bp, Human
ctcattccgtaaaagagataggatctctttaagacagtatgtttaagtcaaaagtatacttaattacacctttcagccaacatctgccctatactgtttattcctgccccttttgtggagccagaattggggaggggtctacaatagcagccgttgagtggaggcccccacctagaggccaactggaagccagttcaaaaaatataaagctaatctgaatcgaactgtcattttcttaaaaataaagtacaacctcatacctccttcctctgtcacaaaacaaacaaacaaaaacaaaaamggcctgctgtgtgcatcccttcccttccctccagtacaccacagcttgtttgcacataaatgataacatgatgggtaccgtaaggcagggacaggaaccaatacgatgggcatctgagaaaccagattgtgctggtgtttccacgttctaggtctatctaaataaatgcacaggttggagaaagggtttttagagcatgttagagggcaaatagccatgttgttctgcaggatatccatatgtatatatatatatcgcaggaatacatatgaaggggggagctggcttacacactcagta

SEQ ID NO: 120029 - DNA, 601 bp, Human
agcctcagcctctgcctgccgtgagatctcaccactgtcttgatttccttcattcaatgcttgactatcagctcttatctctgatgctgctgcctgtctctgttacttcaaattttccctctaagacacctttgacttacttcttaaaggtcactggtaatttaattggcaaaattcaaaaagactttcttctttaaatatgaagctgctacttctaataagagttgtaagtttgtcttcaacaatggcttcagggacaagccgtagtctgtctagtcaatttggaatttcaaaatagctmttttatatttgtgaagcagaaattagttatggaaagccatcacaattccatctttttcatagttccactgaattgctaacatctaaactcaccactggcttttaaaaactcagtggtataaggaaaccctgagtttgtcatccttaagctttaaaaaggttcattttaataactaaaatgcagagcattacatgttagcatgtcctatgaaacagaatccttcattacaacttgtagcttcatatccctcagggcagatacctcctttaggggttttgtcacgagaggttaaagcttgtc

SEQ ID NO: 120030 - DNA, 601 bp, Human
caaaatgttaatagttttctctgggtcttggtataattttcaaaattctttcatatattttccaaatatataaacttttataattaagaaaagcaagcaatactaaagccataatacatttttcacacctataaaacgttttttgagacaggatctgactcttttgcccaggctggagtgcagtggcacgatcatggctcactgcagcctcaacgtcctgggctcaagcaatcttcccaccttagcctctcaaatagctgaactacaggcacacaccaccaggcctggctaattttttttgtttttttttttttttttttgagacaaggtctcactatacccacgctggtctcaaactcctgggctcaagtgatcctcccgccttggcctccaaaagtgttgggattacagacaagagtcaccgtgcctggccagaatattcttaaagagaacatgtttttttaatgtatacagatttctgaacaaagtatgcaagtatttaaaaatacctgaccatgaaaaatctttttcaggaaggggttaaaggggtcttttgtactctggaaattcaagtgactcaatttgtctgctacccagaacc

SEQ ID NO: 120031 - DNA, 601 bp, Human
agagctgaagaaaggtgtagcaacaatattatatcaaaatgttaatagttttctctgggtcttggtataattttcaaaattctttcatatattttccaaatatataaacttttataattaagaaaagcaagcaatactaaagccataatacatttttcacacctataaaacgttttttgagacaggatctgactcttttgcccaggctggagtgcagtggcacgatcatggctcactgcagcctcaacgtcctgggctcaagcaatcttcccaccttagcctctcaaatagctgaactacrggcacacaccaccaggcctggctaattttttttttttttttttttttttttttgagacaaggtctcactatacccacgctggtctcaaactcctgggctcaagtgatcctcccgccttggcctccaaaagtgttgggattacagacaagagtcaccgtgcctggccagaatattcttaaagagaacatgtttttttaatgtatacagatttctgaacaaagtatgcaagtatttaaaaatacctgaccatgaaaaatctttttcaggaaggggttaaaggggtcttttgtactctggaaa

SEQ ID NO: 120032 - DNA, 601 bp, Human
gttacattgtaaaacgtaatcttcttttaataaaagctaataatgactgatgaattacaaatgcacttatttattggtgattacaaacaatacttaagaacttaagcagcttgagtagtagtttaagctagacagagcaaagaaaattcttgtttaatatatatatatttttaattccagtaatattttcttaaattcctgttaaaaatataatcaatattaaagtcagcaaaatgcctttgactgacgcctggattattttaccacttaacctggttacacagtgattttttttttttttctgtcagatgtaactgacaaccagtttagtctttctttaagataaatgaagtgataactcacattgcagcatcttgtggaaaatattcaaactacatttaaaatgcttctgtaaaatggagaactctattgctccacaagaaaatgtatatgtaaaactacaggttggctatggtaatagtaactaaactacatccaaccctgaaggtagaaaaatccctgaaaagaaatacacagcctagtcatagtatatcatataaaggttattttcttattttgaaaattctcccagatttggaga

SEQ ID NO: 120033 - DNA, 601 bp, Human; identical to SEQ ID NO: 120022

SEQ ID NO: 120034 - DNA, 601 bp, Human; identical to SEQ ID NO: 120023

SEQ ID NO: 120035 - DNA, 601 bp, Human; identical to SEQ ID NO: 120024

SEQ ID NO: 120036 - DNA, 601 bp, Human; identical to SEQ ID NO: 120025

SEQ ID NO: 120037 - DNA, 601 bp, Human; identical to SEQ ID NO: 120026

SEQ ID NO: 120038 - DNA, 601 bp, Human; identical to SEQ ID NO: 120027

SEQ ID NO: 120039 - DNA, 601 bp, Human; identical to SEQ ID NO: 120028

SEQ ID NO: 120040 - DNA, 601 bp, Human; identical to SEQ ID NO: 120029

SEQ ID NO: 120041 - DNA, 601 bp, Human; identical to SEQ ID NO: 120030

SEQ ID NO: 120042 - DNA, 601 bp, Human; identical to SEQ ID NO: 120031

SEQ ID NO: 120043 - DNA, 601 bp, Human; identical to SEQ ID NO: 120032

SEQ ID NO: 120044 - DNA, 601 bp, Human
gaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaamcctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaat

SEQ ID NO: 120045 - DNA, 601 bp, Human
gcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggytgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacatacctt

SEQ ID NO: 120046 - DNA, 601 bp, Human
gtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacytttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactc

SEQ ID NO: 120047 - DNA, 601 bp, Human
cttaatattatcacattggggtttaagtttcaacatatgaattttgggggacacatacattcagaccatagcataagccaagtaaggattttgagtgatcttttaggaagtgggactattttttcccatccttcttttcccctttgtccaaactaaatgaaaattttgcagtgaaaaaaggggaaagtctgaggaggaaaccaaagggctagacactaatgagatctgggaaagcagttctttcgtctcaaaattagccacagtatggaacgatgaaaagaaaggatgtcaggaatcaaaraatagataagacttattgtgtgttcatacctgatcatctaggaaacctaaaaatctccccaaatctcctagggccaggaacatggatttggaacgtcctcacagataggtcccatgtgatttggtcagataagaggagcaatctcacatttccttaactggcagagagtggaagttaaggaacagaaagcaaacggctctgaggatgttttgtaattgtgattagaagaatctagagaataaattagattggaccataaagttagtgagcagaatggggtctgggataacaaaaagctct

SEQ ID NO: 120048 - DNA, 601 bp, Human
cagagcacatccacagggcaggggctttgctccttcctcactatatatagtggtcatacaacctcttagaaaagaaaattctagagagaagtgaaagagaaacttctcgagctccctaagtgtaaatttgaagtgacaaagaatactgaaataattgagtttaacttgaattgtttatgactatctaacatgaggtggaaaaggagcttttgtgatatgttaaatcatagaaaagtcaagaagttacatgcctaccaagctctatttaaaaaaaaaacttttaggttcaggggtacacgascatgtttgctatataggtaaacatatgtcacaggagtttgttgtacagaatatttcttcgcccaggtattaagcctagtacccaatagttatttctcctaatcctcttcctcctcctttcctccatcctcaaggagaccccaatgtctattgttccctctttgtgtccatatgttctcatccttaagctccaacttataattgagaacatgcagtatttggttttctgtttctgtgttagtttgctaaggatgatggcctccagctccatccatgttcctgcaaaagacattatctcttt

SEQ ID NO: 120049 - DNA, 601 bp, Human
cagatattaactaaatagagtgaccatataatttactgtccaatctggatacttttgagaacaaaaggaggtcaatattaataagtacactgggacaacagttacaaatcacaacagcccagggcaaaattgggattcaggtcaatctaataaataatggcattgtagaccttcaataacagcaattcagtctctttcattgtattcctctgagagtagatagtttaaatccagcaatcaacttgcattgcggaaattctgtctctataatatcaatgtaatttcgacttgaattcccaamtaaaagtaaaaagtgaaagaagtttttgagcagttttctttaccatgtagaacaaagaaaagtgcctaattaagattttgaaaggtcaaaagttattattattaatttatcttaatttttactgaacgaaaataaatttgttacttatttgacattttttggaacaacattttacgaagtttactactttagcagaatataccatttcctaaattgacttcctttatgttctattaccactgtaaacttgccccctcactcctcccctgccctggcaactcattataactttaaaaagtt

SEQ ID NO: 120050 - DNA, 601 bp, Human
ggaaaattctaagtggagataacaaataagaaggaagatttaaatattaaaaaaccaagaaatcttggggcggggcaagaagtctactaggtagcatgaattatgtggaagatataaaactacagaatttggggaagttaactaaggatggaacagagagaaatggaatgggaatgtgaaaattctgttcctaagtccagtaatgctaccctaaaccaaaatattagagaagtagatgagcaattgagaagacttgagagtgaagggatgcatggtggatttcttaaggttttatttgtartatcatttttatgaaggaggaggaaaaacttctgtatatacaaaagtgctctatgtttctctccttttttaaatattcagactttgctcaggtttcataaaataatgttttcataaaatgtacagcaaaacaaagataaacttatactactcagatgaccttgttttaagagatgcttgtgccaaatatgaattacaagatgatcatgagatcatctgaatatcttgactggggctcaggataagaaaacaggggattgttggtgtaatgttttattagggctgccattacaatctccac

SEQ ID NO: 120051 - DNA, 601 bp, Human
tttctgcaaagagtctttcttccaaataagagtacattcacaggttcctggggttaggacatgggacatatctttttgggagccaccatccaatccaccacagatagtagcacttcttttttgatcatagtactcataaagatatactttcttttccatttccttttctaagagcccacatcaaaacactgtctaattcatgaagtactgatgtcggctaagaagagactttaattacctcctccagaaatcatctagaataaggaatagtcaaagttttattattctggttcgaatattmtgaaaataggacagaaaaatgaatcatcaaacaactggatattttcccctttaatatttcaagtatagatttcactccaagccagcatttgcaaataaatgccatttttatttttaaacaatttagaaaatattttatcacatacctttgagtgtaaataataaatgggttttggcaattgttcattagaattgagagatgtaaaataatttataatatttcattttgagttacgttcatcaattgttcacatttcctaaaatcaggacctcatggaaaaaataaaatttacctacaaaa

SEQ ID NO: 120052 - DNA, 601 bp, Human
gatgtaaaataatttataatatttcattttgagttacgttcatcaattgttcacatttcctaaaatcaggacctcatggaaaaaataaaatttacctacaaaagcttaaaaggcagatcagatttcacaaggatggattatccaaataaaagacacaatacacctttagatggaaagaaacaaacaagcctgaggctaccaagtttatagttaactggtggaaaaatagccattttctcacatgattatcagaaacacaagactgatcacaagtcagtgttgcaaattttatgaatacaawctttcctttttctccctctcttccttctaccctccctcccttcctctctccttccttcctttcctccctacctccctacctttctccatcctttctttcttccttccccgcttctttcccttttattgaggagtcagaaacatatataaagggtagattttatatagttaggggtatatttcaaggcacactgtttttgctattgtttttaatatctcagggtaaagtggttagttttcttccagggctgtgggaagtgaagtaagtgcatgatcacacctcatggtggcaaaacaagat

SEQ ID NO: 120053 - DNA, 601 bp, Human
aggcagatcagatttcacaaggatggattatccaaataaaagacacaatacacctttagatggaaagaaacaaacaagcctgaggctaccaagtttatagttaactggtggaaaaatagccattttctcacatgattatcagaaacacaagactgatcacaagtcagtgttgcaaattttatgaatacaatctttcctttttctccctctcttccttctaccctccctcccttcctctctccttccttcctttcctccctacctccctacctttctccatcctttctttcttccttccccscttctttcccttttattgaggagtcagaaacatatataaagggtagattttatatagttaggggtatatttcaaggcacactgtttttgctattgtttttaatatctcagggtaaagtggttagttttcttccagggctgtgggaagtgaagtaagtgcatgatcacacctcatggtggcaaaacaagatactagttttgctttctcagtacctcctctggtcaaagatttgttcacatcagcttatttagctacttttagacttggtatcattaacatgaaggtttgcttatttagagt

SEQ ID NO: 120054 - DNA, 601 bp, Human
atttccatatagattctggatattagacctttgtcagatgcatagtttgcaaatattttctccccttctgtaggttgtcttaaaaatttactttgttgatagtttcttgtgctgtgcagaagtcttttgtttacataggtcccaattgtcaatttttgttgcaattgcttttggcatcttcatcatgaagtctttgtccattcttatgtctagaattgtgttttctaggttatcttccagggtttttacagttttaggttttacatttaagtaattagtttatctcgagttgatttttgtrtatggtgtaaggaaggggaccagtttcaatattatgcatatgactagccagaattccagcaccatttattgaatagggagtcatttacctattgcttgtttttgccagctttgttgaagatcagatggttctacatgtgtggctttatttctgagtgctctgttccatttctttaatctatgtgtctgtttttgcaccagtaccatgccattttggttactgtagtcttgtagtatatttggaagtcaggtaatatgatgcctcagctttgttctttttgcttagaattgccttgactat

SEQ ID NO: 120055 - DNA, 601 bp, Human
ggaagatgctggcctcatagaatgagttagggtggagtctctcctcaagtttttggaatagtttcattagaaatggtaccagctcttcattacacatctggtagaatttgtctgtaattctttctggtcctgagctttttctggttggtaggctttttattactgattcaattttggaactcattattggtctgttcagggattccatttcttcctggttcagtcttgtgacattgaatgttttcagcagtttatccatttcttctaggttttctagcttgtgttcatagagatgtttttratagtctctgagggtttttttgtatttctatggggccaatggtaatttccttttcatcatttctcattgggcttatttggatctctctctctctctcttttattagtctatctagcagtctattaatcatatttattttttcaaaaagccaactcctgctggatttgttgatctttttatggtttcatgaatgtgtcagtttcactcagttcagctctgatttttattatttcttgtcttctgctcgctttggggttggtttgctattattttcctagttcctctagataacatgttggt

SEQ ID NO: 120056 - DNA, 601 bp, Human
gcagtttatccatttcttctaggttttctagcttgtgttcatagagatgtttttaatagtctctgagggtttttttgtatttctatggggccaatggtaatttccttttcatcatttctcattgggcttatttggatctctctctctctctcttttattagtctatctagcagtctattaatcatatttattttttcaaaaagccaactcctgctggatttgttgatctttttatggtttcatgaatgtgtcagtttcactcagttcagctctgatttttattatttcttgtcttctgctmgctttggggttggtttgctattattttcctagttcctctagataacatgttggttgtcaatttgagatctaacttttaggtgtgggcatctagcactaaaaacttttcccttaacactgctttagctgtgtccagagattctggtatgttgtatcatagttttcattagtttcaagtaatttcttaagttctgccttaatttcattgtttacccaaaagccattcagaaacaggttgtttaaatccctcgtaattgtatggttttgagcaatcttcttactattgatttctatttttatt

SEQ ID NO: 120057 - DNA, 601 bp, Human
aggggaaactgggtgggctggtgtgcattggtaaggattagtctgctggagctttccaacagtcaggcatggtcttctggcaaaggagctataacgtgagcccccaggaactgccctggttgggtaaccgaggctgcactgcaagtggatgtggtcaggctggggccccaggagatgccagtagatggaggggcactcagtcatgccctcatcccatgggcgtgactgctctgctctgtccaggtcctacagtcaccctgaggctaaagtctcctagagttcctagaggagcatggcaagytttgggggatgagcatcactggccatgctccgctgaagccattcccatgccaaatcttctgaactacacaggctagagccctgccgtgtcatttctctaagcagatctttctgccagctcaagtgtctgtgggggtcaggaggtcttcttctgctaggattccagaggtccatgataagtgtaggtcactcctcacctgtgtgaattaccccttcgccaggagtcactgggggccaggaatgagtcctggtgcttatctaccctgtgcagggttctcagctttctccccattcagcccag

SEQ ID NO: 120058 - DNA, 601 bp, Human
aaactgggtgggctggtgtgcattggtaaggattagtctgctggagctttccaacagtcaggcatggtcttctggcaaaggagctataacgtgagcccccaggaactgccctggttgggtaaccgaggctgcactgcaagtggatgtggtcaggctggggccccaggagatgccagtagatggaggggcactcagtcatgccctcatcccatgggcgtgactgctctgctctgtccaggtcctacagtcaccctgaggctaaagtctcctagagttcctagaggagcatggcaagttttgrgggatgagcatcactggccatgctccgctgaagccattcccatgccaaatcttctgaactacacaggctagagccctgccgtgtcatttctctaagcagatctttctgccagctcaagtgtctgtgggggtcaggaggtcttcttctgctaggattccagaggtccatgataagtgtaggtcactcctcacctgtgtgaattaccccttcgccaggagtcactgggggccaggaatgagtcctggtgcttatctaccctgtgcagggttctcagctttctccccattcagcccagcattt

SEQ ID NO: 120059 - DNA, 601 bp, Human
aagcagatctttctgccagctcaagtgtctgtgggggtcaggaggtcttcttctgctaggattccagaggtccatgataagtgtaggtcactcctcacctgtgtgaattaccccttcgccaggagtcactgggggccaggaatgagtcctggtgcttatctaccctgtgcagggttctcagctttctccccattcagcccagcatttgtgtcttccccgtgtccactctcaattccttccctctgaagatctacttgtaggatgccagtctgccccgtatcacagtctcttggtgggagaygttcctcctggctgcagctagtcagccatcctgaatcccgtcctatttctgtttctgaaccaccattatccttgcacttcctgtaaaaatgcatccatcagcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtg

SEQ ID NO: 120060 - DNA, 601 bp, Human
tccatgataagtgtaggtcactcctcacctgtgtgaattaccccttcgccaggagtcactgggggccaggaatgagtcctggtgcttatctaccctgtgcagggttctcagctttctccccattcagcccagcatttgtgtcttccccgtgtccactctcaattccttccctctgaagatctacttgtaggatgccagtctgccccgtatcacagtctcttggtgggagatgttcctcctggctgcagctagtcagccatcctgaatcccgtcctatttctgtttctgaaccaccattatycttgcacttcctgtaaaaatgcatccatcagcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtggatgacttaaccaataacctatcttggatctattcaacttcaaaatttaaaaacttcagtatctcattct

SEQ ID NO: 120061 - DNA, 601 bp, Human
aagtgtaggtcactcctcacctgtgtgaattaccccttcgccaggagtcactgggggccaggaatgagtcctggtgcttatctaccctgtgcagggttctcagctttctccccattcagcccagcatttgtgtcttccccgtgtccactctcaattccttccctctgaagatctacttgtaggatgccagtctgccccgtatcacagtctcttggtgggagatgttcctcctggctgcagctagtcagccatcctgaatcccgtcctatttctgtttctgaaccaccattatccttgcacytcctgtaaaaatgcatccatcagcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtggatgacttaaccaataacctatcttggatctattcaacttcaaaatttaaaaacttcagtatctcattctgtgaccat

SEQ ID NO: 120062 - DNA, 601 bp, Human
gtgtgaattaccccttcgccaggagtcactgggggccaggaatgagtcctggtgcttatctaccctgtgcagggttctcagctttctccccattcagcccagcatttgtgtcttccccgtgtccactctcaattccttccctctgaagatctacttgtaggatgccagtctgccccgtatcacagtctcttggtgggagatgttcctcctggctgcagctagtcagccatcctgaatcccgtcctatttctgtttctgaaccaccattatccttgcacttcctgtaaaaatgcatccatcmgcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtggatgacttaaccaataacctatcttggatctattcaacttcaaaatttaaaaacttcagtatctcattctgtgaccatagcctttaataagtaacaaata

SEQ ID NO: 120063 - DNA, 601 bp, Human
acttaaccaataacctatcttggatctattcaacttcaaaatttaaaaacttcagtatctcattctgtgaccatagcctttaataagtaacaaataagcaaacaaataaaataagtaaaagtattgattttaccaggattctcttttcaaacctcttcttttctttacatatccctccattgatttccccactccatgcccatgatttaaatatcatttatatgttcatgtctctcaatcccattctttataggtaagcaccagaatagaatgtttcacaacttagtggaagtctccagtrtgataaacccataggacttccaactaaagcattcaacactaatcttttcatctccctggcaaggttcccttcagacctggaatcctatatattgttagtggcataactaacaacctggtctcccagtataagcctaggaacttttgaattctctgacttctctactggacataagtaaattcatttttaccctatattgactatcctttctcttttccattctcctaactattgctatatgtaacttctaatgtgaatttctgaaaaaacttccacacacattgcttacaagtaatgatt

SEQ ID NO: 120064 - DNA, 397 bp, Human
attacaggtgtgagccgccatgcctggcccccatctttattatatcatgtcatttcagctgtcatttccattctgccattatataactttccctcaytttcaaaatccaccttaaaataaaaatcctcacaatggatttcaaaatatgcccccaatttacccttaaatgcattatttgaaatacctctgtattgatcttaagatgatcattgcttcttcatttcctattagatcttgccattccctaaattcttatcatcagtccttttccctctcatttcctgtattgtctcaaatcccatatctttgtcatttatattttgaagatgccaaataatttttatcttcaaaccagacacatgtttgaatccaataattttatgtttaacactgtggt

SEQ ID NO: 120065 - DNA, 525 bp, Human
attacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcmtattagatcttgccattccctaaattcttatcatcagtccttttccctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaacatttctccaatctttcaatattccattccagcaaatgaccaccgaatctgttta

SEQ ID NO: 120066 - DNA, 557 bp, Human
attacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcctattagatcttgccattccctaaattcttatmatcagtccttttccctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaacatttctccaatctttcaatattccattccagcaaatgaccaccgaatctgtttaattatccataagccagaaacatgggcttatac

SEQ ID NO: 120067 - DNA, 566 bp, Human
attacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcctattagatcttgccattccctaaattcttatcatcagtccytttccctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaacatttctccaatctttcaatattccattccagcaaatgaccaccgaatctgtttaattatccataagccagaaacatgggcttatacatatttaca

SEQ ID NO: 120068 - DNA, 570 bp, Human
attacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcctattagatcttgccattccctaaattcttatcatcagtccttttscctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaacatttctccaatctttcaatattccattccagcaaatgaccaccgaatctgtttaattatccataagccagaaacatgggcttatacatatttacaattc

SEQ ID NO: 120069 - DNA, 601 bp, Human
attatttgaaatacctctgtattgatcttaagatgatcattgcttcttcatttcctattagatcttgccattccctaaattcttatcatcagtccttttccctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaayatttctccaatctttcaatattccattccagcaaatgaccaccgaatctgtttaattatccataagccagaaacatgggcttatacatatttacaattccttttgccttcatattgaaacggttattgaaattgtaaggattcatgttccctttattttatcaagcttgttctgcctttcacttaacacctgagtcactgcattagccttttttacacacatctctgttccaggcttagtatccccaatctcaggcagtcagaagggtaagtaattaagattggatctgtagtggctgta

SEQ ID NO: 120070 - DNA, 601 bp, Human
cagacacatgtttgaatccaataattttatgtttaacactgtggtctctctccactgaagttttccaggtatactttattctcgttaaggctaaaattcgttcttatttttttctcaacatttctccaatctttcaatattccattccagcaaatgaccaccgaatctgtttaattatccataagccagaaacatgggcttatacatatttacaattccttttgccttcatattgaaacggttattgaaattgtaaggattcatgttccctttattttatcaagcttgttctgcctttcayttaacacctgagtcactgcattagccttttttacacacatctctgttccaggcttagtatccccaatctcaggcagtcagaagggtaagtaattaagattggatctgtagtggctgtaaaaactgagatgatcatccatctcaggtaggttacatatttatatttatgaatgaatgaatgggcttggattaaatgtaatcattttgctcctatgtctgtttatttttgaatgctctatttctagtatattctgaaattttcctcttatttgaaaacttttaaagtaaaaataagtcattt

SEQ ID NO: 120071 - DNA, 601 bp, Human
catattgaaacggttattgaaattgtaaggattcatgttccctttattttatcaagcttgttctgcctttcacttaacacctgagtcactgcattagccttttttacacacatctctgttccaggcttagtatccccaatctcaggcagtcagaagggtaagtaattaagattggatctgtagtggctgtaaaaactgagatgatcatccatctcaggtaggttacatatttatatttatgaatgaatgaatgggcttggattaaatgtaatcattttgctcctatgtctgtttatttttraatgctctatttctagtatattctgaaattttcctcttatttgaaaacttttaaagtaaaaataagtcatttttataatcacttaatatatgacagtagagatgcattttctatttcattcatgtatgttttagatttctatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgt

SEQ ID NO: 120072 - DNA, 601 bp, Human
tctcaggcagtcagaagggtaagtaattaagattggatctgtagtggctgtaaaaactgagatgatcatccatctcaggtaggttacatatttatatttatgaatgaatgaatgggcttggattaaatgtaatcattttgctcctatgtctgtttatttttgaatgctctatttctagtatattctgaaattttcctcttatttgaaaacttttaaagtaaaaataagtcatttttataatcacttaatatatgacagtagagatgcattttctatttcattcatgtatgttttagatttmtatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcatatgacatatttttgagctgaatgtatcaaatatctggctcattgaatcatgaattgtctgatcaggaaaggagaagaaaacaacccctactcctgacctagaa

SEQ ID NO: 120073 - DNA, 601 bp, Human
atttatatttatgaatgaatgaatgggcttggattaaatgtaatcattttgctcctatgtctgtttatttttgaatgctctatttctagtatattctgaaattttcctcttatttgaaaacttttaaagtaaaaataagtcatttttataatcacttaatatatgacagtagagatgcattttctatttcattcatgtatgttttagatttctatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcatatgacatatttttgagctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaata

SEQ ID NO: 120074 - DNA, 601 bp, Human
atttctagtatattctgaaattttcctcttatttgaaaacttttaaagtaaaaataagtcatttttataatcacttaatatatgacagtagagatgcattttctatttcattcatgtatgttttagatttctatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacaygaatccaagaacaaggtatgaaatcatatgacatatttttgagctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaatatttgaatataagagggtactctgacacacagttattatatagctggaaagaggattttgagagatcaatattgtagctttc

SEQ ID NO: 120075 - DNA, 601 bp, Human
tcttatttgaaaacttttaaagtaaaaataagtcatttttataatcacttaatatatgacagtagagatgcattttctatttcattcatgtatgttttagatttctatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcrtatgacatatttttgagctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaatatttgaatataagagggtactctgacacacagttattatatagctggaaagaggattttgagagatcaatattgtagctttcatcagcttattattgctatcaacaaa

SEQ ID NO: 120076 - DNA, 601 bp, Human
gaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcatatgacatatttttgagctgaatgtatcaaatatctggctcattgaatcatgaattgtctgatcaggaaaggagaagaaaacaacccctactcctgacctagaataattcatatcctgtggtaytaggaagatttaaaaaagaagaagaagacatgaattaacaaaaacaaaaaccactagactcttttaatatttgaatataagagggtactctgacacacagttattatatagctggaaagaggattttgagagatcaatattgtagctttcatcagcttattattgctatcaacaaacaattgttctgctttatcgagatgtttaagcattcttaaattattaggggcaataaagacaagcaaacataaagctaaacagaaaaataaatactcaaaatttcagctgtataagatctcaaaa

SEQ ID NO: 120077 - DNA, 601 bp, Human
ctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaatatttgaatataagagggtactctgacacacagttattatatagctggaaagaggattttgagagatcaatattgtagctttcatcagcttattattgctatcaacaaacaattgttctgctttatygagatgtttaagcattcttaaattattaggggcaataaagacaagcaaacataaagctaaacagaaaaataaatactcaaaatttcagctgtataagatctcaaaatttgttatgcattgtaaactgtcctatttgtaattacacttaagatcccagatcaattttattctgcatgtactttttgaaaaaagatcaaatatgtatattaagtacaaagttgcaaaagctaaaggttaaacttagttcattataagcctttactaaccctttattttctacctttccatatacaatttcct

SEQ ID NO: 120078 - DNA, 601 bp, Human
cctgattaattgcatttatgcgataggaaaaccatggaccctctcaacatctggacaaacagttcaatgaaagaactttcctcagttcagttctgtgtattcttttgtgttatgaataccttcaaaatataggttaatcaacatttattgagtactcactctgtaatgagcttaatgctaaggattatattattgcaaatgatattgttttatttcactgcctcctgttactcttatctgggtaccttagattttatctcttcacccactgacctgtacccagttggataaaatatccccyaaattttaatggccaaattgattcctccttctgctttaagatatggtgttcctctgccctaaaacttaccatttcagggacaaactgtttataacttagttgttgcaccagtttctgtgtatctaggagtaagaaataaagaaatcctagtaagttcctactctgggtctgctctctgctttatctaaactaaaactcagagaaaagaaaatacctacactgaagattcaagcagccaattaatatttttaatagatagagggctgtttgggtacccacaacacttattttcttacactc

SEQ ID NO: 120079 - DNA, 601 bp, Human
tctgccctaaaacttaccatttcagggacaaactgtttataacttagttgttgcaccagtttctgtgtatctaggagtaagaaataaagaaatcctagtaagttcctactctgggtctgctctctgctttatctaaactaaaactcagagaaaagaaaatacctacactgaagattcaagcagccaattaatatttttaatagatagagggctgtttgggtacccacaacacttattttcttacactccttatgagttatttttggaatttttcagtctgtgtattataattaatatgaayctatctttctaaaaatataattagatcagaatgaatttaaattgacctgaatttaaattgacaaggtttaaaatgtgcgatatttgtttctgtataatattttgaaaaggcatttggtgatgatgcctggatctgattttatgagcttttgatcttacaagattcactgctcatggatcacagctttgccagtattctgagtatttggagattttctagtcatctttctgttatagtttaattgtattgtagtctgagaaaatattttgtatgatttagattcttttaaatttgttaagc

SEQ ID NO: 120080 - DNA, 601 bp, Human
tcacagctttgccagtattctgagtatttggagattttctagtcatctttctgttatagtttaattgtattgtagtctgagaaaatattttgtatgatttagattcttttaaatttgttaagctagatccaggatgtgatctaccttagtaaatattctatataagcttaaatatgtgttttgctgtttttaaatagagtgttctataaacgtcaatttgataaaatggatcaatactgctcttcatttcaaccatatccttgttgattttttgcctgctccatgtcaattactgatgggagggtggggaattatccaactataatagcaaatttgtgtctttctcttttcagttctatcaggttttccctcaaatattttgatactgtgttgttaggtacataccagttaaggttgtgttcttcttggagaattgaccttttttatcattatgtagttacccttcttatccctgacaatttcccctttcctgatgtcttcttgtctgaaatatactttggctttctcttgattagtgatagtatactatcttcctccatccttttaatttgtcataatctttacatttaaaatgaatttc

SEQ ID NO: 120081 - DNA, 601 bp, Human
aatttgttaagctagatccaggatgtgatctaccttagtaaatattctatataagcttaaatatgtgttttgctgtttttaaatagagtgttctataaacgtcaatttgataaaatggatcaatactgctcttcatttcaaccatatccttgttgattttttgcctgctccatgtcaattactgatgggggggtggggaattatccaactataatagcaaatttgtgtctttctcttttcagttctatcaggttttccctcaaatattttgatactgtgttgttaggtacataccagttarggttgtgttcttcttggagaattgaccttttttatcattatgtagttacccttcttatccctgacaatttcccctttcctgatgtcttcttgtctgaaatatactttggctttctcttgattagtgatagtatactatcttcctccatccttttaatttgtcataatctttacatttaaaatgaatttcttgcagacagcatatagctggggcttgtaatttatctaggctaataattattgctattttaccgatgtcattagacatatttaaagtgattactcatatatttatgttaaa

SEQ ID NO: 120082 - DNA, 601 bp, Human
ggatcaatactgctcttcatttcaaccatatccttgttgattttttgcctgctccatgtcaattactgatgggggggtggggaattatccaactataatagcaaatttgtgtctttctcttttcagttctatcaggttttccctcaaatattttgatactgtgttgttaggtacataccagttaaggttgtgttcttcttggagaattgaccttttttatcattatgtagttacccttcttatccctgacaatttcccctttcctgatgtcttcttgtctgaaatatactttggctttctyttgattagtgatagtatactatcttcctccatccttttaatttgtcataatctttacatttaaaatgaatttcttgcagacagcatatagctggggcttgtaatttatctaggctaataattattgctattttaccgatgtcattagacatatttaaagtgattactcatatatttatgttaaaatgcaatatatttgtaacttttctttcattacgtttgttctttgttactagtctctacctcttgttctactttttttgttttaattattttatattattccattttatttggcaca

SEQ ID NO: 120083 - DNA, 601 bp, Human
atgtcaattactgatgggggggtggggaattatccaactataatagcaaatttgtgtctttctcttttcagttctatcaggttttccctcaaatattttgatactgtgttgttaggtacataccagttaaggttgtgttcttcttggagaattgaccttttttatcattatgtagttacccttcttatccctgacaatttcccctttcctgatgtcttcttgtctgaaatatactttggctttctcttgattagtgatagtatactatcttcctccatccttttaatttgtcataatcttyacatttaaaatgaatttcttgcagacagcatatagctggggcttgtaatttatctaggctaataattattgctattttaccgatgtcattagacatatttaaagtgattactcatatatttatgttaaaatgcaatatatttgtaacttttctttcattacgtttgttctttgttactagtctctacctcttgttctactttttttgttttaattattttatattattccattttatttggcacagtagttacacttcatttttacatatctgtaggtgaactaggttttataatatgca

SEQ ID NO: 120084 - DNA, 601 bp, Human
ttctcgtgcattttgaagctctgttattaagtgtaaacatatttgttaaacaaggtttacaggagggcattgttttgcactaacttcctgaactaggtctcatcaaaccaggccaaaccaaaatggtgtaacttatactatgtgcaaggaagtaggtagatccccaaatagaccagttttccctgaagacaggagattcatagcaaccaatcaaaaagagcccagtctacctgagtcagtgtgataagaactgtctcctttgcttcaaccttacaagaaaagtgacctgtagtaactttaygttaactgatctgctttctaaaattgttctgccttcttgctcctcccttacaaaaaccaaccattctggcatggcctgtggaatattcattctattttataaaatgaggtgtttcctgattccagaattaaaaataaaaaataattatatctttatgttaaatttgttgtaatattgtcttttgacacatttatgatggttattttttataaacttctcattatattgctagaaaatatccctttttacatacagtaatacattttactctgaagctcatcttatttgatattatgatat

SEQ ID NO: 120085 - DNA, 601 bp, Human
gtaagaagtaagtctaaaattataatgacccacatagttacaatgactatcttgtgattctaatgcttttagtaatcatttcgtgctcattagtacaaatgagaaagattccataccaagctaaaaatttaaaaactaagttttagtttaaaagaaatatttaaaaatcatttctcgttattactacattagatacattccaaatttaaaacaaacatacctaagaaaaaaagatctaaaccatttcataataagaaataaaacaagaattagaaaaacattttttatcactggctttcarataagttatatgctaacagcaattctttcttgttttaattatcatgatgaatttgggattactgtattaccatacagcctatccagtcagagcacacactttgcttaaaccttaccaactccataaagatttcactggcttcttcatctttccttcagacactttctgtctttaagaattatggtgaccttctccaattaagaattatatagtgttctgtattttttctttctattaattattatattttaagtggtgccatttttatagaaacattcatagcaagtagtatgtatgttg

SEQ ID NO: 120086 - DNA, 601 bp, Human
atcccacaacgtatatgtacttcaaaacatcatgctgtacacagtaaatacatacagttttatatgtcaatgaaaaaaataaatttgaaagaaaaaaaaactttgaattacttgattcaacatttgtttgtattaattaatcatgatttcctagtatagtgaagagcaatttagtgttgataattgagtcaagcacgaattatcaataaaataacatgaaaaattattagaatgctctaccaatgcaaaaatgaagctgttaccacccaaatccactgaaaaactttagcatctcagaaartaagacaattagtgttttgtgcttcctgatgaaattcagtatgaagtacatgggacaatctatgaggtagtctcattaaaatacttggcctgaatctaatcaaaattctaagattaacttccatgtacatgggaaaacacataataaggaaaaaaaatataaatgcaactaaaaaatagacagacacattaggatatggtacattcaaatggatggctaacagggtgagggggacaaatctggactgtaagaaagttaagagacacatcaaatataaatgcaataggtggtctttatgga

SEQ ID NO: 120087 - DNA, 601 bp, Human
tgctagtgcctcccttattaaaacttattgcagcttcacctctttctaagataattcaatagaaagccatggaacttctaacatttttgagtttgttttaaatcagaagcccacctctgaagttttgaaatagtgaatcaaaggggcttcaaactgttaatttatttttcttattttattctctcaacattctaattaaatgtatatgtaaacttgttcatctcaatcattgaggtaacaagatttttcttttattatctcttcattttattattattattactataaaagcagtagtggyggttacctgaattagctttggtacttggagtttctaagaaatgtgtctgaatacttcatttatatcctgtctaccctcttttgctattttccaaaatttgttaagttgctcacaaagtggctctcatatattgcttcatttaattcacatcctttaaaaatctgtaatatttcaaaatgtgctaatttccttcaaaagcttttgacccaccttaatggatttgatgatgaaaggggaaacactgcacatagcaagaaatggtatgaaaggaaaagcactggatatttcctgagtttggta

SEQ ID NO: 120088 - DNA, 601 bp, Human
cttattttattctctcaacattctaattaaatgtatatgtaaacttgttcatctcaatcattgaggtaacaagatttttcttttattatctcttcattttattattattattactataaaagcagtagtggtggttacctgaattagctttggtacttggagtttctaagaaatgtgtctgaatacttcatttatatcctgtctaccctcttttgctattttccaaaatttgttaagttgctcacaaagtggctctcatatattgcttcatttaattcacatcctttaaaaatctgtaatatttcaaaatgtgctaatttccttcaaaagcttttgacccaccttaatggatttgatgatgaaaggggaaacactgcacatagcaagaaatggtatgaaaggaaaagcactggatatttcctgagtttggtaataactagtgcaatttatttgcaatccctatgtattaaaacagtttggctcatccaagaaggtactgcagttctctagaattaagtcctgtcatgaaaccgcttggactcatttaatgcttattgattttcataaacaaacactgaattgttgggtggttaagacaaaa

SEQ ID NO: 120089 - DNA, 601 bp, Human
tatctttttttctgattataaattgaatttatatgtatttgaaaaaaatttttagaggaaggccttagaaagaaaatacaagtaacaattaaactcacaattccagggaaaaccaatgttaatatttgtgtgtacttcacagtaaactatataaaataaatgaataaaaatataggaatatttatagtaatgtacatacataaaagaatgctataccaacataattttttaaagttaaaattaggttagttatttttatcatgcttttacatttcaaaataaacaccaagtattttgatgygtcagttaatatcctttgaaaatataatttatactaattacttttccatataaaaatgaaatatcattaatttatttacccaaagttgagaatctttacatatttttactattataaataatgctatgatatttttcccataaatatttgattaaattacttaatattactctggaataatttcttaaaaggaaactctggatcttgaccatattgccacattttctctgcagtgtggggcttgatttatcattctatattctgtattagaaggcacctgtctccacatcctcactgact

SEQ ID NO: 120090 - DNA, 601 bp, Human
agtgaattaaggttgcagatggaatcaaggttgtgaatcagatgaccctaaaatagggagatttccctgtattataccgtgagtccaatgcaattccaaaggttcttataagcgaaggagggaaacagaagaggcagagtcaaaatgaagtgatatgagaatgatttgacctgctacctcaaaccacccttgaaaattgaaggaataagtctatgagccattaatgtgggtggcttctagaagctggaaaggaatgagaaacaggtttttcccttttaacctccaaaaagaaactcagtcytgctgacactttcgttttggccaatgaaactcattttagcctccagaactacagaactataaggtaatacatttgtgttgctttaagacactgagattgtggtaattttttacagcagccataggaaactaatagaaaagctaaaagaaaaataaacatgctatggtagtattaaaatctatattgttgccaaaacattccatgaaaatccctttcatagtgttatcttacgatccattttatttctgtggcatctgtagtaatgttgcctctttcatttctgatattgagtcttctttt

SEQ ID NO: 120091 - DNA, 601 bp, Human
cctatacttacctttattgtcaagtttcatactttcttatgctatggtgttgctgtttagtatcccatcatttcaacttgaagaactccttttagcattttttctaagacaggtaatatactattggtgatgatctctctcagattttgtttattttaagtagtttttaatctctcctccactattaaaggccaggtatagtgttcttggttggcagtttcttttcttttagaactttgaatgtatcatcccactccctctggcctgcaaggtttctgctgaaaattcagatagtttcatkgacattttcttttatatgacaagttacttttctctttatctcaaaatacactttgtttttgactttttacaatgtgattacaatgtgtctcaatgttgatttgtttgagttcatcttatttgggaacttttgggcttcatggatctgaatgtctattgccttcctcagatttgggaagtgttcagccattatttctttaaataggctttctggccccttctctcttctcctctgatacttccttaatgcttatattggtgtccttgaagaggtcctatcagtttcttaagttttctccac

SEQ ID NO: 120092 - DNA, 601 bp, Human
cccatctccattctcccacaggtgtctagactgtgccagacccattcgagctctaaaactagttagatagatgctagatcttcaggcagccattgaaaagttggagtgtcagatacacagatcagcactcttcctccacagcaggaagctgaaagctgagatttcttatctgcttactgtatgccaagaagttgggttatgggggggcagggtctgtggcatccaccagatgaaaccaccatctccatcctctgcagaaagctagattgtggtagaccagtcagagctccaactgacagamgtaattcgtgtataaaggccctttaaaaattttggagtactggacacaaatcaatctcttccaatgactgggtgaagctgggaactaggggttctctttctgattgtatggcagtacactggggacagggactccactgagaggatgttctgaatctccctaccaactttggtaactctgatttttcattttcccaggatgtggtagtcattcaattagcttcagaatttcttacaaagataatttgttcaaattgttgttgaaatatgttctggggagtaggacggtgcagaacttccc

SEQ ID NO: 120093 - DNA, 601 bp, Human
caggtgtctagactgtgccagacccattcgagctctaaaactagttagatagatgctagatcttcaggcagccattgaaaagttggagtgtcagatacacagatcagcactcttcctccacagcaggaagctgaaagctgagatttcttatctgcttactgtatgccaagaagttgggttatgggggggcagggtctgtggcatccaccagatgaaaccaccatctccatcctctgcagaaagctagattgtggtagaccagtcagagctccaactgacagaagtaattcgtgtataaagsccctttaaaaattttggagtactggacacaaatcaatctcttccaatgactgggtgaagctgggaactaggggttctctttctgattgtatggcagtacactggggacagggactccactgagaggatgttctgaatctccctaccaactttggtaactctgatttttcattttcccaggatgtggtagtcattcaattagcttcagaatttcttacaaagataatttgttcaaattgttgttgaaatatgttctggggagtaggacggtgcagaacttcccactctgccgttttgctga

SEQ ID NO: 120094 - DNA, 601 bp, Human
gccgttttgctgatgtcactctgtaggagatgcttgatcctatttaaactttctattttagaagatagttgcctttctatgtttagagtatttatattctggtgtgcttttgtgggctgagttccaaaaatgtttaattttgatagctctttcaatattattatactttactttgcttttttaattctgaaggggtttcagctcaatcattgctggtgccatctggggcagaaggccctttctaggccattcaagtcattgggccactttgacgcctgaagatggaaggaacaaaaacaaygaggctttggtcttcctatgtcatttgatagagggctaggaaatatcaagtttgatggataatacttctgtggctcattcaggctgcatttcactggccttattctacagcagggttgtatcagctaggtaggccttcactgatgcctctgaaggcagatcagttagctagttacctggttatcgaatgacggttaggttagtcatccagtgctgtgatgttgccaatatgggtggaatggacagcccaccagtgcactgaatgtggactgtgtttggtgggcctgccaagtctgaaatg

SEQ ID NO: 120095 - DNA, 601 bp, Human
agtatttatattctggtgtgcttttgtgggctgagttccaaaaatgtttaattttgatagctctttcaatattattatactttactttgcttttttaattctgaaggggtttcagctcaatcattgctggtgccatctggggcagaaggccctttctaggccattcaagtcattgggccactttgacgcctgaagatggaaggaacaaaaacaacgaggctttggtcttcctatgtcatttgatagagggctaggaaatatcaagtttgatggataatacttctgtggctcattcaggctscatttcactggccttattctacagcagggttgtatcagctaggtaggccttcactgatgcctctgaaggcagatcagttagctagttacctggttatcgaatgacggttaggttagtcatccagtgctgtgatgttgccaatatgggtggaatggacagcccaccagtgcactgaatgtggactgtgtttggtgggcctgccaagtctgaaatggccactgtgggtgaatcaacacacacatgtgtcctgactccctgactctaaagaaggggctggagcaactccccatgtctttgccg

SEQ ID NO: 120096 - DNA, 601 bp, Human
tatgtccatgagttttcagagtctttttgttgttgtccattgacttgtttcagagtattaaattgtatttagaacgaaggataaggaaaaactgaaactacaaaactttgttccagagcatgcatttatcatagatgttgaataatgttcttctttaaaaacataataaagtgtaaacatattttgagtaatacttatttcactccaagaacaatcagcttcaagtcaaccattatttattacataaagaattaaaccaggcattatatgagacactaatatttgtgaaagatgcaaatgmtgctcttgaggatcttcctgctgacaaggctagtgagaagaggaagttagcgaagaaacagaaaattaaataaatattgtgccatagaaaggtatatgataagaaccaaaaatttaaaataacataagaatggtttttaaaaatgtctcttagataatgttttcaactaatttatcatctgaaatggaatagaaaatctattaatgcttatgacaatttaacacgtgtaaattgaaactgtctcagaaattgaagatataagttcagcttacccttaaaaaattttgtttcaattattgt

SEQ ID NO: 120097 - DNA, 601 bp, Human; identical to SEQ ID NO: 120047

SEQ ID NO: 120098 - DNA, 601 bp, Human; identical to SEQ ID NO: 120048

SEQ ID NO: 120099 - DNA, 601 bp, Human; identical to SEQ ID NO: 120049

SEQ ID NO: 120100 - DNA, 601 bp, Human; identical to SEQ ID NO: 120050

SEQ ID NO: 120101 - DNA, 601 bp, Human; identical to SEQ ID NO: 120051

SEQ ID NO: 120102 - DNA, 601 bp, Human; identical to SEQ ID NO: 120052

SEQ ID NO: 120103 - DNA, 601 bp, Human; identical to SEQ ID NO: 120053

SEQ ID NO: 120104 - DNA, 601 bp, Human; identical to SEQ ID NO: 120054

SEQ ID NO: 120105 - DNA, 601 bp, Human; identical to SEQ ID NO: 120055

SEQ ID NO: 120106 - DNA, 601 bp, Human; identical to SEQ ID NO: 120056

SEQ ID NO: 120107 - DNA, 601 bp, Human; identical to SEQ ID NO: 120057

SEQ ID NO: 120108 - DNA, 601 bp, Human; identical to SEQ ID NO: 120058

SEQ ID NO: 120109 - DNA, 601 bp, Human; identical to SEQ ID NO: 120059

SEQ ID NO: 120110 - DNA, 601 bp, Human; identical to SEQ ID NO: 120060

SEQ ID NO: 120111 - DNA, 601 bp, Human; identical to SEQ ID NO: 120061

SEQ ID NO: 120112 - DNA, 601 bp, Human; identical to SEQ ID NO: 120062

SEQ ID NO: 120113 - DNA, 601 bp, Human; identical to SEQ ID NO: 120063

SEQ ID NO: 120114 - DNA, 397 bp, Human; identical to SEQ ID NO: 120064

SEQ ID NO: 120115 - DNA, 525 bp, Human; identical to SEQ ID NO: 120065

SEQ ID NO: 120116 - DNA, 557 bp, Human; identical to SEQ ID NO: 120066

SEQ ID NO: 120117 - DNA, 566 bp, Human; identical to SEQ ID NO: 120067

SEQ ID NO: 120118 - DNA, 570 bp, Human; identical to SEQ ID NO: 120068

SEQ ID NO: 120119 - DNA, 601 bp, Human; identical to SEQ ID NO: 120069

SEQ ID NO: 120120 - DNA, 601 bp, Human; identical to SEQ ID NO: 120070

SEQ ID NO: 120121 - DNA, 601 bp, Human; identical to SEQ ID NO: 120071

SEQ ID NO: 120122 - DNA, 601 bp, Human; identical to SEQ ID NO: 120072

SEQ ID NO: 120123 - DNA, 601 bp, Human; identical to SEQ ID NO: 120073

SEQ ID NO: 120124 - DNA, 601 bp, Human; identical to SEQ ID NO: 120074

SEQ ID NO: 120125 - DNA, 601 bp, Human; identical to SEQ ID NO: 120075

SEQ ID NO: 120126 - DNA, 601 bp, Human; identical to SEQ ID NO: 120076

SEQ ID NO: 120127 - DNA, 601 bp, Human; identical to SEQ ID NO: 120077

SEQ ID NO: 120128 - DNA, 601 bp, Human; identical to SEQ ID NO: 120078

SEQ ID NO: 120129 - DNA, 601 bp, Human; identical to SEQ ID NO: 120079

SEQ ID NO: 120130 - DNA, 601 bp, Human; identical to SEQ ID NO: 120080

SEQ ID NO: 120131 - DNA, 601 bp, Human; identical to SEQ ID NO: 120081

SEQ ID NO: 120132 - DNA, 601 bp, Human; identical to SEQ ID NO: 120082

SEQ ID NO: 120133 - DNA, 601 bp, Human; identical to SEQ ID NO: 120083

SEQ ID NO: 120134 - DNA, 601 bp, Human; identical to SEQ ID NO: 120084

SEQ ID NO: 120135 - DNA, 601 bp, Human; identical to SEQ ID NO: 120085

SEQ ID NO: 120136 - DNA, 601 bp, Human; identical to SEQ ID NO: 120086

SEQ ID NO: 120137 - DNA, 601 bp, Human; identical to SEQ ID NO: 120087

SEQ ID NO: 120138 - DNA, 601 bp, Human; identical to SEQ ID NO: 120088

SEQ ID NO: 120139 - DNA, 601 bp, Human; identical to SEQ ID NO: 120089

SEQ ID NO: 120140 - DNA, 601 bp, Human; identical to SEQ ID NO: 120090

SEQ ID NO: 120141 - DNA, 601 bp, Human; identical to SEQ ID NO: 120091

SEQ ID NO: 120142 - DNA, 601 bp, Human; identical to SEQ ID NO: 120092

SEQ ID NO: 120143 - DNA, 601 bp, Human; identical to SEQ ID NO: 120093

SEQ ID NO: 120144 - DNA, 601 bp, Human; identical to SEQ ID NO: 120094

SEQ ID NO: 120145 - DNA, 601 bp, Human; identical to SEQ ID NO: 120095

SEQ ID NO: 120146 - DNA, 601 bp, Human; identical to SEQ ID NO: 120096

SEQ ID NO: 120147 - DNA, 601 bp, Human; identical to SEQ ID NO: 120047

SEQ ID NO: 120148 - DNA, 601 bp, Human; identical to SEQ ID NO: 120048

SEQ ID NO: 120149 - DNA, 601 bp, Human; identical to SEQ ID NO: 120049

SEQ ID NO: 120150 - DNA, 601 bp, Human; identical to SEQ ID NO: 120050

SEQ ID NO: 120151 - DNA, 601 bp, Human; identical to SEQ ID NO: 120051

SEQ ID NO: 120152 - DNA, 601 bp, Human; identical to SEQ ID NO: 120052

SEQ ID NO: 120153 - DNA, 601 bp, Human; identical to SEQ ID NO: 120053

SEQ ID NO: 120154 - DNA, 601 bp, Human; identical to SEQ ID NO: 120054

SEQ ID NO: 120155 - DNA, 601 bp, Human; identical to SEQ ID NO: 120055

SEQ ID NO: 120156 - DNA, 601 bp, Human; identical to SEQ ID NO: 120056

SEQ ID NO: 120157 - DNA, 601 bp, Human; identical to SEQ ID NO: 120057

SEQ ID NO: 120158 - DNA, 601 bp, Human; identical to SEQ ID NO: 120058

SEQ ID NO: 120159 - DNA, 601 bp, Human; identical to SEQ ID NO: 120059

SEQ ID NO: 120160 - DNA, 601 bp, Human; identical to SEQ ID NO: 120060

SEQ ID NO: 120161 - DNA, 601 bp, Human; identical to SEQ ID NO: 120061

SEQ ID NO: 120162 - DNA, 601 bp, Human; identical to SEQ ID NO: 120062

SEQ ID NO: 120163 - DNA, 601 bp, Human; identical to SEQ ID NO: 120063

SEQ ID NO: 120164 - DNA, 397 bp, Human; identical to SEQ ID NO: 120064

SEQ ID NO: 120165 - DNA, 525 bp, Human; identical to SEQ ID NO: 120065

SEQ ID NO: 120166 - DNA, 557 bp, Human; identical to SEQ ID NO: 120066

SEQ ID NO: 120167 - DNA, 566 bp, Human; identical to SEQ ID NO: 120067

SEQ ID NO: 120168 - DNA, 570 bp, Human; identical to SEQ ID NO: 120068

SEQ ID NO: 120169 - DNA, 601 bp, Human; identical to SEQ ID NO: 120069

SEQ ID NO: 120170 - DNA, 601 bp, Human; identical to SEQ ID NO: 120070

SEQ ID NO: 120171 - DNA, 601 bp, Human; identical to SEQ ID NO: 120071

SEQ ID NO: 120172 - DNA, 601 bp, Human; identical to SEQ ID NO: 120072

SEQ ID NO: 120173 - DNA, 601 bp, Human; identical to SEQ ID NO: 120073

SEQ ID NO: 120174 - DNA, 601 bp, Human; identical to SEQ ID NO: 120074

SEQ ID NO: 120175 - DNA, 601 bp, Human; identical to SEQ ID NO: 120075

SEQ ID NO: 120176 - DNA, 601 bp, Human; identical to SEQ ID NO: 120076

SEQ ID NO: 120177 - DNA, 601 bp, Human; identical to SEQ ID NO: 120077

SEQ ID NO: 120178 - DNA, 601 bp, Human; identical to SEQ ID NO: 120078

SEQ ID NO: 120179 - DNA, 601 bp, Human; identical to SEQ ID NO: 120079

SEQ ID NO: 120180 - DNA, 601 bp, Human; identical to SEQ ID NO: 120080

SEQ ID NO: 120181 - DNA, 601 bp, Human; identical to SEQ ID NO: 120081

SEQ ID NO: 120182 - DNA, 601 bp, Human; identical to SEQ ID NO: 120082

SEQ ID NO: 120183 - DNA, 601 bp, Human; identical to SEQ ID NO: 120083

SEQ ID NO: 120184 - DNA, 601 bp, Human; identical to SEQ ID NO: 120084

SEQ ID NO: 120185 - DNA, 601 bp, Human; identical to SEQ ID NO: 120085

SEQ ID NO: 120186 - DNA, 601 bp, Human; identical to SEQ ID NO: 120086

SEQ ID NO: 120187 - DNA, 601 bp, Human; identical to SEQ ID NO: 120087

SEQ ID NO: 120188 - DNA, 601 bp, Human; identical to SEQ ID NO: 120088

SEQ ID NO: 120189 - DNA, 601 bp, Human; identical to SEQ ID NO: 120089

SEQ ID NO: 120190 - DNA, 601 bp, Human; identical to SEQ ID NO: 120090

SEQ ID NO: 120191 - DNA, 601 bp, Human; identical to SEQ ID NO: 120091

SEQ ID NO: 120192 - DNA, 601 bp, Human; identical to SEQ ID NO: 120092

SEQ ID NO: 120193 - DNA, 601 bp, Human; identical to SEQ ID NO: 120093

SEQ ID NO: 120194 - DNA, 601 bp, Human; identical to SEQ ID NO: 120094

SEQ ID NO: 120195 - DNA, 601 bp, Human; identical to SEQ ID NO: 120095

SEQ ID NO: 120196 - DNA, 601 bp, Human; identical to SEQ ID NO: 120096

SEQ ID NO: 120197 - DNA, 601 bp, Human
tattaagtttgattctcacaacagcttgtaagggatgcaaggcaagtataattaactgcatttactcattaggaaatcgaaccagagatgttaagtgacttgtccaaggtcacagttagtaagtcccggcttgaatccaggtctcttgatgcccagtcttctttcctctacaaaacacactgcaacttgggccctggacttcagtgacatttggaaacaatgattccagtgattacaggaccctaaatgaaagttctgttgcaaacgctaatgtgaaaaggcaactctattaactgcatgkagaagtaatcaatatctggcaaaatatctacctacacatgagtgtacagtataaaatgccatgattacatatattcacaaaggtcatcacaaatctgcgcagcactcaagtgacagttctccataatatgtcattcagagatcgccagaccctgagtatattgatgtcagtctaagaaaagactgccacttcccttaaaccaaacccagaagggaaaggcttgccccagaggatggtaaagacatggagcctaacaaggctctgcgggattacacgcaggttgcaaactcccagcgataa

SEQ ID NO: 120198 - DNA, 601 bp, Human
gaaattcataggttacaaaaagctttcacaacgattattaagtttgattctcacaacagcttgtaagggatgcaaggcaagtataattaactgcatttactcattaggaaatcgaaccagagatgttaagtgacttgtccaaggtcacagttagtaagtcccggcttgaatccaggtctcttgatgcccagtcttctttcctctacaaaacacactgcaacttgggccctggacttcagtgacatttggaaacaatgattccagtgattacaggaccctaaatgaaagttctgttgcaaamgctaatgtgaaaaggcaactctattaactgcatgtagaagtaatcaatatctggcaaaatatctacctacacatgagtgtacagtataaaatgccatgattacatatattcacaaaggtcatcacaaatctgcgcagcactcaagtgacagttctccataatatgtcattcagagatcgccagaccctgagtatattgatgtcagtctaagaaaagactgccacttcccttaaaccaaacccagaagggaaaggcttgccccagaggatggtaaagacatggagcctaacaaggctctgc

SEQ ID NO: 120199 - DNA, 601 bp, Human
cctgagtagctgggattacaggcatgcgccaccacgcccagctaattttctatttttagtagagacggggttttgccatgttggtcaagatggtctcgaactcctgacctcaggtgattcacccacctcggcaacgtgttgggattacaggcgtgagctaccgtgcccagcctaactttttaatttttttgtagagaccaggtctcattatgttcctcaggctgttaaaaggtaaattttaaaatagattgtgataaagctgtgacagaagcccaaaactttaccatttacaaatcacaayatcttttcaattttttctcccaaattatcctgggggaaaaaagcattcgaaatccaacaacaatttattatccactcagtctctagttaagcagcctactattaggtgactcaaagatgactgctcaccatatagaacggagggtgtccaatcttttggcttccctgggccacactggaagaagaattttctttggccacacataaaatacactaatgataaatgatgagctaaaaaaaaaattgcaaaaaaaacacaacaacccatgttttaagaaagtttacgaatttgtgttggggc

SEQ ID NO: 120200 - DNA, 601 bp, Human
aagaatttgccaacaaataaccaagtaaccagactattaattaggcataagtatatttagaagaaggcagtgtaagccccaacttcagtcttgatctctaagccagtctgtctttataatgacaaagaggttaaaaaaaattttttttcaacacacggtcttgctgttttgcccaggatggagtgcagtggcacagtcatggctcactgcagcctcaacctcccaggctcaagcaatcttcctgcctcagctgatcatcctgcctcagctctcgagtagctgggaccgcaggcgtgactamctcgcccagctaatttttatttatttatttatttattttttgagacagagtttcgctcttgttgcccaggctcgcgatcttggttcactgcaacctccgccttccaggttcaagtgattctcctgcctcagcctcctgagtagctgggattacaggcatgcgccaccacgcccagctaattttctatttttagtagagacggggttttgccatgttggtcaagatggtctcgaactcctgacctcaggtgattcacccacctcggcaacgtgttgggattacaggcgtgagctaccgtgc

SEQ ID NO: 120201 - DNA, 601 bp, Human
ataaataaaataggctgggtgtggtggctcatgcctgtaatcccacactatgggaggtggaagcaggaggatcacttgagtccaggagtttaagaccagcctgggcaacatactgagactatctctagaagaaatttaaaaattagctgggtgcatagctgtggtcccagctactcacgaggctgaggtgggaggacagcttgagcccaggagttaaaggctacagtgagtcatgttcatttcactgcactccagcctgggtgacacagtgagaccctgtctcaaaaaaaataaaaaattaaaaaaaaaaaaaaccagcttcaagtaatcttgaccatcctatagcatggataccatggtgctatccatggtgtctgggaacatgatgacaggaggaatagcatgccattcattataatgttcccgataatccttctaggtctaattgataaaccctactccacaaatgtagaattgcttctagttaccaaaagcacctatggatgatgtatgatatagatatccactggcaagtcaagactagcaaatattttcaaaatcagaagcaatgagatatcatagtttccttcaattcttttgg

SEQ ID NO: 120202 - DNA, 601 bp, Human
acctcagcctggacaacagagtgagaccctgaacctaaataaataaataaataaataaataaataaataaataaataaaataggctgggtgtggtggctcatgcctgtaatcccacactatgggaggtggaagcaggaggatcacttgagtccaggagtttaagaccagcctgggcaacatactgagactatctctagaagaaatttaaaaattagctgggtgcatagctgtggtcccagctactcacgaggctgaggtgggaggacagcttgagcccaggagttaaaggctacagtgagycatgttcatttcactgcactccagcctgggtgacacagtgagaccctgtctcaaaaaaaataaaaaattaaaaaaaaaaaaaaccagcttcaagtaatcttgaccatcctatagcatggataccatggtgctatccatggtgtctgggaacatgatgacaggaggaatagcatgccattcattataatgttcccgataatccttctaggtctaattgataaaccctactccacaaatgtagaattgcttctagttaccaaaagcacctatggatgatgtatgatatagatatccactggc

SEQ ID NO: 120203 - DNA, 601 bp, Human
ctcccctgaggtcacagttaaatccctggaagcccattcataaagcttcctccagttctctttcattatttaaaaaaaaaaaaaaaagctaaaagtaccaggaagatctaaaatatgtggcagcagcaattctcattagaatcagaatctctctgtaatcttttctggacaatacacaaaactttcacacttcaagaaacagtaacaaatttcaagaggaaataatgggcattttgctttgtcaagctatgtaaagaagtatttcttagtagcattcaagttccacagaggcagtcaaaakttgtgatgaaacaggaattaattttcagtttccaagtctggagctactggcattatttcatactactcctgctccttcccatcctatatgtaatccatctcggagagacctgtctctcagatttatcctcttctttcccacaccttctgcccctgcctcagtccaccagaccttcaccacttcacattttgtttcctgaaagtttcctggtctccctggttcccagttctattactcatcctgttcaacatgcctgaaaatgtgtttacttgtttaaccacatctttataccctgcttcg

SEQ ID NO: 120204 - DNA, 601 bp, Human
ctagcccagcatcttgcccacatttttggccacagtagtacattaggccacaggaggtagatacatggtcctcatgaacacttagtgcattatgtacaatgcacttctcccttgatttcaatcaagtttagaaccattattttgaaatcaaaaaataattacatcatccctaagttctacaattggcaaaaagcctttgctgtacaaggagatatttaacgctaatgcctgctagttaaaaagaattccaagtgaggagggcttagaagagaaatggagaatgcctgaggcatgaagagcyagggataagtttctgcaaagtttaggttgtatcagcacaaactcagactgatgttacaaccaagacagatggggaagaggaaccgttaaagggcaaaattaaccaaagggcatttcagaaggcatcaaaggcagacatcattaataaaggcaaagtggtcagtgtgtgaaggaaagattaaacaaaaatcatctaaactccttttatatccacttccgcctcccactgaaaatgaaactccacagccatgatctccaatgccaggcctttgtaataagtatctctattggttgggctaag

SEQ ID NO: 120205 - DNA, 601 bp, Human
atttctctagtttcatgtacatttgtcaagaagtagaaaccccaaccacacatgcaggattcctggccaggactatatgtttttgtatatgtgacaaaagatggacaaaacctatcttttttgtgcatccagtctccctctagcccagcatcttgcccacatttttggccacagtagtacattaggccacaggaggtagatacatggtcctcatgaacacttagtgcattatgtacaatgcacttctcccttgatttcaatcaagtttagaaccattattttgaaatcaaaaaataattayatcatccctaagttctacaattggcaaaaagcctttgctgtacaaggagatatttaacgctaatgcctgctagttaaaaagaattccaagtgaggagggcttagaagagaaatggagaatgcctgaggcatgaagagccagggataagtttctgcaaagtttaggttgtatcagcacaaactcagactgatgttacaaccaagacagatggggaagaggaaccgttaaagggcaaaattaaccaaagggcatttcagaaggcatcaaaggcagacatcattaataaaggcaaagtggtca

SEQ ID NO: 120206 - DNA, 601 bp, Human
aaaaaaaaaaacctctactgtattcccagctcaccttcatctttctaaactagagagttcgacacctttaatctgtctagcctcttcactgccctgatcattttacttctcctattctgaaatttctctagtttcatgtacatttgtcaagaagtagaaaccccaaccacacatgcaggattcctggccaggactatatgtttttgtatatgtgacaaaagatggacaaaacctatcttttttgtgcatccagtctccctctagcccagcatcttgcccacatttttggccacagtagtayattaggccacaggaggtagatacatggtcctcatgaacacttagtgcattatgtacaatgcacttctcccttgatttcaatcaagtttagaaccattattttgaaatcaaaaaataattacatcatccctaagttctacaattggcaaaaagcctttgctgtacaaggagatatttaacgctaatgcctgctagttaaaaagaattccaagtgaggagggcttagaagagaaatggagaatgcctgaggcatgaagagccagggataagtttctgcaaagtttaggttgtatcagcacaa

SEQ ID NO: 120207 - DNA, 601 bp, Human
tgtcaaagagtctactatagggctgggcacagtggttcacgccagtaatctcagcactttgggaggccgaggcaggcgtatcacatggtcaggagttcgagacccgcctggccagtactgtgaaaccccatcgctactaaaaatacaaaaattagccaggggtggtggcacatgcctgtagtcccagctactcgggaggctgaggcagaagaatcgattgaacacaggaggcagaggttgcagtgagctgagatcacgccactgcactccagcctgggtgacagagcgagactctgtctcaaaaaaaaaaaaaaacctctactgtattcccagctcaccttcatctttctaaactagagagttcgacacctttaatctgtctagcctcttcactgccctgatcattttacttctcctattctgaaatttctctagtttcatgtacatttgtcaagaagtagaaaccccaaccacacatgcaggattcctggccaggactatatgtttttgtatatgtgacaaaagatggacaaaacctatcttttttgtgcatccagtctccctctagcccagcatcttgcccacatttttggccacagta

SEQ ID NO: 120208 - DNA, 601 bp, Human
aggaaaaagaaataacaacaataatgacagtagctaacatttcttaaatatgtgccaggcattattctaagtgcttcccatgtactatctcatttaatcttcataacaaccctatgaagtaagtattatgccatcatacagatgtagaaactaagacacagagaaattaaatcaggtagggtagtatgaagaaggagggagcagatgacaatcgattttgaatatgctgggtttggggggcttgtgaagatgtccataaggcagttgtctgtagggatctaggtttgtaggaagagcaagyaggctggaaacaggtttggaagtcatcagcacagggctggcacctgactcttcaggactggatcaggccacagtgggagggagtgtaggtcaaggacagagcccaggaacatcaatatctaaggtgcaataggaggtaagtgagcttaagaagatgagaaagcagacagagagaaaggagaatgacagctataacagcaacaatagtaataactaatacttgtaagaatttactaaataccggtcactattctaagcatttcttaatatattataagtcagtcatcattaaaaccacata

SEQ ID NO: 120209 - DNA, 601 bp, Human
cacagtggctcacacctgtaatcccagcactttgggaggccgaggtgggtggatcatgaggtcaggagacggagaccatgctggtaaacaggttgcagtgagctgagatcgcaccagtgcactccagcctgggtgacagagccagactctgtctccacaggaaaaaaaaaaaagtattccagatgattgctacacatagtaaagtctgagaaactccagtgttgtgaaagatcaagccaagacagtaggtttagaaaaagatcgtaagtcttaatcaccaggctacagaataagctggccrggtgcggtggctcacacccgtaatcccagcactttgggaggccgagatgggctgatcacctgaggtcaggggttcaacaccagcctggccaatatggcaaaaccccatctctactaaaaatacaaaaattagcagggtgtggtgccatgtgcctataatcccagctactcaggaggctgaggcaggagaatagcctgaacccgggaggcagaggttgcagtgagccgagatggtgccattgcactccagcctgggcaacaagagcaaaactccatcttaaaaaaaaaaaagccatagttt

SEQ ID NO: 120210 - DNA, 601 bp, Human
ctgtgccatcctccttctctaatctcttggagaaaaaaaaaaagagcacaaaaaagctctaaggtcttttaatgagactattattccattaattatttgaggcagtttttgtttcactagaattaattaacataacccttctactttcagctccagctgcatctgatgtcactgctatggcagtgaagaatgaaaaccaaaggacaactggctacttaaggaattaagcggactaaaatgaaaaccattcacagcagttccagtactctggctgagactctgttttcctacatacagcccacacattctgaatatactcaaatctacgcaatttcaaacttagaaaactttaactgctgccccactgaagccattttcaagctggaatcatgtataataaactactccatctatttcaccaatatatacattttaaaataattaatttagcctctactcattcagatctattaaatttcaccactatgacagttatcttagaaaatcctcttaaacatagccaacagataaatcaaataagaatttttggaaatctttaaccttaaggacaatattaagaatctaggtcaagggtccccca

SEQ ID NO: 120211 - DNA, 601 bp, Human
aatctgtgccatcctccttctctaatctcttggagaaaaaaaaaaagagcacaaaaaagctctaaggtcttttaatgagactattattccattaattatttgaggcagtttttgtttcactagaattaattaacataacccttctactttcagctccagctgcatctgatgtcactgctatggcagtgaagaatgaaaaccaaaggacaactggctacttaaggaattaagcggactaaaatgaaaaccattcacagcagttccagtactctggctgagactctgttttcctacatacagcccacacattctgaatatactcaaatctacgcaatttcaaacttagaaaactttaactgctgccccactgaagccattttcaagctggaatcatgtataataaactactccatctatttcaccaatatatacattttaaaataattaatttagcctctactcattcagatctattaaatttcaccactatgacagttatcttagaaaatcctcttaaacatagccaacagataaatcaaataagaatttttggaaatctttaaccttaaggacaatattaagaatctaggtcaagggtccc

SEQ ID NO: 120212 - DNA, 601 bp, Human
gaggacttaagatggatcaatagcttaaaaaggtctcaagtgaacaatctgtgccatcctccttctctaatctcttggagaaaaaaaaaaagagcacaaaaaagctctaaggtcttttaatgagactattattccattaattatttgaggcagtttttgtttcactagaattaattaacataacccttctactttcagctccagctgcatctgatgtcactgctatggcagtgaagaatgaaaaccaaaggacaactggctacttaaggaattaagcggactaaaatgaaaaccattcacggcagttccagtactctggctgagactctgttttcctacatacagcccacacattctgaatatactcaaatctacgcaatttcaaacttagaaaactttaactgctgccccactgaagccattttcaagctggaatcatgtataataaactactccatctatttcaccaatatatacattttaaaataattaatttagcctctactcattcagatctattaaatttcaccactatgacagttatcttagaaaatcctcttaaacatagccaacagataaatcaaataagaatttttggaaa

SEQ ID NO: 120213 - DNA, 601 bp, Human
aaatgtttgcttgctaggtcaactgtatttaaactaaaatatgacagctgtaaataagccaataaaataggggccatttttagattctgacaagccaaagatcaggcactgctctcttgaaaactgtcaccaaaggcaaagagagagcagcctcaagaggaaataagagaaaatcactacatggcctgaatgattcacgttgaaatcagaggcatcagatgaggacttaagatggatcaatagcttaaaaaggtctcaagtgaacaatctgtgccatcctccttctctaatctcttggagaaaaaaaaaaagagcacaaaaaagctctaaggtcttttaatgagactattattccattaattatttgaggcagtttttgtttcactagaattaattaacataacccttctactttcagctccagctgcatctgatgtcactgctatggcagtgaagaatgaaaaccaaaggacaactggctacttaaggaattaagcggactaaaatgaaaaccattcacagcagttccagtactctggctgagactctgttttcctacatacagcccacacattctgaatatactcaaatctacgcaatt

SEQ ID NO: 120214 - DNA, 601 bp, Human
tttgtcccatacttgtaacacacaaatgtttgcttgctaggtcaactgtatttaaactaaaatatgacagctgtaaataagccaataaaataggggccatttttagattctgacaagccaaagatcaggcactgctctcttgaaaactgtcaccaaaggcaaagagagagcagcctcaagaggaaataagagaaaatcactacatggcctgaatgattcacgttgaaatcagaggcatcagatgaggacttaagatggatcaatagcttaaaaaggtctcaagtgaacaatctgtgccatyctccttctctaatctcttggagaaaaaaaaaaagagcacaaaaaagctctaaggtcttttaatgagactattattccattaattatttgaggcagtttttgtttcactagaattaattaacataacccttctactttcagctccagctgcatctgatgtcactgctatggcagtgaagaatgaaaaccaaaggacaactggctacttaaggaattaagcggactaaaatgaaaaccattcacagcagttccagtactctggctgagactctgttttcctacatacagcccacacattctg

SEQ ID NO: 120215 - DNA, 601 bp, Human
gattttgtagctagttttatgaaaactttgataaaattacaacaaacattgttagggttttataaggaaaaaaaaaaaaagtagaactaacctgacaaaacaaaccaccaaaaaaggcatcacaacacacaatgtacaaacaacaaaagtagaaacataaatatacatctatattagtcctatgtgttctaaatccctcctttgtttcatctactgtgagtttgctacctccatagcacactggccaagattacttgtaggcataccattggttccctgaattattgggctattattcccygcctcacccccaccccctgccaaaacattaaccctgtttactccacacatagctggtaacacacatgtggttaattatacccaaatctctagtctcaaactactgtacttagctttttattttaggtttttatgcttccctttttcttttactgtctttttctttacatctttattattatgttcccagaaatttagctcctgaacatacataagatccttgcatattttcaacaatacaatgaaatccgtaccttcttatctaccaaaaaaaccgtaagccgtatgttatacgttattt

SEQ ID NO: 120216 - DNA, 601 bp, Human
gctgcactccagcctgggtgacagagcgagactctgtctcaaaaaaataataataataaaatgaaaattagctgggcgtggtggcacacacctgtaatcccagctactcaggtggctgaggcgtgggaatcacttgaacctgggaagtggaggttacagttagccgagatcgcgccattgtactccagcctgggcaacagagtgagaccctttctcaaaaaaaaaaaaaaaaaattcagtcccttggccagatgcagtggctcatgcttgtaatccagcaatttgggaggacaaggagggyggatctcttgaggtcaggagttcaacaccagcctggccaacatggtgaaaccctgactctactaaaaatacaaaattagccggcgtggttgcctgcacctgtaatcccagatacacaggtggctgaggtgtgacaatcacttgaacccgagagggggaggtggcagtgagccgagattgtgccactgcactccagcctgggctatagaatgaaacgctgtctcaaaataaaaaaaagaattcagattctgtctttctgctctaccttcttagcttgttaacttttcattctgaggcttgt

SEQ ID NO: 120217 - DNA, 601 bp, Human
tactaaaaatacaaaaaattagccgggcatggtggcaggcacctgtagtcccagctacttgggaggctgaggcaggagaatgacgtcaacccgggaggctgagcttgcagtaagccaagactgcgccgctgcactccagcctgggtgacagagcgagactctgtctcaaaaaaataataataataaaatgaaaattagctgggcgtggtggcacacacctgtaatcccagctactcaggtggctgaggcgtgggaatcacttgaacctgggaagtggaggttacagttagccgagatcgcrccattgtactccagcctgggcaacagagtgagaccctttctcaaaaaaaaaaaaaaaaaattcagtcccttggccagatgcagtggctcatgcttgtaatccagcaatttgggaggacaaggagggtggatctcttgaggtcaggagttcaacaccagcctggccaacatggtgaaaccctgactctactaaaaatacaaaattagccggcgtggttgcctgcacctgtaatcccagatacacaggtggctgaggtgtgacaatcacttgaacccgagagggggaggtggcagtgagccg

SEQ ID NO: 120218 - DNA, 601 bp, Human
taatttcctaactactttttttccacaagggtcctatgtattttctcacttctaagaggtattatctacctctactttaactttccataccaaatgaacaaatttaccaaacattttaccattaatctaaaacttaacaggaatgggttagcacatgatcgacattgctttaccatcaacttcacataagtgttcagaaaccaggcggaagtgaaaccctaagttgaaggagcttttaacgcttgcatgaaaattttctagaccttcaaaggctgttgctgctgtttctccttctcctttktttttttttttttttgcctttttaaatatcttgttctcttctttcccccactgaaattcaagaatttgcagataccataaacttgggatatcctagaaacaaccatggttagaaaactgatatgtttctacacactcatcctttaattgatgtcctccacccactcactcttactcatacccagctagcttctcccatattattgaaacttcaatccttgcctctgtcatgttcaggtttctaagcctggggaagataacactttaaaatgccgtaagtacagtgggaaaggactgagga

SEQ ID NO: 120219 - DNA, 601 bp, Human
gtctcctgatatggtcaaattttcttaatttcctaactactttttttccacaagggtcctatgtattttctcacttctaagaggtattatctacctctactttaactttccataccaaatgaacaaatttaccaaacattttaccattaatctaaaacttaacaggaatgggttagcacatgatcgacattgctttaccatcaacttcacataagtgttcagaaaccaggcggaagtgaaaccctaagttgaaggagcttttaacgcttgcatgaaaattttctagaccttcaaaggctgktgctgctgtttctccttctcctttttttttttttttttttgcctttttaaatatcttgttctcttctttcccccactgaaattcaagaatttgcagataccataaacttgggatatcctagaaacaaccatggttagaaaactgatatgtttctacacactcatcctttaattgatgtcctccacccactcactcttactcatacccagctagcttctcccatattattgaaacttcaatccttgcctctgtcatgttcaggtttctaagcctggggaagataacactttaaaatgccgt

SEQ ID NO: 120220 - DNA, 601 bp, Human
cagtatgtgtcttttgtgactggcttatttcacatggcataatgtcatcaaggttattcatgttgaggcatctttcagaatttccttcctttttgaggctgaataatgttccattgtataaatacacgacattttgtttatccattcatccaccaatggacactgggttgcttccatcctttggccattgtgaataatgctactgtgaacacagatgtacaagtatctctttgagaccttgctttgaattcttttgggtatattcccagaagtgagattgctggatcatatggtaattatmagtttaatttttttagggggccgggcacagtaggtcacacctgtaaccccagtgctttgggagaacaaggcagggggatcgcttgggtgatcagaggattttgagggttacagtgagctacaatcacccctctgcacttcagcgtaggtgacagaggaatactgcctcttaaaaataaaaaataaaataaataaaaatttgaggaactgacatactgttttccatagtggctgcattttacattatcaccacccgtgcacaagagttccaatttctccacatcctcttcaacatttgtat

SEQ ID NO: 120221 - DNA, 601 bp, Human
tttacaatctttatcatttttaagtatacacttcagtggtggtattaaatacatttgctttgttgtgtaaccatcaccaccgtctgtccacagaactttttcatcttccaaaaccgaaactccatatccattaaatgaacgccccattttccccctccctcagccactaggagcaactatgctactttgtctctaccgattgtactactttaggtacttcatgtaagtagaatcacacagtatgtgtcttttgtgactggcttatttcacatggcataatgtcatcaaggttattcatgtkgaggcatctttcagaatttccttcctttttgaggctgaataatgttccattgtataaatacacgacattttgtttatccattcatccaccaatggacactgggttgcttccatcctttggccattgtgaataatgctactgtgaacacagatgtacaagtatctctttgagaccttgctttgaattcttttgggtatattcccagaagtgagattgctggatcatatggtaattatcagtttaatttttttagggggccgggcacagtaggtcacacctgtaaccccagtgctttgggag

SEQ ID NO: 120222 - DNA, 601 bp, Human
taattgtacaataaagaaaaatcaacaaaaccaaaaattaattatttaagaagactaataaaattataaaacactagtttgtacagatataatctatgtaaacaattccctattgctggacatctacgttatctccacttggatacactattccacagcactgacataatcatccttccaatattcattcatgcttatttcctgaaaataaatcttaaaattatgactgttagctcaaagggtgtaaaaaattctaaggcttctgatacatatattgtgttaaactgccctatagaaagaytgaacgaattttactcccactagcagtttgtgatagtgttcatttccctaagaaataagtgtgattttaaaaaatatttattaatttgtttggttaaaaaaaaacctcttcattttaatgtgcatttcttacattactgagttgaacacttcctcaatgtttacaggctaagtttcttttgtgaattgccttagtgttttctattcttctattaaggtgttagtctttctcacagatattattactttttatatattgatattgagccctgaaccaaagaattaaaaatattttcctgtt

SEQ ID NO: 120223 - DNA, 601 bp, Human
tcttgagagagaatcccttgttttcattcaaaaactctacctctagtcttattttataattttatctgttatacagtttccaagttcatctgagtttaagttagaaaattcatgttgtcctcagggtggggaacatcacaccccagggcctggcgtggggtgggaggcagggggagggatagcattaggagaaaaacctaatgtaaatgatgagttaatgggtgcagcaaaccaacatggcacatgtgtaacaaacctgcacattgtgcacatgtaccctagaacttaaagtataattttwaaaaaaaagagaaatgaaaaaaaaaagaaaattaatgttgtcctaagtagcataaactggcctgagttaagctaaggcaggcaaagaagattataaggatataggtcccttcatgaagtccaagaacaggaacagtgcttcagacaggactggaagcagggcttagatggctcatcatccctcttggtttctcatctctgctcatttgtgtatatctgccccctgtgctttctaggccacatgactggtaaaagatgcccactgcatagctcctgagcttcaagtttacaggtgtaacta

SEQ ID NO: 120224 - DNA, 601 bp, Human
gttttactcttctccttactttgtgaatgtttcaaaaacttttcaaaataaaaagtttaaaaagctaaactaaaaagtataaatgacacttaataacaaataatatttaacaatttctctttcttaaaacgcaaaactctctggggaaagatgagataaatcagtaacaactgcccatgggaggaggcattatagcaagatttccacagcaagcagttgtcaatagcataactaaatttagaaccttaacttatcttctacatggcgtgtacatgcaccattagaccaaagtgtaaaagtraaactgcagagaatgaagataaaccttccttataccacatagaaaaattaactcaaaatggaccaaagacctaaatgttaagagctaaaactgtaagactcttagaagaaaatacaggaggaaaacttcatgatactgaatttggcactgatttcttggagctgacaccaggagcacaggcaataaaagaaaaaggtaaataaatttaaaacctctctgcatcggctgggcgcggtggctcatgcctgtaatcccagcactttgggaggccggggcgggcggatcacgaggtcaggagat

SEQ ID NO: 120225 - DNA, 601 bp, Human
aagctgcgggcttggggggatttgttttactcttctccttactttgtgaatgtttcaaaaacttttcaaaataaaaagtttaaaaagctaaactaaaaagtataaatgacacttaataacaaataatatttaacaatttctctttcttaaaacgcaaaactctctggggaaagatgagataaatcagtaacaactgcccatgggaggaggcattatagcaagatttccacagcaagcagttgtcaatagcataactaaatttagaaccttaacttatcttctacatggcgtgtacatgcaycattagaccaaagtgtaaaagtaaaactgcagagaatgaagataaaccttccttataccacatagaaaaattaactcaaaatggaccaaagacctaaatgttaagagctaaaactgtaagactcttagaagaaaatacaggaggaaaacttcatgatactgaatttggcactgatttcttggagctgacaccaggagcacaggcaataaaagaaaaaggtaaataaatttaaaacctctctgcatcggctgggcgcggtggctcatgcctgtaatcccagcactttgggaggccggggcg

SEQ ID NO: 120226 - DNA, 601 bp, Human
cacatttgatcagaaatgtctatgtttaccttaaacatatgagtgaaataataaaatggttgtgatttgccttaaaatctttcagaagaagaaaatgttgggaaaaagaagaaatgaagcaaatgtgcagaaggctgttatttgttgaagctgcgggcttggggggatttgttttactcttctccttactttgtgaatgtttcaaaaacttttcaaaataaaaagtttaaaaagctaaactaaaaagtataaatgacacttaataacaaataatatttaacaatttctctttcttaaaackcaaaactctctggggaaagatgagataaatcagtaacaactgcccatgggaggaggcattatagcaagatttccacagcaagcagttgtcaatagcataactaaatttagaaccttaacttatcttctacatggcgtgtacatgcaccattagaccaaagtgtaaaagtaaaactgcagagaatgaagataaaccttccttataccacatagaaaaattaactcaaaatggaccaaagacctaaatgttaagagctaaaactgtaagactcttagaagaaaatacaggaggaaaacttca

SEQ ID NO: 120227 - DNA, 601 bp, Human
aagtagatcacctgaggtcaggagttcaagaccagcttggaccacatggtgaaaccccgtctctgctaaaaatataaaaattagccgagcatggtgacaggtgcctataatcccagctactcaggaggctgaggcaggagaatcactggaacccaggaggcaggggttgcagtgagccaagatcatgccactgcactccagcctagatgacagaacgagactccgtctcaaaaaaaaaaaaaaaaaagttttacactatgacatttcctggtttcaattttgcattatccttggctgactraggaaaccagcatacttgtacggccggcgttcctgatgcccctcactcactaccctcaatccctaccccacattcccagacagctttatttcagtctgctgagatgacctatccaccaagagcccattctttgggctccagcagtacctgacaatagcaacataaacactaagatgaaagctttctaattctgggtgaggcctctgattatctctcatttcaatggccatgtatttgtgaattcttaacttctacatagtacttctgtagcaaaaagttcctttactttattgaacttta

SEQ ID NO: 120228 - DNA, 601 bp, Human
ggagtgcggccaattctaaaggccaagggtgtacacctgcctgaccacatcatgcccactggaatcatcaaaggcttacaactgaggctctatagaagattcccacgaggatacacccatgtcataggcacacgggtgaaggaaacactcagagctagaaatgtcagcataagggatatgggctttcttaagaaaagaatgagtatttgtgttatgtacaaatgcttcttaaatatctttttagaagactctgtgatacaagttttacgttgatactaaaaatttggaagctttcaaagargagaaataggtcatacgacacaaaattatttcctgggggatgtatggaacactgtgctaaaatgggtactagggccgaagcagcagctcactcttgtaatgccaacactctgggaggccagggtgggaggatcgcatgagtccaggagttcgagaccagcctgggcaacatagggaaaccttgtttctacaaaaaataaaaaagttagctgcacatgatgacacacacccgtagttccagctactcagggggctgaggtgggaggattgcttgaggacaggaggtcaagactgcagtgag

SEQ ID NO: 120229 - DNA, 601 bp, Human
actaaaggcaaagaggagtgcggccaattctaaaggccaagggtgtacacctgcctgaccacatcatgcccactggaatcatcaaaggcttacaactgaggctctatagaagattcccacgaggatacacccatgtcataggcacacgggtgaaggaaacactcagagctagaaatgtcagcataagggatatgggctttcttaagaaaagaatgagtatttgtgttatgtacaaatgcttcttaaatatctttttagaagactctgtgatacaagttttacgttgatactaaaaatttgraagctttcaaagaggagaaataggtcatacgacacaaaattatttcctgggggatgtatggaacactgtgctaaaatgggtactagggccgaagcagcagctcactcttgtaatgccaacactctgggaggccagggtgggaggatcgcatgagtccaggagttcgagaccagcctgggcaacatagggaaaccttgtttctacaaaaaataaaaaagttagctgcacatgatgacacacacccgtagttccagctactcagggggctgaggtgggaggattgcttgaggacaggaggtc

SEQ ID NO: 120230 - DNA, 601 bp, Human
ccccgactttcattctctctccactacactgtatcttccttattcaaacctcagctcaaatgttaccttctcagagaggctgtgtttttaaatgagtagttttattttcttcccattttaaaagagattagacttattaataaattctagaaatcagacttttccagttgaaaacaagagactcttggggattttttgttttaatattgttgtcactaaggtaaaagtctttaaaaagaggagaaataaaggaaaggaaataacacacaggcagagaaaaagaaagactatgttacaaagragagcagtattacactttctcctttgttgcttcactaaaggcaaagaggagtgcggccaattctaaaggccaagggtgtacacctgcctgaccacatcatgcccactggaatcatcaaaggcttacaactgaggctctatagaagattcccacgaggatacacccatgtcataggcacacgggtgaaggaaacactcagagctagaaatgtcagcataagggatatgggctttcttaagaaaagaatgagtatttgtgttatgtacaaatgcttcttaaatatctttttagaagactctg

SEQ ID NO: 120231 - DNA, 601 bp, Human
ggaggtcaaagagccacgtccattttaatcctaatagccctatcgctgagcattattacctcagttttacagatgaaaaaactcaggttgagtgagtcaaagtagcttggtcaagatgacatgtctagttaagtggtggagccaggatttgaccaaagaatgtctggccccgactttcattctctctccactacactgtatcttccttattcaaacctcagctcaaatgttaccttctcagagaggctgtgtttttaaatgagtagttttattttcttcccattttaaaagagattagacktattaataaattctagaaatcagacttttccagttgaaaacaagagactcttggggattttttgttttaatattgttgtcactaaggtaaaagtctttaaaaagaggagaaataaaggaaaggaaataacacacaggcagagaaaaagaaagactatgttacaaaggagagcagtattacactttctcctttgttgcttcactaaaggcaaagaggagtgcggccaattctaaaggccaagggtgtacacctgcctgaccacatcatgcccactggaatcatcaaaggcttacaactgag

SEQ ID NO: 120232 - DNA, 601 bp, Human
cactacaaatgattttcatttctaaacaattttcaactaacttcttaatcccttaaattatccttctctactaaagatctgtaaatgacagaacacaaatctttaaaagagaataaagaattcactatgtaaaaaaaaaaaaaaaaaaacaagactgtcaggtgattaatcacttctaatgacaaaaaatgttttagggtattgaatttgaacaaagtagtatatattctcaaatactattggaattaaggggacaattagaatcctagagagttcaagttttccgtcacatgagttaagyagcctaagtcagttgatctctgcacgagacctctgattagatcatgagatactgaattctagaataacaaggtctctttttagaaatccttactctaggtagtactagatgaatgttattaaaatgaaataaaaacatgaatcagcataatatttacccttttaaaaaaaagattaagtaacctcttgtatggataatatagtttctactatgctaatgtaatttttcacatcatagccagaaaggagtgggttttacatagactgttaaaaaagataataacataaacatacacttttg

SEQ ID NO: 120233 - DNA, 601 bp, Human
atccgcccgccctggcctcccaaagtgctgggattacaggtgtaagccaccgcacccagcctcaatgttgtctttttaagtaaactgtctgttcttttgaataattacaaaaaacagtaaggcagagttaataattacagaactttcaatagctaggaagtatgtaagtcactacaaatgattttcatttctaaacaattttcaactaacttcttaatcccttaaattatccttctctactaaagatctgtaaatgacagaacacaaatctttaaaagagaataaagaattcactatgtaaaaaaaaaaaaaaaaaaacaagactgtcaggtgattaatcacttctaatgacaaaaaatgttttagggtattgaatttgaacaaagtagtatatattctcaaatactattggaattaaggggacaattagaatcctagagagttcaagttttccgtcacatgagttaagcagcctaagtcagttgatctctgcacgagacctctgattagatcatgagatactgaattctagaataacaaggtctctttttagaaatccttactctaggtagtactagatgaatgttattaaaatgaaata

SEQ ID NO: 120234 - DNA, 601 bp, Human
acaaaacaacttggtagaaagaatcaaaaattgcaggtatttccttattcccccaaatgttttctgatttcaatgtttgtttgtttgtttttgagacagagtctcgctctgtcccccaggctggagtgcagtgccatgatctcggctcactgcaacctctacctcccaggttcaagcaattctcctgccttagtctccgagtagctgggattgcaggcacccaccaccacgcttgccaccagcctggccaacatggtgaaaccccgtctctactgaaaatacaaagaaatacaatttttcrctgctcctggatgaatttttttgtatttttagtagcgatggggtttcaccatgttggccaggctggtcttgaactcctgaccacaggtgatccgcccgccctggcctcccaaagtgctgggattacaggtgtaagccaccgcacccagcctcaatgttgtctttttaagtaaactgtctgttcttttgaataattacaaaaaacagtaaggcagagttaataattacagaactttcaatagctaggaagtatgtaagtcactacaaatgattttcatttctaaacaattttcaactaact

SEQ ID NO: 120235 - DNA, 601 bp, Human
ccactccccaacattctatggattaaggtattttaattgagcaaatgttatgttaaaagatatcctggcaagaatgcgaaggtccatccccagactagatgaacttcttccttagcttatggctatgtccacacccttatgacagccctaattgtggttcctgaacttctattattataacacaacgatttagaaaaacagtctgctctatacagctaatgtcacactgtggaaatgaatcattctgaccaaaagccttgcttctggcagtgccaatcccttcctaaagcaactgcaagcmgtccacctcccagtcaggaagcatctggtagctggggctctagaagtatccctgggaagtcagtcagaactagagagaccactaacatttgttagggggcactggaattgttgagctctgacacatgatcaagtaggccaggaaaagtaactaatcttaggatcctcatgttaagaaagattaaagtgattagatcaatcactaaatgactataagagcagaaccaaaagtattctatgataattgtagcaagttgaacgtattacaggtatgcattacattttcctgaaaatatatgtg

SEQ ID NO: 120236 - DNA, 601 bp, Human
caacaacaaaaaactatgggtgcaaggacacgcctagaaatttctaaaaaacccattctcagcactcagttttccttccccatccattccaatccataatttggaaaaacatgtcccactccccaacattctatggattaaggtattttaattgagcaaatgttatgttaaaagatatcctggcaagaatgcgaaggtccatccccagactagatgaacttcttccttagcttatggctatgtccacacccttatgacagccctaattgtggttcctgaacttctattattataacacaaygatttagaaaaacagtctgctctatacagctaatgtcacactgtggaaatgaatcattctgaccaaaagccttgcttctggcagtgccaatcccttcctaaagcaactgcaagccgtccacctcccagtcaggaagcatctggtagctggggctctagaagtatccctgggaagtcagtcagaactagagagaccactaacatttgttagggggcactggaattgttgagctctgacacatgatcaagtaggccaggaaaagtaactaatcttaggatcctcatgttaagaaagattaaa

SEQ ID NO: 120237 - DNA, 601 bp, Human
aagcactgtgaattaatttatgatacactgatggtagcaatgccttagaaatttcaggagtagggaagagaaaaagtgacatctgggaggcagtagagactcagcaatatatttaaaaacaacaacaacaacaaaaaactatgggtgcaaggacacgcctagaaatttctaaaaaacccattctcagcactcagttttccttccccatccattccaatccataatttggaaaaacatgtcccactccccaacattctatggattaaggtattttaattgagcaaatgttatgttaaaagayatcctggcaagaatgcgaaggtccatccccagactagatgaacttcttccttagcttatggctatgtccacacccttatgacagccctaattgtggttcctgaacttctattattataacacaacgatttagaaaaacagtctgctctatacagctaatgtcacactgtggaaatgaatcattctgaccaaaagccttgcttctggcagtgccaatcccttcctaaagcaactgcaagccgtccacctcccagtcaggaagcatctggtagctggggctctagaagtatccctgggaagt

SEQ ID NO: 120238 - DNA, 601 bp, Human
gtgagccattttcaggtcagggcctccccttgtccaatcagcttggctggatcatttggtttcttagcaggggccccaggtcaacagggagagtgaggggtacagttaccctttgaagggaccgtgagtatggcaagcactgtgaattaatttatgatacactgatggtagcaatgccttagaaatttcaggagtagggaagagaaaaagtgacatctgggaggcagtagagactcagcaatatatttaaaaacaacaacaacaacaaaaaactatgggtgcaaggacacgcctagaaatktctaaaaaacccattctcagcactcagttttccttccccatccattccaatccataatttggaaaaacatgtcccactccccaacattctatggattaaggtattttaattgagcaaatgttatgttaaaagatatcctggcaagaatgcgaaggtccatccccagactagatgaacttcttccttagcttatggctatgtccacacccttatgacagccctaattgtggttcctgaacttctattattataacacaacgatttagaaaaacagtctgctctatacagctaatgtcacac

SEQ ID NO: 120239 - DNA, 601 bp, Human
attcctggtagttgttttttgtgagtgggcttgggccctttgctgctgctgaagagggaagaggatagccagagctgggaaaaacaggagtcaacatgatccatactctaacaactccatgttgaacatattgaaacacacaggaatcctgggccagagtagatttccaataattttacaaaaacagaagcaatacagacaccataagtactggctataaattctaaaaactttcatcacacatcaaaaacaactcaacaaggtgaaatttattccatttgatatccctaacattaatttyctgttcataatttttttttttaataaaaggtaagactgtggaggagggcaatctgcttaattttgctgtgaacctaaaatggctttaaaaaattttttttaagtgaatccggtccattagtagaggagttgcggcagctcaaggcaaggagcctgaggcccagattcctaatttcttggccctaaatagtgactctatcccctgatgcccctggactaccaacctgcccgtggctcttccaggtttctaaggtctcctgtgattaggcttctatcattgcaatggactgatactcaagct

SEQ ID NO: 120240 - DNA, 601 bp, Human
cagacacaggcaaagatcatacggagaaagatgaaagaggcatgcacggggtctgtgagcttgagaacttcctggatatagcaaccatctcttttctcctataggccatctctttttttcgtttaacataaataaaccaagtatctgtgactctacctgaccttcttcatggcatcatgtggaagaaaccctgatccagaagggaatagaactcatattcctggtagttgttttttgtgagtgggcttgggccctttgctgctgctgaagagggaagaggatagccagagctgggaaaaasaggagtcaacatgatccatactctaacaactccatgttgaacatattgaaacacacaggaatcctgggccagagtagatttccaataattttacaaaaacagaagcaatacagacaccataagtactggctataaattctaaaaactttcatcacacatcaaaaacaactcaacaaggtgaaatttattccatttgatatccctaacattaatttcctgttcataatttttttttttaataaaaggtaagactgtggaggagggcaatctgcttaattttgctgtgaacctaaaatggct

SEQ ID NO: 120241 - DNA, 601 bp, Human
tgagaggccagagagattcccagggctcagatcataaaaggactggaacatagtagtactcagtaaatacttgatgaaagaattggctagagctttcatgaaggaaaaggtataagtatgtggttatgcatgttggacaaattttgtatgtccattttgttagtagaaacaggatataatcagtattattctacatcagtagaattataagaacatgattcagtcagcaagaacttggctcactcagcatgataactggagactcaggcataataaagaggaagtggctaggcagtttttrtattcttgtgaccacaagagagagaagagctagagtggtatctgcacagacacaggcaaagatcatacggagaaagatgaaagaggcatgcacggggtctgtgagcttgagaacttcctggatatagcaaccatctcttttctcctataggccatctctttttttcgtttaacataaataaaccaagtatctgtgactctacctgaccttcttcatggcatcatgtggaagaaaccctgatccagaagggaatagaactcatattcctggtagttgttttttgtgagtgggcttgggccc

SEQ ID NO: 120242 - DNA, 601 bp, Human
ctttgtggtgttctctgtatttcctgaatttgaatgttggcctgccttgctaggttggggaagttctcctggataataacctgaagagtgttttccaacttggttccattttccccgtcactttcaggtacgccaatcagatgtagatttggtcttttcacatagtcccatatttcttggaggctttgtcatttctttttactcttttttctctaaacttctcttcttgcttcatttcattcatttgatcttcaatcactcatatcctttcttccagttgatcaaattggctactgaagcytgtgcatgcgtcacgtagttcttgtgccatggttttcagctccatcaggtaatttaaggtcttctctacgctgtttactctagttagccattcgtccaatctttttttaaggttcttggcttctttgcgatgggtttgaacatcctcctttagcttggagaagtttgttattactgatcttccgaagccttcttctctcaactcgtcaaagtcattctccgtccacctttgttccattgctggcaaggagctgcgttcctttgtgttcctttggaggagaagaggcgctctgattttttg

SEQ ID NO: 120243 - DNA, 601 bp, Human
atctttgtggtgttctctgtatttcctgaatttgaatgttggcctgccttgctaggttggggaagttctcctggataataacctgaagagtgttttccaacttggttccattttccccgtcactttcaggtacgccaatcagatgtagatttggtcttttcacatagtcccatatttcttggaggctttgtcatttctttttactcttttttctctaaacttctcttcttgcttcatttcattcatttgatcttcaatcactcatatcctttcttccagttgatcaaattggctactgaakcttgtgcatgcgtcacgtagttcttgtgccatggttttcagctccatcaggtaatttaaggtcttctctacgctgtttactctagttagccattcgtccaatctttttttaaggttcttggcttctttgcgatgggtttgaacatcctcctttagcttggagaagtttgttattactgatcttccgaagccttcttctctcaactcgtcaaagtcattctccgtccacctttgttccattgctggcaaggagctgcgttcctttgtgttcctttggaggagaagaggcgctctgattttt

SEQ ID NO: 120244 - DNA, 601 bp, Human
gacaattatgtgtcttggggttgttcttctcaaggagtatctttgtggtgttctctgtatttcctgaatttgaatgttggcctgccttgctaggttggggaagttctcctggataataacctgaagagtgttttccaacttggttccattttccccgtcactttcaggtacgccaatcagatgtagatttggtcttttcacatagtcccatatttcttggaggctttgtcatttctttttactcttttttctctaaacttctcttcttgcttcatttcattcatttgatcttcaatcactsatatcctttcttccagttgatcaaattggctactgaagcttgtgcatgcgtcacgtagttcttgtgccatggttttcagctccatcaggtaatttaaggtcttctctacgctgtttactctagttagccattcgtccaatctttttttaaggttcttggcttctttgcgatgggtttgaacatcctcctttagcttggagaagtttgttattactgatcttccgaagccttcttctctcaactcgtcaaagtcattctccgtccacctttgttccattgctggcaaggagctgcgttcct

SEQ ID NO: 120245 - DNA, 601 bp, Human
aaggattttatttctccttcacttatgaagcttagtttggctggatatgaaattctagcttgaaaattcttttctttaagattgttgaatattggtccccactctcttctggcttgtagagtttctgccgagagatctgctgttagtctgatgggcttccctttgtgggtaaccggacctttctctctggctgcccttaacattttttccttcatttcaactttggtgaatctgacaattatgtgtcttggggttgttcttctcaaggagtatctttgtggtgttctctgtatttcctgartttgaatgttggcctgccttgctaggttggggaagttctcctggataataacctgaagagtgttttccaacttggttccattttccccgtcactttcaggtacgccaatcagatgtagatttggtcttttcacatagtcccatatttcttggaggctttgtcatttctttttactcttttttctctaaacttctcttcttgcttcatttcattcatttgatcttcaatcactcatatcctttcttccagttgatcaaattggctactgaagcttgtgcatgcgtcacgtagttcttgtgc

SEQ ID NO: 120246 - DNA, 601 bp, Human
aatttacaggagacagatttcaaaaacaaacagaaattctgggtctgaaaaattattgaaggaattacaaaatacatttgaaatgcttcaaaaatagactagactaagcagaaaaaaagaatctcaaaacttgaagacaagtcttttgaaataacataatcagacaaaagtgaggaaaaaagaatgaataaagacatcaagatattagggtctacataaggcaaccaagcttacgaattattggtattctcaaggaggaagaaaatgcaaaaagttctgaaaacctatttaaggaaataaytgatgaaaatttcccaagtcaagaaagagatttagacatccagctacaggaggcccagcaatccccaggaaaataaactgcaaaaaaaacttcaccacagcatattatcatcagactgtctaaagtcaaagtgaaggaaaaaaattttaaatcggcaagagaaaagcacacttagttgcctataaaggaaaccccatcagactaatggcacacttctcagcagaactctcacaggccagaagagaatgggatggcattttcaaagtgatgaaagaaaaaagaaaaacctagcagccaata

SEQ ID NO: 120247 - DNA, 601 bp, Human
cagcctgaagagcccactgcaacaattaacacaagagcacagcacttgagaaagagaagagcttctcacaactactgcccctatcacccatgacatcacagctgcacaggaggttgtgtgtctgctcactgcctggtacgccactacaaccagcattcaagaaagctaccgcattaaggctatgtatatccaaggaaatcatacaaagtctttgtcacttcatgcagacaaatggccctacccaatcagcatcatagtcacatcttcagatacacagaaatcaacatataggaagtatgaraaagcaaggtattatggcgccctcaaaggaacaaaataattatttggcaatagatcttaagcagaacaaaaatccttgaaatgtcgataaataattcaaagtattgattttaaagaagctcaatgagatgcaagagaaatctgcaaactaatataaagaaaatcagaaaatcaatttaggatgcacatgaggaatttacaggagacagatttcaaaaacaaacagaaattctgggtctgaaaaattattgaaggaattacaaaatacatttgaaatgcttcaaaaatagactagactaag

SEQ ID NO: 120248 - DNA, 601 bp, Human
agatacatcttgagatttttttcgcccaagatggctgactagaggcttttctagcacacttcataaactcagaagaaccaaaatagtgtgtagacaatcatactttgaacatattatccatgataatatgtttgacatgaaaagcaatgagtccaacagaaaagcaaaaagaaactccaaaatctgagaagaaggaaggtaggtagcccgtatggccaggaccggccaaaaaccaggagtgaatccccaatatggaaaagggtacatatctctctgtggtccactttcccactagggaatygagcaatccagaccacaggaaagtaccttgccccttctaagccctagatctaacatgcggagcagccaggagactgtgagaaggaactgcttgaggaagtatcccaggcattccttcagactggacacctacagcaggaccctattctctttcctagctcttacttagcaagctgcacctcacacgcctgggagctagccacagcagcagcagtctttggcagtagagagactcaggctggggcttggggaactgaaacctgtgggaggggctcccacagccagaactgagaaatgagtg

SEQ ID NO: 120249 - DNA, 601 bp, Human
atgatcccctatccttgccccttttattaagtgtccttttagcttaattttagccgagaaaagcagctatgaaagttgatctaggttttataattttgaaagaatggttggtataaaatatttttcagaaaaataaaaaacttctgggtgccaaaatacatcataaacaaacccaaaatacagggtgaccaaaaatatatttgtaaaaaagcaaagtcccttaatgtataaagaacttttgcctgtagtcccagctacttgggaggctagggcaggaggattgcttgaattcaggaattcraaagtatagtgcgctatgatcatgccactgcactccagcctgagcaacagagcaagaccctgtctctagaaaataaatagaataaatttaaaaagacttttaaaaagaactcttacaaatcattaagaaaaagatacatcttgagatttttttcgcccaagatggctgactagaggcttttctagcacacttcataaactcagaagaaccaaaatagtgtgtagacaatcatactttgaacatattatccatgataatatgtttgacatgaaaagcaatgagtccaacagaaaagcaaaa

SEQ ID NO: 120250 - DNA, 601 bp, Human
ttagatattaaggttatcggccaggcacagtggctcacgcctataatcccagcactttcggaggccaaggtgggcagattgcctgaggtcaagagttccagaccagcctggccaacatggtgaaaccccatctctactaaaaatacaaaaattggccgggcacggtggcacacacctgtagtcccagctactctggaggctgaggcaggataatctcttgaaccctggaggtggaggttgctgtgagccaagattgtgccactgcactccatcctgggcgacagcgagaatccgtcttggaaaaaaaaaaaaaaggttatgaaattctcattcagtaatttccaaacatctagagagatcaagagtacactttgcttcccttaaatctgacagccctaagatgttaagtggtatgattgaactgatagagaaaatcatccaaattgggtggtcgggttctcagtatgactgagagaaactgacaggacaatgggaatcataacagaaagatcaaaattgattgtcagtctattttaggttgtaaaaatctcatgaactaaaggacattttttcttgagtgacaggtactccaactgtatac

SEQ ID NO: 120251 - DNA, 601 bp, Human
aacaaaaaacaaataatctcattaaaaagtaggcaaaggggcttggtgtggtggctcacgtctgtaatcctaactctttgggaggctgaggcaggtagactgcttgagctcaggagttcaagacctgcctgggcaacatggcgaaaccctatctctacaaaaaatacaaaaattagccaggtgtggtgtagtcccagctacttgggggctgaggtgggagaagcgcttgagcccagggaggttaaggctgcagtgcacaatgactgcaccagcctaagtgacagagtgagaccctgtctcaaaaaaaaaaaaaaaaaaagtagacaaaggatctgaacacacatttctcacaagaaggcatataaatggctaacaggtatatgacaaaatgctcaacaccactaatcatcagaaaatgcaaatcaaaactacaatgagatataatctcactcccgttagaatgacttttatcaaaaaggcaaaaaataacagaggctgttgaggatgtggagaaaaggaaattcttatacattgttggtggaaatgtaaattagaacagtcattatggaaaagagcatggagatttttcaaaagtctaaaa

SEQ ID NO: 120252 - DNA, 601 bp, Human
acctgataccaaaatcagaaaaggagacaacaaaataagaaaactacaggctaatatcactgatgaatacagatgcaaaaattctcaaaaaaaatactagcccaactgaattcaacaacacattaaaaagatcattcaccataatcaagtgggattcatcccagacatgcaaggatggttcaacatacacaaatcaataaatgtaatacatcacattaacagaacgaagaacaaaaaccatatgatcattttgatacatgttaaaaaagcattcaataaaattcaacatcccttcatgataaaaaaaaaaaacctcaacaaagtggttacagaaggactatacttcaaaataataaaggccacatatgagaaacccacagctaacatcattgaatggggaccatttgaaagcctttcatctaacatacggatcaacaaaaggatgtctacttttacttttattcaacataatattggaagtcctcaccagagcaatcagataagagaaagaaaagacatccaaattggaaaggaagaagtcaaattacccttgctcgcagatgacatgatcttattatttagaaaaccctaaaaacgccac

SEQ ID NO: 120253 - DNA, 601 bp, Human
gataacccagacagaaaatcaacaaggaaacatcagagttaaactacaggcaaacaggcctaacatttacagaacatttcacccatttgcagaagagtacacattcttttcatcagcacatgaaatattctccagaatagaacataacttgggccacaaaacaaatctcaacacattcaaaaaaggagaaaccaagtatcttttctgactacaatggaaccctggaaaattcacaaatacatggaaattaaacaacatgctcctgaatgaccaaagggtcaatttaaaaaattaagatggraatttaaaatttccttgaaaatacaaaaacggtaatacaacataccaaaatctatgggatacagcaaaagcagtactaagaaagatgtttatagcaataaatgcctacatcaaaaaagtaaaaagacttcaaatgaacaatctaataatggtgcatgttaaggaactagaagagcaagaacaaatcaaatccaaaattggtagaggaaaagaaataataaagaccagagcagaaataaatgaaattgaaactaaaaaaaaaatacagaaggtcaatgaaacaaaaagtttactgtttgaa

SEQ ID NO: 120254 - DNA, 601 bp, Human
actgcttgagtccaggagttcaagatcagcctgggcaacacagtgagacctcacctctataaaaaatgaacagaattagccaggtgtgatagcacatgcctgcagtcccagctacttagaaagctgaggttgggaggattgcttgagcctgggaggtcaaggctgcagtgagccaagatcttgccactgcactctagcctgagcgacagggctagatcctgtctccaaaaaaaaaattgaattcaggctcaggctttagagcagggcgtggtgatgtgcacacctgtaaaccctggtactygagaggcttaggtgggaggatcacttgagctcaggagtttgagaccagccttggcaacataacaagacccatctcaaaaataataataataatagttcaggataagactttctgggtttactagccctgtggttttcctatgtattgcctacaatgagggtaataatacctaccacataggggtatcatgaagattaaatcagttatatatgtgaagtactcagaacagtgcttagtacgtagaaggcagttgatatgtgacctattctcattaataatattctttaaaaaaaaaaatta

SEQ ID NO: 120255 - DNA, 601 bp, Human
taatcccagcactttgggaagccaaaggaggaggactgcttgagtccaggagttcaagatcagcctgggcaacacagtgagacctcacctctataaaaaatgaacagaattagccaggtgtgatagcacatgcctgcagtcccagctacttagaaagctgaggttgggaggattgcttgagcctgggaggtcaaggctgcagtgagccaagatcttgccactgcactctagcctgagcgacagggctagatcctgtctccaaaaaaaaaattgaattcaggctcaggctttagagcagggygtggtgatgtgcacacctgtaaaccctggtactcgagaggcttaggtgggaggatcacttgagctcaggagtttgagaccagccttggcaacataacaagacccatctcaaaaataataataataatagttcaggataagactttctgggtttactagccctgtggttttcctatgtattgcctacaatgagggtaataatacctaccacataggggtatcatgaagattaaatcagttatatatgtgaagtactcagaacagtgcttagtacgtagaaggcagttgatatgtgacctat

SEQ ID NO: 120256 - DNA, 601 bp, Human
gaccctggcagcctacctggaacactctggcctggcatggttccttcctgcctctctaatcattcctttcccatttcctgtgccagctctaccttctctatcctatctgtaactattagaattgcccagacctctaagctaagtctcttctctcttttaatgtggtgttaagaatgcaggcttgctaggcacagtagctcatgcctgtaatcccagcactttgggaagccaaaggaggaggactgcttgagtccaggagttcaagatcagcctgggcaacacagtgagacctcacctctayaaaaaatgaacagaattagccaggtgtgatagcacatgcctgcagtcccagctacttagaaagctgaggttgggaggattgcttgagcctgggaggtcaaggctgcagtgagccaagatcttgccactgcactctagcctgagcgacagggctagatcctgtctccaaaaaaaaaattgaattcaggctcaggctttagagcagggcgtggtgatgtgcacacctgtaaaccctggtactcgagaggcttaggtgggaggatcacttgagctcaggagtttgagaccagccttggcaaca

SEQ ID NO: 120257 - DNA, 601 bp, Human
tgtcatctctcacctctcctggccttgcattcaaccctcttaacaactgcaaacaccagctggtttctccgtatctatctctactcaaattgcccagcaagccctttcccccatcctcatcacccatataatacctatgtattctttaagggctcacctttcagcagtgtttcaccactgaccctggcagcctacctggaacactctggcctggcatggttccttcctgcctctctaatcattcctttcccatttcctgtgccagctctaccttctctatcctatctgtaactattagaaytgcccagacctctaagctaagtctcttctctcttttaatgtggtgttaagaatgcaggcttgctaggcacagtagctcatgcctgtaatcccagcactttgggaagccaaaggaggaggactgcttgagtccaggagttcaagatcagcctgggcaacacagtgagacctcacctctataaaaaatgaacagaattagccaggtgtgatagcacatgcctgcagtcccagctacttagaaagctgaggttgggaggattgcttgagcctgggaggtcaaggctgcagtgagccaagatct

SEQ ID NO: 120258 - DNA, 601 bp, Human
ccggcctcaggtatttctttatagcagtatgagaatggactgtaatacagaatgttacaaatctttcatgatctggccctgtcaacttctccagtgtcatctctcacctctcctggccttgcattcaaccctcttaacaactgcaaacaccagctggtttctccgtatctatctctactcaaattgcccagcaagccctttcccccatcctcatcacccatataatacctatgtattctttaagggctcacctttcagcagtgtttcaccactgaccctggcagcctacctggaacactctggcctggcatggttccttcctgcctctctaatcattcctttcccatttcctgtgccagctctaccttctctatcctatctgtaactattagaattgcccagacctctaagctaagtctcttctctcttttaatgtggtgttaagaatgcaggcttgctaggcacagtagctcatgcctgtaatcccagcactttgggaagccaaaggaggaggactgcttgagtccaggagttcaagatcagcctgggcaacacagtgagacctcacctctataaaaaatgaacagaattagccaggtgt

SEQ ID NO: 120259 - DNA, 601 bp, Human
gccataaagcttagcagattccatgtggtgttaagcctgtaggtgtacagaataaaaagtgaagaacgtttggcagcctccacttagatttcagaggatgtatgagaaagcctgggtgccgaggcaaaagcctcctgcaggggcaaagccctcatagagaacctctactagggcagtgccaaaggaaaatgtggggttggaggccctatacagagttgcaagggggcattgcctagtggagctgtgagaagggggccaccatcctccagatcccagaatcgtaaatccactggcaccttgyaccttcagcctagaaaagccacaggcattcaactccaacccataagaacagccctaggggctgaaccctacaaagccacagacaaagagctgcccaaggccttgggaacccactctttctatcagtgtgccctggatgggacgtgtagtcaaacaggattatcttggatctttaagatttaatgattgccctgctaggtttcaaacttgtctgtagcccctttcttttggccaatttctcccttttggaatgggagaaatgtccataccccacggtatcttggcagtagtcaacttgttt

SEQ ID NO: 120260 - DNA, 601 bp, Human
aagtcaatggggaaaaggcctggaaggcatttcggagaccttcccagcagcccctcccaccacaggcccagaggcctaggaggacattatggtgtagagggccaggcctagggccccactaccctgcacagcctcagagctctgcttcctgcgtgctggctgctccagctccagctccagccaagggtcaaaaaagccggggtacagctcaagctgccactttgaagaatgcaagccataaagcttagcagattccatgtggtgttaagcctgtaggtgtacagaataaaaagtgaagaaygtttggcagcctccacttagatttcagaggatgtatgagaaagcctgggtgccgaggcaaaagcctcctgcaggggcaaagccctcatagagaacctctactagggcagtgccaaaggaaaatgtggggttggaggccctatacagagttgcaagggggcattgcctagtggagctgtgagaagggggccaccatcctccagatcccagaatcgtaaatccactggcaccttgcaccttcagcctagaaaagccacaggcattcaactccaacccataagaacagccctaggggctgaac

SEQ ID NO: 120261 - DNA, 601 bp, Human
gacagtgaaggccaggctgagaaggtctcagacggaaatgtggaacttagtggaactggagcaaaggtcacgtgtgttacgcctcaccaaagaacttggctacaatgtggcccccgccctaggggatctgtggaactgaacttcagagtgatgatttaaggtatctggcagaagaaatttcaaggcagaaaagcattcaagatgtggcccgactgcttcgaacagcctacactcaggtacaggagcaaagaagcgacttaaagttggaatatatatttaagcaggaagtagagcataaaastttggaaaatttgcaggctggccatgtggcagagatagcttttgcaagagagaaatccaagcaggctgtggagcagcaaccatttgctagagaaatttgcataactaaaagagagacaagtgctaacagccaagtcaatggggaaaaggcctggaaggcatttcggagaccttcccagcagcccctcccaccacaggcccagaggcctaggaggacattatggtgtagagggccaggcctagggccccactaccctgcacagcctcagagctctgcttcctgcgtgctggctgctccagc

SEQ ID NO: 120262 - DNA, 601 bp, Human
gatagtgatccagacagtgaaggccaggctgagaaggtctcagacggaaatgtggaacttagtggaactggagcaaaggtcacgtgtgttacgcctcaccaaagaacttggctacaatgtggcccccgccctaggggatctgtggaactgaacttcagagtgatgatttaaggtatctggcagaagaaatttcaaggcagaaaagcattcaagatgtggcccgactgcttcgaacagcctacactcaggtacaggagcaaagaagcgacttaaagttggaatatatatttaagcaggaagyagagcataaaagtttggaaaatttgcaggctggccatgtggcagagatagcttttgcaagagagaaatccaagcaggctgtggagcagcaaccatttgctagagaaatttgcataactaaaagagagacaagtgctaacagccaagtcaatggggaaaaggcctggaaggcatttcggagaccttcccagcagcccctcccaccacaggcccagaggcctaggaggacattatggtgtagagggccaggcctagggccccactaccctgcacagcctcagagctctgcttcctgcgtgct

SEQ ID NO: 120263 - DNA, 601 bp, Human
aggctcagaagaagacaggaagaagaaagaaagtttggaattcttagagactggttaaatggttgtgaccaaaatgctgatagtgatccagacagtgaaggccaggctgagaaggtctcagacggaaatgtggaacttagtggaactggagcaaaggtcacgtgtgttacgcctcaccaaagaacttggctacaatgtggcccccgccctaggggatctgtggaactgaacttcagagtgatgatttaaggtatctggcagaagaaatttcaaggcagaaaagcattcaagatgtggcccractgcttcgaacagcctacactcaggtacaggagcaaagaagcgacttaaagttggaatatatatttaagcaggaagtagagcataaaagtttggaaaatttgcaggctggccatgtggcagagatagcttttgcaagagagaaatccaagcaggctgtggagcagcaaccatttgctagagaaatttgcataactaaaagagagacaagtgctaacagccaagtcaatggggaaaaggcctggaaggcatttcggagaccttcccagcagcccctcccaccacaggcccagaggcctag

SEQ ID NO: 120264 - DNA, 601 bp, Human
aattggtactaggagtgagggattgcctcacatacagataactgaaaatgtagaagcaactttggaactaggtaacagcagaggttggaagcatatggaaggctcagaagaagacaggaagaagaaagaaagtttggaattcttagagactggttaaatggttgtgaccaaaatgctgatagtgatccagacagtgaaggccaggctgagaaggtctcagacggaaatgtggaacttagtggaactggagcaaaggtcacgtgtgttacgcctcaccaaagaacttggctacaatgtggcmcccgccctaggggatctgtggaactgaacttcagagtgatgatttaaggtatctggcagaagaaatttcaaggcagaaaagcattcaagatgtggcccgactgcttcgaacagcctacactcaggtacaggagcaaagaagcgacttaaagttggaatatatatttaagcaggaagtagagcataaaagtttggaaaatttgcaggctggccatgtggcagagatagcttttgcaagagagaaatccaagcaggctgtggagcagcaaccatttgctagagaaatttgcataactaaaag

SEQ ID NO: 120265 - DNA, 601 bp, Human
ctgctcctgccttgctttccaccgtgaaagctccctgaggcctccctagaagcagatgccgccatgcttcatgtacagcctgcagaaccgtaagccaattaaaccccttttcttataacttacccagtctcaggtctttctttatagcaatgcaagaatgaactaacacaaaaaattggtactaggagtgagggattgcctcacatacagataactgaaaatgtagaagcaactttggaactaggtaacagcagaggttggaagcatatggaaggctcagaagaagacaggaagaagaaasaaagtttggaattcttagagactggttaaatggttgtgaccaaaatgctgatagtgatccagacagtgaaggccaggctgagaaggtctcagacggaaatgtggaacttagtggaactggagcaaaggtcacgtgtgttacgcctcaccaaagaacttggctacaatgtggcccccgccctaggggatctgtggaactgaacttcagagtgatgatttaaggtatctggcagaagaaatttcaaggcagaaaagcattcaagatgtggcccgactgcttcgaacagcctacactcaggta

SEQ ID NO: 120266 - DNA, 601 bp, Human
gaagttagataacttgccccaaagtcactcagctaataaatggcagaagcagacttcaaaccgagaaagatctctgatttcaaaatgattaggttgtataaggaagaataagaaaaacacaatctcattgaatcactttctcctgattgggaccaaagttgctcaactaagcaaaacaactcacactttcctatcattttcaacacttgttctcaatgtagaaaaaagtattaaatggaagtcatattaaatatgtacaggcctctttatataggggtcttcctcccacatagactatctrtcaccctgataaatgatgtagtgatgaaagaagtcatgggtaattttttaaattttaactaaaatgtcttaacatggtaagatttaaggaatcatggcattaaacatcaaacaacacatacattatatgagacaatatggataaggtgccaaaacagtacctgggaaataatagacaggtgccggtatgtatttccctcccacttataacaggcagctccctttgtgttgctccccagctttgggaatcgacacttctaggtcttttgctaacttgggaaatgacacagtttggatattt

SEQ ID NO: 120267 - DNA, 601 bp, Human
aatatgcatatcaagaaaaattagtatttccatctataattagctggtggtattttaaaccacaaaattctaaataattaaaataatcaaaggtaaaacagaatcaccaacagggaagcgaactatataggttgtattcatcacaggactttgatcaggataaagaaaagtcctaactttacttaacctcataatatgctttataattattattaaagaagttccttattcaacaaaacacttgagagaagttagataacttgccccaaagtcactcagctaataaatggcagaagcagamttcaaaccgagaaagatctctgatttcaaaatgattaggttgtataaggaagaataagaaaaacacaatctcattgaatcactttctcctgattgggaccaaagttgctcaactaagcaaaacaactcacactttcctatcattttcaacacttgttctcaatgtagaaaaaagtattaaatggaagtcatattaaatatgtacaggcctctttatataggggtcttcctcccacatagactatctatcaccctgataaatgatgtagtgatgaaagaagtcatgggtaattttttaaat

SEQ ID NO: 120268 - DNA, 601 bp, Human
aattttatgtgagatgacagagctttggaatgagtatttttagacactgtagttatttaacattcgtgtaaagattattttcagaactagatctcacttcttaagaacagtgttaatatgcatatcaagaaaaattagtatttccatctataattagctggtggtattttaaaccacaaaattctaaataattaaaataatcaaaggtaaaacagaatcaccaacagggaagcgaactatataggttgtattcatcacaggactttgatcaggataaagaaaagtcctaactttacttaayctcataatatgctttataattattattaaagaagttccttattcaacaaaacacttgagagaagttagataacttgccccaaagtcactcagctaataaatggcagaagcagacttcaaaccgagaaagatctctgatttcaaaatgattaggttgtataaggaagaataagaaaaacacaatctcattgaatcactttctcctgattgggaccaaagttgctcaactaagcaaaacaactcacactttcctatcattttcaacacttgttctcaatgtagaaaaaagtattaaatggaa

SEQ ID NO: 120269 - DNA, 601 bp, Human
agggaagcagaggttgcagtgagctgagactgggccactgcactttagcctgggcgacagggcaagactccatctcaaaaaaaaaaaaaaaaagtaaatcacactttgggaggccgaggcgggtggattgtctgagctcaggagttcaagaccagcttgggcaacatggtgaaaccctgtctctactaaaatacaaaaaattaactgggagtggtgacacgcacctgcacagtcccagctacttgggaggctgaggcacaagaattgcttgaacctgagaggcggaggttgcagtgagccragattgtgccactacactccagcctgggcaacagaggaagactctgtctccaaaaaaaaaaggaaaatcaagttcaagtcagctccctccagacactgaaattatcattttaaatttaggaagaaaacaagaacttgcaaattgatggatatgctttgtcaccattaagtagcaaaaattaaatattcttatttttctaaaattttatgtgagatgacagagctttggaatgagtatttttagacactgtagttatttaacattcgtgtaaagattattttcagaactagatctcacttc

SEQ ID NO: 120270 - DNA, 601 bp, Human
atttttatttttttgctgactctgcaagttaccttgcatatactgtgaaatgtacctggtttaaaagtaaatcacgcttcactttgggaggctgaggcgggtagatcacgaggttaggagttcgagaccagcctggccaacatggagaaaccccgtctctactaaaaacacaaaaattagctgggcatggtggtgggcgcctgtaatcctagctactcgggaggctgaggcagaactgtttgaaccagggaagcagaggttgcagtgagctgagactgggccactgcactttagcctgggmgacagggcaagactccatctcaaaaaaaaaaaaaaaaagtaaatcacactttgggaggccgaggcgggtggattgtctgagctcaggagttcaagaccagcttgggcaacatggtgaaaccctgtctctactaaaatacaaaaaattaactgggagtggtgacacgcacctgcacagtcccagctacttgggaggctgaggcacaagaattgcttgaacctgagaggcggaggttgcagtgagccgagattgtgccactacactccagcctgggcaacagaggaagactctgtctccaaa

SEQ ID NO: 120271 - DNA, 601 bp, Human
tttgcctcccaggttcaagcgattctcctgcctcagcctcccaagtagccgagattacaggcatgcaccacaacacctggctaatttttatattattagtagagacggggcttcgccatgttggccaggctggtcttgaacccctgacctcaggtgatctgcccacctcggcctctcaaagtgctaggattaaaggcatgagtcaccgcacctggcccaccagtcatctttcttttggtatcttaccatgatgacaacactgaagaggcccttgattgatgcagatgactcactggaagtyttgctaacttgtgttttgtctgtcaaggaacactgagggtgtgggcaccaaaagcagttgcttctgatgccccagacacttttgggaacaaaactaacagcattaacagagtaaactgaccagccctcaaaacccaaagaatttgacccatatgatcttctctcttctccccctaactcccatatacattatttgctttatagcacatgtgcacatctttattagcttctgtattaaatcatgagcagcttggcaattcagaatcggccatggctcactttcgatagcccattgtgaatg

SEQ ID NO: 120272 - DNA, 601 bp, Human
tggcagcaatgaggtaattttgacagagtctaaaagaagagcactagaaaggcacgttcaagggacatgctggcactggaacatgccagagagaggcaccaaacagtgttggctcacccagcactgcccttgcacctccttgggggttacacccagccttgcatgtttaaggaggcaccagccatcttttttttttctttttctttttttttttctgagatggagtctcgctctgttgcccaggctggagtgcagtggcacaatctctgctcactgctacctttgcctcccaggttcaagygattctcctgcctcagcctcccaagtagccgagattacaggcatgcaccacaacacctggctaatttttatattattagtagagacggggcttcgccatgttggccaggctggtcttgaacccctgacctcaggtgatctgcccacctcggcctctcaaagtgctaggattaaaggcatgagtcaccgcacctggcccaccagtcatctttcttttggtatcttaccatgatgacaacactgaagaggcccttgattgatgcagatgactcactggaagttttgctaacttgtgttttgt

SEQ ID NO: 120273 - DNA, 601 bp, Human
gagaaaataatgctagcacagatttaacctgcataatagcttgcaaggaaaataaaagacatctgtccttccacaatacaatttaatgaggcctgcctggcagcaatgaggtaattttgacagagtctaaaagaagagcactagaaaggcacgttcaagggacatgctggcactggaacatgccagagagaggcaccaaacagtgttggctcacccagcactgcccttgcacctccttgggggttacacccagccttgcatgtttaaggaggcaccagccatcttttttttttctttttctttttttttttctgagatggagtctcgctctgttgcccaggctggagtgcagtggcacaatctctgctcactgctacctttgcctcccaggttcaagcgattctcctgcctcagcctcccaagtagccgagattacaggcatgcaccacaacacctggctaatttttatattattagtagagacggggcttcgccatgttggccaggctggtcttgaacccctgacctcaggtgatctgcccacctcggcctctcaaagtgctaggattaaaggcatgagtcaccgcacctggcccaccag

SEQ ID NO: 120274 - DNA, 601 bp, Human
ggtaacactgtcatgtagctggattctgtcatgattagctaacaaagggttaggctctctttcagtgatccccgtttcctcttctccactcacactactctagatctagtccctcattatcttgtgagagtctctcaaacatctcacttatgctacctgaaaccttattttagttatttatgaatctacctaccttccataccagactatatactctttcaaagccatctttgaatcccctttgaggtcagccaagttcctggcccatagtttgtgggcagcacatatatgttgattttayttaagactgagataaggtaaggcaaggaaaagaggtgagaaaaattggcaacattccacaggcttagctcaggattttccatgaagccataccagagtttgaggccaccaagcagggttgagatggggcatgaatcagaggcttaaagaagagagactcatgaagtagtaggtaaagaaaaagtaaataatgatgtagaaactggtaggagaaggaaaaagaagagcctgagatttgaggtattgggattaaagaaaaaacctagggagggagaaatgagaaaataaacctaaactacat

SEQ ID NO: 120275 - DNA, 601 bp, Human
agcaaggacgacccggtaacactgtcatgtagctggattctgtcatgattagctaacaaagggttaggctctctttcagtgatccccgtttcctcttctccactcacactactctagatctagtccctcattatcttgtgagagtctctcaaacatctcacttatgctacctgaaaccttattttagttatttatgaatctacctaccttccataccagactatatactctttcaaagccatctttgaatcccctttgaggtcagccaagttcctggcccatagtttgtgggcagcacatrtatgttgattttatttaagactgagataaggtaaggcaaggaaaagaggtgagaaaaattggcaacattccacaggcttagctcaggattttccatgaagccataccagagtttgaggccaccaagcagggttgagatggggcatgaatcagaggcttaaagaagagagactcatgaagtagtaggtaaagaaaaagtaaataatgatgtagaaactggtaggagaaggaaaaagaagagcctgagatttgaggtattgggattaaagaaaaaacctagggagggagaaatgagaaaata

SEQ ID NO: 120276 - DNA, 601 bp, Human
tcactgggttccacagttctcttccgtgacccacggcttctaatagagctataacactcaccgcatggcccaagattccattccttggaatccgtgaggccaagaaccccaggtcagagaacatgaggcttgccaccatcttggaagtggcccgccgccattttggaagtggcctgccaccatcttgggagctctgggagcaaggacgacccggtaacactgtcatgtagctggattctgtcatgattagctaacaaagggttaggctctctttcagtgatccccgtttcctcttctccaytcacactactctagatctagtccctcattatcttgtgagagtctctcaaacatctcacttatgctacctgaaaccttattttagttatttatgaatctacctaccttccataccagactatatactctttcaaagccatctttgaatcccctttgaggtcagccaagttcctggcccatagtttgtgggcagcacatatatgttgattttatttaagactgagataaggtaaggcaaggaaaagaggtgagaaaaattggcaacattccacaggcttagctcaggattttccatgaagcc

SEQ ID NO: 120277 - DNA, 601 bp, Human
cttgcaactgcactttcttttggtctgtgtttgttacggctcgagctgagctttcgctcgccgtccaccactgctgtttgccactgttacagacctgtggctgacttccacagggtggatccagcagggtgtctgctgtactcctgatccagctaggcgcccactgctgctcccgatagggctacaggcttgccatcgttcctacatggctaagtgcccgggttcgtcctaatcgagctgaacactagtcagtcactgggttccacagttctcttccgtgacccacggcttctaatagagytataacactcaccgcatggcccaagattccattccttggaatccgtgaggccaagaaccccaggtcagagaacatgaggcttgccaccatcttggaagtggcccgccgccattttggaagtggcctgccaccatcttgggagctctgggagcaaggacgacccggtaacactgtcatgtagctggattctgtcatgattagctaacaaagggttaggctctctttcagtgatccccgtttcctcttctccactcacactactctagatctagtccctcattatcttgtgagagtctctca

SEQ ID NO: 120278 - DNA, 601 bp, Human
aagatatttaaacactgaacaccaccctgataaccaatttcctctttatcttagctttacctctgaggaaagcatccaaggagaaataggtcagaaaccattctattattaccattgcctttctgtggttcttttccatcttaaccaatgagatcagtgactctgcagaaacaactatgccagaagggggtcagtttgaggatatataccttagatgctgaaacagggaaatctcaacctgatatgccacttcctactgctttcatcacttccaaccctgcctcccccaggccgcaaagcaatacacatggcaggaatagaactaaacttgtccagtcacatccggtgagaagactgggggaaggcaggcaagaagacaaggccactggaacgcatgaggaacctagaaatgggacacagtgtgagtcgggcaggaatcagaaacaaggatagacactgcctacttagtctgcagaaggccctcctggtgaaaaagaagcagttagaaaacaataaccctggccaaagtgaatcaaactggacacagccccagcaaggcaagggaaagcccctgttgagagacaggactagctggatttcc

SEQ ID NO: 120279 - DNA, 601 bp, Human
tgactgatgaaaacacaaaaaaggaaaatgtgtccaagtgagtttgtagaagcatgactgaccagtgcctaaacatgaggagactttaaatctagaaagtgccttcatgttctgtgttagtagggagctccagctcagatttccacaagtattttgcaaaaagtagatactttgccaaagaccagatttccaagggctagatgttaacaacacttacagataagcagtgggaggataaggccctcatattcaccaaaagcaagatatttaaacactgaacaccaccctgataaccaatttyctctttatcttagctttacctctgaggaaagcatccaaggagaaataggtcagaaaccattctattattaccattgcctttctgtggttcttttccatcttaaccaatgagatcagtgactctgcagaaacaactatgccagaagggggtcagtttgaggatatataccttagatgctgaaacagggaaatctcaacctgatatgccacttcctactgctttcatcacttccaaccctgcctcccccaggccgcaaagcaatacacatggcaggaatagaactaaacttgtccagtcaca

SEQ ID NO: 120280 - DNA, 601 bp, Human
gcagtacttagaacagtacctgacacagagctggtgcttagtaagaacttatcgaaagaagatcagaataaaaggcatctctttaaattgaatataagtagcatgattaaaagctcgctcaattgctttaattttctcttattattaccaacacatacaaacttttaatctaaacagtttgcagaggaaagagtatggaattagactatgggttctactcccagggccaccagatgggccttggcctttatttcaggcaacaataaaatgaggatgacaacaatagtcttctagtttattkcaaaggcttacgcacatagaaacttcatgaaaagtataaaccaatatataagtacaaggtggggttgttactgtttttcccataggaagtgatttctaatgtcatatatcaaacatgttactgaaatttgttttacaacttttttcccagggacacagtccataaactgagtaatatctgtacatatcactaaagccttactcatgtaataaatatttctatgtactaactgctcccactctgaagcttactttacaaagacagcacttttgtagctttctctggaaggcactactggtt

SEQ ID NO: 120281 - DNA, 601 bp, Human
gacattttaacaagaaaacagtaggacaaatagccatcacagtttttttgttttctgtttttctgacacagagttttcctcttgttgcccaggttggagtgcaatggcatgatctcggctcattgcagcctccgcttctggggttcaagcgattctcctgcctcagcctcccaagtagctgggattacaggtgcctgccaccacacctggctacttttttgttgttgttgtatttttagtagagacagggtttcgccatgttggccaggctggtctcaaactcctagcctcagagagtgakcctcccaccttggcctcccaaagtgctgggattacggcgtgagccaccacacctggcctggccatcatagttaacatacaaatcccttaccatgttctacaagggccttcatgacctgtcctttccttcccctgccaacctctaagccggcactatgcagatcttattttagttcttcaggaacacagttttgtttgctcctgtctctagaccctggctcttgttaagccctctataatgtacttctcccagatctgcttatgtctgcctccttctcacttatatgatagctcaaatgta

SEQ ID NO: 120282 - DNA, 601 bp, Human
ttggagctttgagaaggagcatttggatttgagtatgttaaatatggggcaacttcccaaagaactgtgataatgtaatgactattctaagtactgggcacaaagttctggaagcttgtaacaaggtcattcccaagtacaagagaaatttatatgacccagtgatgaacttacagataggagaaagcgaaaagaaagtgggtgaacgaaagtacaggtagatctgagattcaagataatttaaattaagaaaaacatttcagcatgccatgccactgtcctggatattacgttaacctctttttttttttttttttttttgagacggagtctcactctgtcactctgtcacccaggctggagtgcagtggcacgatctcggctcactgcaacctccgcctcctgggttcaagtgattctcctgcctcggcctcccgagcagctgggactataggcacatgccaccacacccagctaatttttttctatttttagtagagacagggtttcaccgtgttagccaggatggtctcgatctcctgacctcatgatccacccgccttggcctctcaaggtgctgggattacaggcatgagccacc

SEQ ID NO: 120283 - DNA, 601 bp, Human
aaagcagcaaatattttgcctcaactagatactccctggacataagccagaagattatgtggtcaattttgaagaaaaagaacaaaatatactaacatgcataaatctttcgaataccacattgaagaagtgtttttatgtgcttggactctctgggaagaaatttccctttaaaacacacatacactaaacctaaatgcccattttcatgaacaaatcacatatgaaaacaggaatcctagattcagccagcaagggaaagacatgacacaatcaatcatggctggcatgggccagactraacccggtctctggcctgtatctgtatcctcatttcatgtaaattcacctctagatttcatttttaacaataatcagggtactaatttacttggagctttgagaaggagcatttggatttgagtatgttaaatatggggcaacttcccaaagaactgtgataatgtaatgactattctaagtactgggcacaaagttctggaagcttgtaacaaggtcattcccaagtacaagagaaatttatatgacccagtgatgaacttacagataggagaaagcgaaaagaaagtgggtgaacgaa

SEQ ID NO: 120284 - DNA, 601 bp, Human
gagatacagtctcgctctgttgcccaggctggagtgcagtggcacgatttcggctcactgccacctctgcctcccgggttcaagtgattctcctgcctcagcctcacgagtagctgggactacaggcatgtgccactgtgcccagctaatttttgtatttttagtagagacggggtttcaccatgttggccaggctggtctcgaacccctgacctcgtgacccacctgcctcagcctcccaaagtgctgggattacagtcatgagccaccgtgcccggcccacaatttggatttttttatkgtggtttgcatcctgtgctctgcaaagccttagtgatttctcagacatccttcaggagccatcacagtagggagaagaggagaataaaaataacagattttttaaaactgaagaaacacggttgttcagcattttgccttcattattttataaagatgagtgggaaatggtaaaaatggcacagccagtcactaataagcttagctcctgtagcctcaacatcatgaaaaaggcatggtaatcatcagggattcccaaagcagcaaatattttgcctcaactagatactccctggacata

SEQ ID NO: 120285 - DNA, 601 bp, Human
ctctgcctcctgggttcaagcaattctcctgcctcagcctcctgagtagctggaattacaggcgcctgccaccacactcagctaatttttttgtttttaataaagatggagtttcgccatattggccaagctggtctccaaactcctgacctcaggtgatccacccgcctcagcctcccaaagtgctgggattacaggtgtgagccaccacgtccagctgaaatttactttttaaattagtaaacaaaaaatattttagctctcatagcaccaccattcccaaattatataaaaagtgtgytctgaaaaaacagttatgatcaaagcttgactttgctttacacagtaaatgccacctgaaagtataattttaggttaaaatgtacacataagatctatttttgaagctatggtgttgtggttctgccagtttcaacagcactgccatctttttatggctgggtttacaatttggatttttttgttctttctttttcttttttttttttttttttgagatacagtctcgctctgttgcccaggctggagtgcagtggcacgatttcggctcactgccacctctgcctcccgggttcaagtg

SEQ ID NO: 120286 - DNA, 601 bp, Human
tttacacttttgaactcccttcactttatgccaatgacaacaaatgaaagtgagatctcacctttccttcctcgaggtgaagcaggaggactttatctcctggcttataatctttgagcagctctgctgacttccagacttcctctggatcaggtatccaaaccctggcaaactagaagacaaaaagaaaaaaatttaaactagcaaatcaattattttacaatcatatataaacatatgataactatttataattaaacaatttatgaaaaaagaaatcttggccaacatgaaattcacttttttttttttttttttttttttgagacagagttaagctcttgttgcccaggctggagtacagtggcatgatctcagctcacagcaacctctgcctcctgggttcaagcaattctcctgcctcagcctcctgagtagctggaattacaggcgcctgccaccacactcagctaatttttttgtttttaataaagatggagtttcgccatattggccaagctggtctccaaactcctgacctcaggtgatccacccgcctcagcctcccaaagtgctgggattacaggtgtgagccaccacg

SEQ ID NO: 120287 - DNA, 601 bp, Human
accatgcctctttttaaaaacactacaagcactccccatagcacaccagttaaatgcaagagttttaggattagatgtgaatctaaacctgataatcataataaattcacaggccaaaatagaagctttttaaagtatctgctattttcactaatctatgccattaaaaacactatcaggatagaaaactgagtttgccatttttaccaatttagtaagtaaaaattctaggtaagttcaaaatttaacttccattgggagtttacttcacagtaaatttacacttttgaactcccttcaytttatgccaatgacaacaaatgaaagtgagatctcacctttccttcctcgaggtgaagcaggaggactttatctcctggcttataatctttgagcagctctgctgacttccagacttcctctggatcaggtatccaaaccctggcaaactagaagacaaaaagaaaaaaatttaaactagcaaatcaattattttacaatcatatataaacatatgataactatttataattaaacaatttatgaaaaaagaaatcttggccaacatgaaattcactttttttttttttttttttttttt

SEQ ID NO: 120288 - DNA, 601 bp, Human
caacacaatgacattcattaattacaaagggaaaacagtaactttacagtggataacatggcagacatcaccttaagcaactggtcatggccagcaatctgcaaaaatccaatatagtcaaatagtataagcactcatcttagagtcatctgtgttcaaatctcacttcaaattccaaaagccacttcctggctgtgtgaccttgagcaaaactacttaatgactttgaagtttggctttcttatttggaaaatagtgattatatcacctgccaacccatagggttggtgtgaaatttaaygtgagaaaattcactccaaagtgccgaacattttgcctaacaaagcagatgaccaataaatgttaaataagttaattccctagtttggtattaaaagccctcctaattggcctaattcttccccgccttcctcccaactagtatcttcccctcagttttgctctccatgctgccaccaatgagtctcctctaagacctggcaccatgcctctttttaaaaacactacaagcactccccatagcacaccagttaaatgcaagagttttaggattagatgtgaatctaaacctgataatcat

SEQ ID NO: 120289 - DNA, 601 bp, Human
caagatcatgctactgaactccagcctgtgctacagagtgagactccatctcaaaaaaaaacaaaaaaacaaaacaaaacaaaacaaacgacattttaatagggttcctggtcccaaaagttaacaagtactattcagttaatttttaatagagatgggggtctcactatgttgcccaggctgatctcgaactcctggcctcaagggatcctcctgcattggcctcccaaatgctgggattacaggtgtgagtgaccattactagccactattcactttaaagtcacgggaatacggcttyatggcacagccaaccatgaatattgtcacttaactatataaaggggcaaataacataggacaagtgaataggaataaaaattcaatttagttgtagggagggacaaggttttgtaaaaagccagttatggtaatactaaaaatatatacagaggtcaaatattcaaatcatatttgaacgaattatgctaaaggagagaaaaattaacaatttaccactcagcatttcttgctgcctgtttatcagagaatatcacccttgcctggggctgactggtccttgcattggccctgtaaatac

SEQ ID NO: 120290 - DNA, 601 bp, Human
gcttattcattcatcagatttaggccggacgcagtggctcacacctgtaatcccagtactttgggaagccaaggcgggcggattacctgaggtcaggagttcgagaccagcctggccaacatggcaagactccgtctttattaaaaatacaaaaattggccaggcatggtggctcatgcctgtaatcccaacactttgggaggccgaggtgggtggatcacctgaggtcaggagttcgagaccagcctggccaacatggtgaaaccccatctctactaaaaactcaaaaattatccaggcrtggtggtgggcacctgtaattccaaatactcgggaggctgagccaggagaatcacttgaaccctggaagcagaggttgcagtgagccaagatcatgctactgaactccagcctgtgctacagagtgagactccatctcaaaaaaaaacaaaaaaacaaaacaaaacaaaacaaacgacattttaatagggttcctggtcccaaaagttaacaagtactattcagttaatttttaatagagatgggggtctcactatgttgcccaggctgatctcgaactcctggcctcaagggatcctcc

SEQ ID NO: 120291 - DNA, 601 bp, Human
gtaaaatgggctaacagggttgtggtaaaaaagtaaatgaggcaagtccggcatgtggtaagtacttaggaatccttaaaccactagatacccaagaatcccctgaaattacgtgcaacaactctgtgtgtatgtgcacatatgtgtactttttttgaggcaagacaattcatagttttcatgagatttttgttttgtttgctttttgtttttttctgtgcatatgcttattcattcatcagatttaggccggacgcagtggctcacacctgtaatcccagtactttgggaagccaaggcrggcggattacctgaggtcaggagttcgagaccagcctggccaacatggcaagactccgtctttattaaaaatacaaaaattggccaggcatggtggctcatgcctgtaatcccaacactttgggaggccgaggtgggtggatcacctgaggtcaggagttcgagaccagcctggccaacatggtgaaaccccatctctactaaaaactcaaaaattatccaggcatggtggtgggcacctgtaattccaaatactcgggaggctgagccaggagaatcacttgaaccctggaagcagagg

SEQ ID NO: 120292 - DNA, 601 bp, Human
aataagtttggaatcaataaagcggactctgagattatggagcacagcaggctcatgaagatagctgagggctgtgaggtcattttcaccaacaagtatgtcaggatttcgtaagtgaggcagctccttggtctttggatctagatggtattccaaatcctgaaaatgcacaaggcacagcatctggatgaattatggcaaggactgtgaaagaggcccatgcattttgcttacttcctattcctgatttgcttctcagctattaaatgcattattttcctagcaccttccaatatcacakaaactggtggagatggaaacaatatgaagtgcgttttcattagacataccaacctgtattaacaatttttgctaatatactttgaaagccatagcctagacctttttcacccacgtactgaatcagaagttttaaacttttaaatatgtttctctcctccaaccccttttacctataaaaaagtggcggacaatataaaagagtggtcgagagcttggctctaggatcagattgcccaggattcaaatcctgatactaatacttactttttatgtggtcttgagttacagtatttcaccc

SEQ ID NO: 120293 - DNA, 601 bp, Human
ttttttatacttttctgtatttcctaagaatttttctgtaggtgtatattaacttaatgaagtcgtccattcaataaatgtttattcagctccaactatgtgtaaagtcatttctaaatgctgaacttacaacagtaaacaaacaaacaaacaaaaaagactaatctttaccctcatggaacttaaactctagtgggaaattcagacaattaacaagataagtaagaaaatatatatatacataatctcagattaaattgtaataaggaaaagaaggcaaaaaataatgcagggaagaaasacagtaaggaggggtttctgacttgatagggtggctagacaagacttcactgagaaggtaacacatgtgcaaggaaaaaaaatggaagaaaaataacaattgagaaacagaaatagttaccagaaaggaaaagttagtatcaatgatataaaggatgttaattattttaagaagaaaaggtggctgttcctgtctaaaacaggagagtaatgaagaaatcatgagcactgagttggatataccacacgaatgaatggaaatccagatttgagcttccgaggacagagtgattagtgaaag

SEQ ID NO: 120294 - DNA, 601 bp, Human
tgagttacatataattgtttttcctttttttatacttttctgtatttcctaagaatttttctgtaggtgtatattaacttaatgaagtcgtccattcaataaatgtttattcagctccaactatgtgtaaagtcatttctaaatgctgaacttacaacagtaaacaaacaaacaaacaaaaaagactaatctttaccctcatggaacttaaactctagtgggaaattcagacaattaacaagataagtaagaaaatatatatatacataatctcagattaaattgtaataaggaaaagaargcaaaaaataatgcagggaagaaacacagtaaggaggggtttctgacttgatagggtggctagacaagacttcactgagaaggtaacacatgtgcaaggaaaaaaaatggaagaaaaataacaattgagaaacagaaatagttaccagaaaggaaaagttagtatcaatgatataaaggatgttaattattttaagaagaaaaggtggctgttcctgtctaaaacaggagagtaatgaagaaatcatgagcactgagttggatataccacacgaatgaatggaaatccagatttgagctt

SEQ ID NO: 120295 - DNA, 601 bp, Human
tcagattaaattgtaataaggaaaagaaggcaaaaaataatgcagggaagaaagacagtaaggaggggtttctgacttgatagggtggccagacaagacttcactgagaaggtccaaatcatgtttttgaaggatattaaatgtcataggaaaacataatacaaaactatatatagactgattccaattttctatcaacttatgcatacaaagagaaaggatgtaaatcaatattaatactggctatttttcagtggtgagttacatataattgtttttcctttttttatacttttctgtrtttcctaagaatttttctgtaggtgtatattaacttaatgaagtcgtccattcaataaatgtttattcagctccaactatgtgtaaagtcatttctaaatgctgaacttacaacagtaaacaaacaaacaaacaaaaaagactaatctttaccctcatggaacttaaactctagtgggaaattcagacaattaacaagataagtaagaaaatatatatatacataatctcagattaaattgtaataaggaaaagaaggcaaaaaataatgcagggaagaaacacagtaaggaggggtttc

SEQ ID NO: 120296 - DNA, 601 bp, Human
gtcgtccattcaataaatctcagattaaattgtaataaggaaaagaaggcaaaaaataatgcagggaagaaagacagtaaggaggggtttctgacttgatagggtggccagacaagacttcactgagaaggtccaaatcatgtttttgaaggatattaaatgtcataggaaaacataatacaaaactatatatagactgattccaattttctatcaacttatgcatacaaagagaaaggatgtaaatcaatattaatactggctatttttcagtggtgagttacatataattgtttttcctttttttatacttttctgtatttcctaagaatttttctgtaggtgtatattaacttaatgaagtcgtccattcaataaatgtttattcagctccaactatgtgtaaagtcatttctaaatgctgaacttacaacagtaaacaaacaaacaaacaaaaaagactaatctttaccctcatggaacttaaactctagtgggaaattcagacaattaacaagataagtaagaaaatatatatatacataatctcagattaaattgtaataaggaaaagaaggcaaaaaataatgcagggaagaaa

SEQ ID NO: 120297 - DNA, 601 bp, Human
ttgcttgtaagcttcttcagctactgcaaagatatgtggatccatatcacccatgttctgaccactgtatgcattaataatatcttctccataaataggcagctgttcatagggatttatagctactaggactatacctgggaatagggtaggggacaagaaagaaaaagaagtcaatgataccctaatgggcatatcaaacttagtaaagtgagactcacagttaacacaatccttcatttcaatttagttaatattaaaccaataaattgttcaaggatcaaaatgtatcatagccttygcctctgaacccattatacatagttctgcctaaaacaccatttaaaaactggactaggtggcttaaaataatgtggcaatgttataagaactttaaatatcttcatatatttaatccaaaaattccactttacttctacaatttatccaaatgaaataatcagaaattcatgcaaagagtttttttttttttttcacaaagatgtttatcataatgttatctgtaacagtgaaaatggaaacaaaatatatagggcaaggagactagttgaatgcattctgttacatccatatgatagac

SEQ ID NO: 120298 - DNA, 601 bp, Human
tgctattagaagtatccatattaatattattttattattaaaagggcataatgatttctagggttttgtccctgaaataattctaaaattctgtcacatgctggaccaatcatgtatactctccctggctggagaggacaaaataaaaacctctgcagtattagttttctttccaccttataaattactcgtgggtttcccatattatatttataatgtgttctgctttgtaggctggagaaatgaattaaacttaaactattcttctacacattcacagttttatattttattatattaytaagagcataatctagtcctgaaagtaacatttttctcccattttccaccctcaaaatgttagggttccatggttaatataagagacattttgcagatgctgttcaggataactgatgccctatcatataatactaatgttaaaattcacactttcagttgggcatggtagtgtatgcctgcagtaccaactactcaggaggctgaagaaggaggatcacttgagcccaggagttcaagcccagcctgggcaacatagcaagaccccatcttgaaagaaaaaaatttcacactttccttt

SEQ ID NO: 120299 - DNA, 601 bp, Human
gtgttcaataaatctctattacatgaatgatgaattgtaccttccctgaagacatgagggatccctagaaatggtgataatgtgaaacaccaggatttgcatctagaaagatgacatctttgtttgacaagaaaacaatggtaaggctggctgggcgtggtggctcatgcctgtaatcccagcactttgggaggccgaggtgggcggatcacgaggtcaggagatagagaccaacctggctaacacagtgaaaccccgtctccactaaaaatacaaaaaattagctgggcgtggtggcagstgcctgtagtcccagctactcgggaggctgaggcaggagaatggcgtgaacccgggaggcggaggttgcagtgagctgagattgcgccactgcactccagcttgggtgacagggcaagactccgtcttaaaaaaaaaaaaaaagaaaagaaaacaatggcaagaaatgatcctgcagcagttatttctgactgtaagcctgaatagatacactctattttactgctgtggcagatgttatgggtatagatttatttatataaatggtaaatataataccataactaattgaggcatattt

SEQ ID NO: 120300 - DNA, 601 bp, Human
gcttaagtgatcggcctacagacgtgcgccaccatgcccagctaatagttttattgttaatcatgcctgacttcgtggggtaggaattcctgtctatttaatttgtatcccccatgcccagaacagtgtctggcgtttggacggtgttcaataaatctctattacatgaatgatgaattgtaccttccctgaagacatgagggatccctagaaatggtgataatgtgaaacaccaggatttgcatctagaaagatgacatctttgtttgacaagaaaacaatggtaaggctggctgggcgkggtggctcatgcctgtaatcccagcactttgggaggccgaggtgggcggatcacgaggtcaggagatagagaccaacctggctaacacagtgaaaccccgtctccactaaaaatacaaaaaattagctgggcgtggtggcaggtgcctgtagtcccagctactcgggaggctgaggcaggagaatggcgtgaacccgggaggcggaggttgcagtgagctgagattgcgccactgcactccagcttgggtgacagggcaagactccgtcttaaaaaaaaaaaaaaagaaaagaaaacaat

SEQ ID NO: 120301 - DNA, 601 bp, Human
aagaattcctagtatgagttttgcttttaggatagatgtcaaaaacatcttttcaaccttaaagatctaaattagaactctgctcccttccccctactccccaccctacaacacacacaacctgctcttcctgccatcttctacatctcaataaacagcaactccaaccttctaggtgctcagtccaaatccttactgccatccttaactcctctttttctcaaataccccatataagcaaggctttgccagttctgtcttaaaaatatacccagaatccatctactttttaccacctccrctaattaaatgatcatcttttccatggatcaaggcaataacctcccaactagtctcctggcctctacccttgctccagcacagtatgttcttctaatttttttgtaactttacttttttgttgtttttgtagatagggtcttgctctgtcacccaggcaggaatgcagtggcaccatcttggcccactgcagccttcaactcctgggctcaagcgatcctcccacctctgactcctgagtagctgggactaaaggcacaggccaccatgcctggctagtttttgtattttgtttgtaaag

SEQ ID NO: 120302 - DNA, 601 bp, Human
aactgattatcactcacagtggagagaaaatatagcaaattaaagccatcaacactacctggttttaaggaaacaacacaaaacaaaacaaaaatcctagttacagcatgagaaaagactggcaagaatgtcaaacaagaataaaataaaaaaataggcatggcagtccactgagtgtttctccatggtaagtcaacaaggacaattaaaattaaaaggctattctaggaaggtattttatgagggcattgtactctctaaggagcatgtttaaaaagaagccatgagtcaaggatccagytcaaggatcctggttattgctgatgtcactggacatagatctgcttggaaagaattcctagtatgagttttgcttttaggatagatgtcaaaaacatcttttcaaccttaaagatctaaattagaactctgctcccttccccctactccccaccctacaacacacacaacctgctcttcctgccatcttctacatctcaataaacagcaactccaaccttctaggtgctcagtccaaatccttactgccatccttaactcctctttttctcaaataccccatataagcaaggctttgcca

SEQ ID NO: 120303 - DNA, 601 bp, Human
gtagagctgggttgttacaccccacatctcttgatttccaggggaaagtctacacaatgcttcttctgctttgttacacagctccctaccatggtctcccctcaattaaaatgtttatgcattagttcccatcaaacataaagataacaaatgcataccacagaaacctgtacatgtaaagctagatcatcagtgacactgttccgttttatagatgataaaacggagactcagggagaccaggagatttgagcttatatgattagttattggtagatacgtgactagtacagatgtcttyttcactagaccaaagttaattgcatataacttatttcaagcaaatttaaataaatgaaacttagtcaataaaactgattatcactcacagtggagagaaaatatagcaaattaaagccatcaacactacctggttttaaggaaacaacacaaaacaaaacaaaaatcctagttacagcatgagaaaagactggcaagaatgtcaaacaagaataaaataaaaaaataggcatggcagtccactgagtgtttctccatggtaagtcaacaaggacaattaaaattaaaaggctattctagg

SEQ ID NO: 120304 - DNA, 601 bp, Human
tcaactagatgtagcctatcaaccttgctctttcttgcatccacaacaatgagccaaataaatttctgttcattataaattacccagtctggtattcttatataccagtataaaacagactaagatactcatataatggagaattctaaagagaaatcatttactgtgagctggggtcatctgaaagtaaaatctgagtgggataatgaagtataaatataaatcagacagataaaaaagcatggagcaagatattctaggctaaataaaagatgtagaaatagaactatgccatcttaaygtgagggaatagatctgttagaatagggccaggtagttgaaagtaagaaaactaaatgacaaagaagaaaggcttcagagtctcaaagctggattcaaatctcagctcttagataccatttattagcatatggcctggacaagctactttcctcacctgtaaagcagtggtgatctgctccagggatataatgaggattacatgcctggcaccatgtttggtacacagtagacctcaaatatggtagatatttattaatttaagttaacccacctttatataacatatataaaattatcc

SEQ ID NO: 120305 - DNA, 601 bp, Human
cacatggctatcagatcctctcaaatcaacctgagttttctgttccatcagtacagagcctatgcattatataaagatgctagagcagaaatagccaactatatttgtttataacttttacatactctagttctctaatatatactgtattttattcctgctgcaaccttctggggtagataatattcagtaagtcccaaactagcagtttaatgttatggtttgaatgtgttcctcaaagttcatatgttgcaaactgaatcctcaatacaacagcgttgagaggtgagactttaaaatktgactaggccaggcatggtggctcacgcctgtaatcccagcactttgggaaggtgaggcaggaggatcacttgagcttaggaatttgagaccagcctgggcaacatagtgagattccatctctacaagaaagaaaaaattagctgggcatcactgcatatgcctgtagtcctaactacttgggaggctgaggtgggaggatcacttgagcctgggaggttgaggctgtagtgaaccatgactgtgccactacacccttgcctgggtgacatagtgagaccctgtattacaaaaaaaaaaa

SEQ ID NO: 120306 - DNA, 601 bp, Human
cagttcctggtgagaagcctgtcacatggctatcagatcctctcaaatcaacctgagttttctgttccatcagtacagagcctatgcattatataaagatgctagagcagaaatagccaactatatttgtttataacttttacatactctagttctctaatatatactgtattttattcctgctgcaaccttctggggtagataatattcagtaagtcccaaactagcagtttaatgttatggtttgaatgtgttcctcaaagttcatatgttgcaaactgaatcctcaatacaacagcgktgagaggtgagactttaaaatgtgactaggccaggcatggtggctcacgcctgtaatcccagcactttgggaaggtgaggcaggaggatcacttgagcttaggaatttgagaccagcctgggcaacatagtgagattccatctctacaagaaagaaaaaattagctgggcatcactgcatatgcctgtagtcctaactacttgggaggctgaggtgggaggatcacttgagcctgggaggttgaggctgtagtgaaccatgactgtgccactacacccttgcctgggtgacatagtgaga

SEQ ID NO: 120307 - DNA, 601 bp, Human
tacatcatcactcataaaaatcaagctgctctgctctctgtgtctctctgattcctacttttaattagtctcaataagaaaatgcttaaaccctaaagttaatactagacaatgagtttacaattataatattaattttatttttgaagcacaaatatttactataaaaatggttgctggcactgttgaacgctttagagaggcagacagacttctcaggaaatgaaaacaagtgtttcctagagatacttgctgaggtcactcagttcctggtgagaagcctgtcacatggctatcagaycctctcaaatcaacctgagttttctgttccatcagtacagagcctatgcattatataaagatgctagagcagaaatagccaactatatttgtttataacttttacatactctagttctctaatatatactgtattttattcctgctgcaaccttctggggtagataatattcagtaagtcccaaactagcagtttaatgttatggtttgaatgtgttcctcaaagttcatatgttgcaaactgaatcctcaatacaacagcgttgagaggtgagactttaaaatgtgactaggccaggca

SEQ ID NO: 120308 - DNA, 601 bp, Human
cagttggaagtaactgctataaaaaaggtctatctaagatactatgaaagtagaaaggaagggtatggaaccagtaggagatgtgaggaggagatgtcaggaaagcctttccagagaaggtaataccagaattgagagggtaataccagaattgactcatatatatgatcattaggagaaaaccaggttctgtgagaataaggaaatggagttaaattatgtagaagcactcgaaaccccaggaaacaattattcaaggatgagcaagagagagatagagaaagagagaaagagagagagmcagagagagagagagccggggtgggggagggtgtctgttagcctttattttcctcttatggtcatcagtgaccttatatctatttggtctgtcgggtctttccttatagttttcattttgtatgaaatgtattattttatagattttcctttcgaattttaccctttaaaatatgtaatctctctagtttatcatggtcataccaaacactattcatatcttccaagatcatcaacttgtcctctgtaaacttaataaacatactttcaattacatctacgtcatcaacaaggaaattaa

SEQ ID NO: 120309 - DNA, 601 bp, Human
aataaacttctgctctttataaatcacccagtctgtggtattctgttatagcagcagaaactggactaagacagtcatctaataggaaagacaggccaataattcaagactgtaatacatgtgatggggccgtaagaggaagaagaggttatcagggaagattccctagagatgacagctgaacaaggtctacaaaaatgagtaagagaaagcaagcaaggactatagaagtcaggaagggtacattccaggcaaaagggatagcataaatgaaggctcagaatcagaagtttggaaagarcagataactcagcttagctggaaaatggagtaatgacagatttatgatttctggtttggccagtcctttcaagggcctccacaataatcctaaataggctgggtactgggtgctttggagtggaggtgagctcttctgacctgtttccagaaggtctaatgtgaactaaaagccctcttaaaaatactgcttcattcgttcatttaacaaacacataataagcagctacaatgtgctaatcactttatggaaataaaagactctagggtcatagtcaattgagagagactagaaaggaca

SEQ ID NO: 120310 - DNA, 601 bp, Human
tttcagcctccagaacagtgagtcaaataaacttctgctctttataaatcacccagtctgtggtattctgttatagcagcagaaactggactaagacagtcatctaataggaaagacaggccaataattcaagactgtaatacatgtgatggggccgtaagaggaagaagaggttatcagggaagattccctagagatgacagctgaacaaggtctacaaaaatgagtaagagaaagcaagcaaggactatagaagtcaggaagggtacattccaggcaaaagggatagcataaatgaagrctcagaatcagaagtttggaaagagcagataactcagcttagctggaaaatggagtaatgacagatttatgatttctggtttggccagtcctttcaagggcctccacaataatcctaaataggctgggtactgggtgctttggagtggaggtgagctcttctgacctgtttccagaaggtctaatgtgaactaaaagccctcttaaaaatactgcttcattcgttcatttaacaaacacataataagcagctacaatgtgctaatcactttatggaaataaaagactctagggtcatagt

SEQ ID NO: 120311 - DNA, 601 bp, Human
gtgccctcctactactgaatgacctttgccagatgccagcgctgtgctcttggacttttcagcctccagaacagtgagtcaaataaacttctgctctttataaatcacccagtctgtggtattctgttatagcagcagaaactggactaagacagtcatctaataggaaagacaggccaataattcaagactgtaatacatgtgatggggccgtaagaggaagaagaggttatcagggaagattccctagagatgacagctgaacaaggtctacaaaaatgagtaagagaaagcaagcaargactatagaagtcaggaagggtacattccaggcaaaagggatagcataaatgaaggctcagaatcagaagtttggaaagagcagataactcagcttagctggaaaatggagtaatgacagatttatgatttctggtttggccagtcctttcaagggcctccacaataatcctaaataggctgggtactgggtgctttggagtggaggtgagctcttctgacctgtttccagaaggtctaatgtgaactaaaagccctcttaaaaatactgcttcattcgttcatttaacaaacacataat

SEQ ID NO: 120312 - DNA, 601 bp, Human
tgctggcttggcttcattcaactaaaagttaaataagtcatgatctgtatcctcatgtggttgacggatgttgtggtttgaatgttctctccaaaattcatgttgaaatttaattgccaacatgatgatattgggaggtggggcctttaagagctgattaggtcatgaggcccctcccctcaggaatggattaatggcatgaatgcaggagtgagctagtcatcacgggagtgggctcctgataaaaggatgagtttaagctgatttcctctctgcctcacatgctcatgtgccctcctaytactgaatgacctttgccagatgccagcgctgtgctcttggacttttcagcctccagaacagtgagtcaaataaacttctgctctttataaatcacccagtctgtggtattctgttatagcagcagaaactggactaagacagtcatctaataggaaagacaggccaataattcaagactgtaatacatgtgatggggccgtaagaggaagaagaggttatcagggaagattccctagagatgacagctgaacaaggtctacaaaaatgagtaagagaaagcaagcaaggactatagaag

SEQ ID NO: 120313 - DNA, 601 bp, Human
aaagtatcctcatcactagagaagaaatagtccatttgctggcttggcttcattcaactaaaagttaaataagtcatgatctgtatcctcatgtggttgacggatgttgtggtttgaatgttctctccaaaattcatgttgaaatttaattgccaacatgatgatattgggaggtggggcctttaagagctgattaggtcatgaggcccctcccctcaggaatggattaatggcatgaatgcaggagtgagctagtcatcacgggagtgggctcctgataaaaggatgagtttaagctgayttcctctctgcctcacatgctcatgtgccctcctactactgaatgacctttgccagatgccagcgctgtgctcttggacttttcagcctccagaacagtgagtcaaataaacttctgctctttataaatcacccagtctgtggtattctgttatagcagcagaaactggactaagacagtcatctaataggaaagacaggccaataattcaagactgtaatacatgtgatggggccgtaagaggaagaagaggttatcagggaagattccctagagatgacagctgaacaaggtctacaa

SEQ ID NO: 120314 - DNA, 601 bp, Human
taaattaccagctaacaatcctcaaaatggcatctcccacaaactctagctcctattaaagtatcctcatcactagagaagaaatagtccatttgctggcttggcttcattcaactaaaagttaaataagtcatgatctgtatcctcatgtggttgacggatgttgtggtttgaatgttctctccaaaattcatgttgaaatttaattgccaacatgatgatattgggaggtggggcctttaagagctgattaggtcatgaggcccctcccctcaggaatggattaatggcatgaatgcargagtgagctagtcatcacgggagtgggctcctgataaaaggatgagtttaagctgatttcctctctgcctcacatgctcatgtgccctcctactactgaatgacctttgccagatgccagcgctgtgctcttggacttttcagcctccagaacagtgagtcaaataaacttctgctctttataaatcacccagtctgtggtattctgttatagcagcagaaactggactaagacagtcatctaataggaaagacaggccaataattcaagactgtaatacatgtgatggggccgtaagag

SEQ ID NO: 120315 - DNA, 601 bp, Human
tgtttaaagttacaaaaccatttaaaatattttaaattaccagctaacaatcctcaaaatggcatctcccacaaactctagctcctattaaagtatcctcatcactagagaagaaatagtccatttgctggcttggcttcattcaactaaaagttaaataagtcatgatctgtatcctcatgtggttgacggatgttgtggtttgaatgttctctccaaaattcatgttgaaatttaattgccaacatgatgatattgggaggtggggcctttaagagctgattaggtcatgaggcccctsccctcaggaatggattaatggcatgaatgcaggagtgagctagtcatcacgggagtgggctcctgataaaaggatgagtttaagctgatttcctctctgcctcacatgctcatgtgccctcctactactgaatgacctttgccagatgccagcgctgtgctcttggacttttcagcctccagaacagtgagtcaaataaacttctgctctttataaatcacccagtctgtggtattctgttatagcagcagaaactggactaagacagtcatctaataggaaagacaggccaataattca

SEQ ID NO: 120316 - DNA, 601 bp, Human
agagaaacagggtcttcacaatgcctgggaaaggaggagagataaggctcactagccaaagaaaaacaggcagttaatttttaaaggactccagctctttctctttctcagggggaaatggattttcttacatacaactgagtttctgcttacacattctttaatttcttttaattcctgttccactgcccacttggcaatgtgattaacattatttcttctgtgttcttcgtgataaggcacagtgagtttttgctggttcatacatgcaacagtgtggaaaggaacataagaatgatayttcctaaaaataatatctacttataaattaaaaaataacacagaggaagaagatatcaagcattaaattagagagcatcacaactaaggatgaatctgcaatagagggcctctgaattcttatgtgtacaaatctcaaacatattattttattcctaaagaattacttcaatatcttacagtactgttgtcaaccacttcaggagatactctttgaagccacagcaaagaaatttaaatttacaaagaaatttaatttgtttaaagttacaaaaccatttaaaatattttaaattaccag

SEQ ID NO: 120317 - DNA, 601 bp, Human
tggcagaaccactcacagttgcaaagtatcgcatggcatacttagctgagactgtttttcctgccccagactctccacttacgatgatggactgatttcgttcatctctgtaaaataaaaattttttaaaaagtaactgccattgctgcctatagcaggattgataagggaaactatggtctctatggaagtagggggctaattaatggattttttggtcgatactggtgcttataacaccaaggtctcaggttcaatccctatactggccaccagaaatgttgcaggatatatatatatattttttaaggaatcagagagaccgatggggttgaggaggatatttattatttaggtgcaccagcccagtcagattaacatccaaaggaccaagccctgaacaaagcgttaagttaccttttaaacatttcatggggtgtgggggagatctgtgcagggggaagcatattacagaagtaagaaacaaagacagttattcaattaattgagacatgcattacatcatttcttttcaagaaaaaacatgttttatgacttgggtttatctgtctagtgactttgcagctgcacagctagagaa

SEQ ID NO: 120318 - DNA, 601 bp, Human
actggcagaaccactcacagttgcaaagtatcgcatggcatacttagctgagactgtttttcctgccccagactctccacttacgatgatggactgatttcgttcatctctgtaaaataaaaattttttaaaaagtaactgccattgctgcctatagcaggattgataagggaaactatggtctctatggaagtagggggctaattaatggattttttggtcgatactggtgcttataacaccaaggtctcaggttcaatccctatactggccaccagaaatgttgcaggatatatatatwttttttttaaggaatcagagagaccgatggggttgaggaggatatttattatttaggtgcaccagcccagtcagattaacatccaaaggaccaagccctgaacaaagcgttaagttaccttttaaacatttcatggggtgtgggggagatctgtgcagggggaagcatattacagaagtaagaaacaaagacagttattcaattaattgagacatgcattacatcatttcttttcaagaaaaaacatgttttatgacttgggtttatctgtctagtgactttgcagctgcacagctagag

SEQ ID NO: 120319 - DNA, 601 bp, Human
agtggctggagaccccaggctttctgagacatgctgtatcaatcaattttttgagcatgtttcttatcaagagaatataggaagaaagccgaagactcgctgtcttacctccatgatggggttggaggccaagaccttttcctccacattggcctcactggcagaaccactcacagttgcaaagtatcgcatggcatacttagctgagactgtttttcctgccccagactctccacttacgatgatggactgatttcgttcatctctgtaaaataaaaattttttaaaaagtaactgccaktgctgcctatagcaggattgataagggaaactatggtctctatggaagtagggggctaattaatggattttttggtcgatactggtgcttataacaccaaggtctcaggttcaatccctatactggccaccagaaatgttgcaggatatatatatattttttttaaggaatcagagagaccgatggggttgaggaggatatttattatttaggtgcaccagcccagtcagattaacatccaaaggaccaagccctgaacaaagcgttaagttaccttttaaacatttcatggggtgtggg

SEQ ID NO: 120320 - DNA, 601 bp, Human
acggcattctgttctgaagtgtcacacgcagcaccgcaaaccaagcacaattacctctacatagattatcgcaaaaaccacttgtaccacaggtgcaccaggccgattttaactccatctgtgtttgggtgacaaataaagcttgacaaaggaaaaagacaggaataaaaaaatgccgatttgaatttttaacaaggaaggtttgcttctgcatgtccaaattaatttctctccatttaacaaaagtaatttttctccatttaataagtcttcatataaaactataactttccaaaaatcwtattaatagacagataattatctacaaatcctaaaacactcaaattctcacacaattagttccattttcattggcacaggcatttctactttgtatatggtgtattcaagttttgaaagcacattttttcatagttcttcccctgtcaaaaccttacagttactgtcttttatgaacctatagctgtgttatgtgcttgacagaacaacaacaacaacaaaaagcttataaagatcatagtttaagtttgtagttcaaatctggaaaaaaattaaaactttagctatattaaaatttaag

SEQ ID NO: 120321 - DNA, 601 bp, Human
ccagaagcctagcagatgccagagccatgcttactgtacagcccacagaaccatgagctaaataaatctctttctttataaattacccagcctcaggtattctgaggctatagttatagcaacactaaatggactaagacagtagctattccaaatttttaatatattcctactaatacaattcaaatctgtgttgcagaaaaaccaataaagctggttttttttgaaagaggtcataaaatagttcactcaactcatgaaaaattctagaaggttcattctagacttaagttatcttcamagacaacttcaaatcctagtattatatggtccaggcccggaagaaatgggattacctaatgccatcacattcaagactttgggatattctaatgctagggactaaaatggctggaactgttgtcaaataccaagaatttgtcatgaccaaaaccagtcaaaacaacaacagcaagaaaagaagccctgttgttttctgaccccaaaccaaaaactggctccacagattctatttccccagtattaacactagtgacatccagcagtgtatctgtagcttacattctttcaaaatcttaac

SEQ ID NO: 120322 - DNA, 601 bp, Human
gtgtccacttgccctgtgacattctctgccatgttatgcagcacgccggccctcaccagaagcctagcagatgccagagccatgcttactgtacagcccacagaaccatgagctaaataaatctctttctttataaattacccagcctcaggtattctgaggctatagttatagcaacactaaatggactaagacagtagctattccaaatttttaatatattcctactaatacaattcaaatctgtgttgcagaaaaaccaataaagctggttttttttgaaagaggtcataaaatagtwcactcaactcatgaaaaattctagaaggttcattctagacttaagttatcttcaaagacaacttcaaatcctagtattatatggtccaggcccggaagaaatgggattacctaatgccatcacattcaagactttgggatattctaatgctagggactaaaatggctggaactgttgtcaaataccaagaatttgtcatgaccaaaaccagtcaaaacaacaacagcaagaaaagaagccctgttgttttctgaccccaaaccaaaaactggctccacagattctatttccccagtatta

SEQ ID NO: 120323 - DNA, 601 bp, Human
tcacacccataatcccagcactttgggaagctgaggcaggaggattgtttgagcccagtagttcatttgagatcagcctgggacaggccgagacagagcaagaccctgtctcttaaaaaaaaaaaagtttcagtgtgctattcccatcttatgatgaaaatttccaggaaaaaatgaaaacatgaaatgaagcaaatagaataattatctgtacatcattcacattttgcaaaagaagcctatgttgagaatgaggagcttcctttttaaagaataatgtgcatatctctttagaccctgrattgtaatgttaaccatgtaggatgctcattatcctatgaggagtttcagcagatcactggagacgccgatatgcctttcctgacatctcagcaaagggctctgatatagggacatagtattgaagcgatttaaagctacaaatttttcagactacatactcaatattttacctatgttttcttccagtaactgatcttcagctccatatcacatttccaactttcaaattgagatgcccttttttgtagttattgaaaattagttcaactctttaccaaatttttcttaatccaaattc

SEQ ID NO: 120324 - DNA, 601 bp, Human
tcaagaccagcctgaccaacacggtgaaaccctatctctatttaaaatacgacagtagctgagcgtggtggcatgtgcctgtaatcccagctactcgggaggctgaggcaggagaatcgtttgaatccaggaggtggaggctgcagtgagctgagatcatgccattgcactgcagcctggacaacaagagcgaaactctgtctcaaaaaaaaaaaaaaaaaaaaaaattaacatccaggcctggtagagtggctcacacccataatcccagcactttgggaagctgaggcaggaggattgyttgagcccagtagttcatttgagatcagcctgggacaggccgagacagagcaagaccctgtctcttaaaaaaaaaaaagtttcagtgtgctattcccatcttatgatgaaaatttccaggaaaaaatgaaaacatgaaatgaagcaaatagaataattatctgtacatcattcacattttgcaaaagaagcctatgttgagaatgaggagcttcctttttaaagaataatgtgcatatctctttagaccctggattgtaatgttaaccatgtaggatgctcattatcctatgaggagttt

SEQ ID NO: 120325 - DNA, 601 bp, Human
aaatgttttatataaccttaaaaattttaatgacatatgtctttctgatttaggtaactcgcttctataaatttttttaaggcaaagcaaaaaaaaaaaagatgtagttagaaaaccaagtgtttacataatgcatatattaaatgtttaataagcaaatttcaaaaaaattaatatctttcacttgtgtaaagcctatgtcaggattagtaaattgaaaccacagcagacagaaagatgtgaaaatacaatgtagttttaagagtgatacaaatgtaagtaatgaaaacaatagtaacayagccatacaagtcaacacattagattctttgatcaatcaaagaaaatatattttcactttctgaaatagagtgtagacatcctattttgttttggcagtgaggacactgctatattttagattaacattttaaatgcttttctagaaaaataagaatatcttcctggcaaaattacagaaggatctaatgtagcctcagataatttatctattcatttactcagatgttacccctcttgatattacaaaacaccacagcaaaaagtctgtatatggtctcactattttatttagaaaagc

SEQ ID NO: 120326 - DNA, 601 bp, Human
atttttagcagagacggggtttcaccatgttggccaggctagtctcgagctcctgaccttgtgatccacccacctctgcctcccaaagtgctgggattacaggcgtgagccaccacacctggccaaaactgattcttttaagaacagaaccacttttgccactgcaggcacaggtgtatgctttgctcactgcacagtcacacagatatatactaatagtttttatttgtcttgttattctcacaaaaatgattttcagaaacagcagacctgaactcagaggttagaatattttcataamaccttttgggttatctgaacattcatgccagcaaagaaagagaacaaacgaggatgggagctgccaaggcataggctttgttaggtaagcttcaggtttttatttttttccaaaaaacttcacctgctttacataaataagatggttaagaccaatgaatatttcctggaaatgctgctctggtgttcagggtctctttagcctgatgtttctatcaccttatcctgtggcaacaaaggtccagttagactatttattagtagagtattagtattacccactcaatttaaaggccatttt

SEQ ID NO: 120327 - DNA, 601 bp, Human
tcaagtgattctcctgcctcagcctctgggattacaggcacatgccaccacgcccagctaatttttgtatttttagcagagacggggtttcaccatgttggccaggctagtctcgagctcctgaccttgtgatccacccacctctgcctcccaaagtgctgggattacaggcgtgagccaccacacctggccaaaactgattcttttaagaacagaaccacttttgccactgcaggcacaggtgtatgctttgctcactgcacagtcacacagatatatactaatagtttttatttgtctwgttattctcacaaaaatgattttcagaaacagcagacctgaactcagaggttagaatattttcataacaccttttgggttatctgaacattcatgccagcaaagaaagagaacaaacgaggatgggagctgccaaggcataggctttgttaggtaagcttcaggtttttatttttttccaaaaaacttcacctgctttacataaataagatggttaagaccaatgaatatttcctggaaatgctgctctggtgttcagggtctctttagcctgatgtttctatcaccttatcctgtggca

SEQ ID NO: 120328 - DNA, 601 bp, Human
ctccgcctcccaggttcaagtgattctcctgcctcagcctctgggattacaggcacatgccaccacgcccagctaatttttgtatttttagcagagacggggtttcaccatgttggccaggctagtctcgagctcctgaccttgtgatccacccacctctgcctcccaaagtgctgggattacaggcgtgagccaccacacctggccaaaactgattcttttaagaacagaaccacttttgccactgcaggcacaggtgtatgctttgctcactgcacagtcacacagatatatactaatwgtttttatttgtcttgttattctcacaaaaatgattttcagaaacagcagacctgaactcagaggttagaatattttcataacaccttttgggttatctgaacattcatgccagcaaagaaagagaacaaacgaggatgggagctgccaaggcataggctttgttaggtaagcttcaggtttttatttttttccaaaaaacttcacctgctttacataaataagatggttaagaccaatgaatatttcctggaaatgctgctctggtgttcagggtctctttagcctgatgtttctatca

SEQ ID NO: 120329 - DNA, 601 bp, Human
aagatggagtagaacacaggtccttaaaattgattttttttttttttttttgagacagagtcttgctctgtcactaggctggagtgcagtggcacaatctcggctccctgcaacctccgcctcccaggttcaagtgattctcctgcctcagcctctgggattacaggcacatgccaccacgcccagctaatttttgtatttttagcagagacggggtttcaccatgttggccaggctagtctcgagctcctgaccttgtgatccacccacctctgcctcccaaagtgctgggattacaggygtgagccaccacacctggccaaaactgattcttttaagaacagaaccacttttgccactgcaggcacaggtgtatgctttgctcactgcacagtcacacagatatatactaatagtttttatttgtcttgttattctcacaaaaatgattttcagaaacagcagacctgaactcagaggttagaatattttcataacaccttttgggttatctgaacattcatgccagcaaagaaagagaacaaacgaggatgggagctgccaaggcataggctttgttaggtaagcttcaggtttttat

SEQ ID NO: 120330 - DNA, 601 bp, Human
caagggagaaaataagattttagaagtgtaattcataacatgacatttacagaatctgctcagagagagaaaagatggagtagaacacaggtccttaaaattgattttttttttttttttttgagacagagtcttgctctgtcactaggctggagtgcagtggcacaatctcggctccctgcaacctccgcctcccaggttcaagtgattctcctgcctcagcctctgggattacaggcacatgccaccacgcccagctaatttttgtatttttagcagagacggggtttcaccatgttgrccaggctagtctcgagctcctgaccttgtgatccacccacctctgcctcccaaagtgctgggattacaggcgtgagccaccacacctggccaaaactgattcttttaagaacagaaccacttttgccactgcaggcacaggtgtatgctttgctcactgcacagtcacacagatatatactaatagtttttatttgtcttgttattctcacaaaaatgattttcagaaacagcagacctgaactcagaggttagaatattttcataacaccttttgggttatctgaacattcatgccagc

SEQ ID NO: 120331 - DNA, 601 bp, Human
atgcagttgaggctaatgaaacccaaatctcacagcatgaggcaagcagtaggtctacagaactgacagtgtgtgataaacccatacctataaatatataaatgtatgcctgctagtgatggaaatatatagtatctcccatatctcccacttaccaatcaaaagggaccaagagcatacatgtggatgtaaaccccacccagatgcatcaactgtttttttgatagtagttcacaattgggttgtgaagatttttttttaaccctcactattctatctaaacaataatatattctgaaasaggagaagaaggaaggaaagaggacaagataattttttttcttgcactgagttcaaactaacttattgagagcatggaacaatgccttccctatcatttggaaatatgagagacaagactaaaccaatagcacctgttctcaactaagctttcccgcaagcacctgtaggaaaaagtcaaacctaaaagtgaccagtcccaaaaactattagcatttaagtggtactcccttgcctctaacaggcaccattttacaggcttcagtccaagtgtggttggaggtaatattgtcataatatg

SEQ ID NO: 120332 - DNA, 601 bp, Human
aacctatgacagacctgggctatggaaattgtggacactgttacatggcagtgtcaagggtatttgaacctcaatgcagtgggcatgcagttgaggctaatgaaacccaaatctcacagcatgaggcaagcagtaggtctacagaactgacagtgtgtgataaacccatacctataaatatataaatgtatgcctgctagtgatggaaatatatagtatctcccatatctcccacttaccaatcaaaagggaccaagagcatacatgtggatgtaaaccccacccagatgcatcaactgtttttttgatagtagttcacaattgggttgtgaagatttttttttaaccctcactattctatctaaacaataatatattctgaaacaggagaagaaggaaggaaagaggacaagataattttttttcttgcactgagttcaaactaacttattgagagcatggaacaatgccttccctatcatttggaaatatgagagacaagactaaaccaatagcacctgttctcaactaagctttcccgcaagcacctgtaggaaaaagtcaaacctaaaagtgaccagtcccaaaaactattagcatt

SEQ ID NO: 120333 - DNA, 601 bp, Human
aaacctatgacagacctgggctatggaaattgtggacactgttacatggcagtgtcaagggtatttgaacctcaatgcagtgggcatgcagttgaggctaatgaaacccaaatctcacagcatgaggcaagcagtaggtctacagaactgacagtgtgtgataaacccatacctataaatatataaatgtatgcctgctagtgatggaaatatatagtatctcccatatctcccacttaccaatcaaaagggaccaagagcatacatgtggatgtaaaccccacccagatgcatcaactgyttttttgatagtagttcacaattgggttgtgaagatttttttttaaccctcactattctatctaaacaataatatattctgaaacaggagaagaaggaaggaaagaggacaagataattttttttcttgcactgagttcaaactaacttattgagagcatggaacaatgccttccctatcatttggaaatatgagagacaagactaaaccaatagcacctgttctcaactaagctttcccgcaagcacctgtaggaaaaagtcaaacctaaaagtgaccagtcccaaaaactattagcat

SEQ ID NO: 120334 - DNA, 601 bp, Human
caaattctcagacactttcaaacctatgacagacctgggctatggaaattgtggacactgttacatggcagtgtcaagggtatttgaacctcaatgcagtgggcatgcagttgaggctaatgaaacccaaatctcacagcatgaggcaagcagtaggtctacagaactgacagtgtgtgataaacccatacctataaatatataaatgtatgcctgctagtgatggaaatatatagtatctcccatatctcccacttaccaatcaaaagggaccaagagcatacatgtggatgtaaacccyacccagatgcatcaactgtttttttgatagtagttcacaattgggttgtgaagatttttttttaaccctcactattctatctaaacaataatatattctgaaacaggagaagaaggaaggaaagaggacaagataattttttttcttgcactgagttcaaactaacttattgagagcatggaacaatgccttccctatcatttggaaatatgagagacaagactaaaccaatagcacctgttctcaactaagctttcccgcaagcacctgtaggaaaaagtcaaacctaaaagtgaccag

SEQ ID NO: 120335 - DNA, 601 bp, Human
agcaacttcagactgctcaaattctcagacactttcaaacctatgacagacctgggctatggaaattgtggacactgttacatggcagtgtcaagggtatttgaacctcaatgcagtgggcatgcagttgaggctaatgaaacccaaatctcacagcatgaggcaagcagtaggtctacagaactgacagtgtgtgataaacccatacctataaatatataaatgtatgcctgctagtgatggaaatatatagtatctcccatatctcccacttaccaatcaaaagggaccaagagcatayatgtggatgtaaaccccacccagatgcatcaactgtttttttgatagtagttcacaattgggttgtgaagatttttttttaaccctcactattctatctaaacaataatatattctgaaacaggagaagaaggaaggaaagaggacaagataattttttttcttgcactgagttcaaactaacttattgagagcatggaacaatgccttccctatcatttggaaatatgagagacaagactaaaccaatagcacctgttctcaactaagctttcccgcaagcacctgtaggaaaaagtca

SEQ ID NO: 120336 - DNA, 601 bp, Human
aagaagagttttcaattacagcattttaatctaaaattcagggaattctatcataaaataagattttaatatttaattatctcagttggttaaataaattatactttcctatatttcctaatacttatttctgattattaaatcttatgatttatagtctatatgcatatgtatgagtatgtgtgtgttgctcaaattcaacataaagtatcggatagtaatgctttctgaactagtgaacagcttgatatatgtcaacaatcataagataatcagtgcttttgggggaaactaaaatcatttttttttgcaatactcaatactattttctaatggtacctcttagattcacagtcttccaaatgctttgaaaaaagaataatcccattcttgccatattgtagactggaccatctactgtggttatttgtaggaaagtcacaaatgtacatcttctatatcattttagtttatacattttaaatcaataactgttttataaaatagaaaataaatcacatataaattctaagataatttttcagtatttcctgagagtcttttccacacatatatctaaaaaatacagttgcaataatat

SEQ ID NO: 120337 - DNA, 601 bp, Human
tcatacctaatcgtagcattttaaattcaggtaactttgctgaggcacaaagctgatagaagatatgatagtttctctcctcttctgccttcgaaataagaagagttttcaattacagcattttaatctaaaattcagggaattctatcataaaataagattttaatatttaattatctcagttggttaaataaattatactttcctatatttcctaatacttatttctgattattaaatcttatgatttatagtctatatgcatatgtatgagtatgtgtgtgttgctcaaattcaacayaaagtatcggatagtaatgctttctgaactagtgaacagcttgatatatgtcaacaatcataagataatcagtgcttttgggggaaactaaaatcatttttttttgcaatactcaatactattttctaatggtacctcttagattcacagtcttccaaatgctttgaaaaaagaataatcccattcttgccatattgtagactggaccatctactgtggttatttgtaggaaagtcacaaatgtacatcttctatatcattttagtttatacattttaaatcaataactgttttataaaa

SEQ ID NO: 120338 - DNA, 601 bp, Human
cctccttgttttgtgtaattaaagttatctgcatttcctgtaatgaagaaaaataaaaattttctggtttatgaaaaagccttgccttctaaccttatgtccactctgaatcagaggtggtgatagcacagttgagtgtacagcatctagagtttgactgcctgtgttttcaattgtattttaataaaaaattaaaaattaaataaaatttaattaaataaatggggtaaaatatttatagtttatttatgttaattggtaaaataaatagtcctttcctaaaggttttattccaatctayacactagaataatttcctcaaatcctttactcccctcataagaaaccctactggcttctaacaaatcaactcctttaattttttttttcctttaatcaaagcaaatatcaaacacatacaaaagtagagagactaatagaatgagcccctaggtactcattactcatcttaaacagccatctaaaatcacctccaggccaatcctgttccatttatacagccacttactcctcctctacccctatgggttattttgaagccaagggctgactttttatcatattatccataagtattcca

SEQ ID NO: 120339 - DNA, 601 bp, Human
ctttgtatggctttttcaaattcacaaatttactatttacaaacagatttagcacgagaagaaatgcagtgattttcaaacttttaatatgcatatgaatcaccaatagattttgataaaatgcagattatgtttcagtaggtctgagaagggatttgagattctgcatttctagcaaggcccacaatggtcctggtccacactgtaattagcagtgcttttaaattaagttaactcacctgagggtactactcaaaatgccatcatatgattttagagttatctatattctgaggttttktttttctttaagttgtagatgacaagttctaaagattaatttattcacatgaaggcccaacattttttaaatcccagaaacaagatagtgacatctgagctgcttcagaaatgttggaacagaaaaaaaatgctggaataaactacatgtaatggaatattctgtcatgatgccaactcagccacatttcccagccacagaaagatccccaaaaccaaacaaataaaccaatagctcctacaaaatgcgagcttgtagaggagcccgtttcacttagcttcaggtttcagattttgtaaa

SEQ ID NO: 120340 - DNA, 601 bp, Human
cacccaggctggagtgcagtggtgtgatctcagctcactgcaaactttgtatggctttttcaaattcacaaatttactatttacaaacagatttagcacgagaagaaatgcagtgattttcaaacttttaatatgcatatgaatcaccaatagattttgataaaatgcagattatgtttcagtaggtctgagaagggatttgagattctgcatttctagcaaggcccacaatggtcctggtccacactgtaattagcagtgcttttaaattaagttaactcacctgagggtactactcaamatgccatcatatgattttagagttatctatattctgaggttttttttttctttaagttgtagatgacaagttctaaagattaatttattcacatgaaggcccaacattttttaaatcccagaaacaagatagtgacatctgagctgcttcagaaatgttggaacagaaaaaaaatgctggaataaactacatgtaatggaatattctgtcatgatgccaactcagccacatttcccagccacagaaagatccccaaaaccaaacaaataaaccaatagctcctacaaaatgcgagcttgt

SEQ ID NO: 120341 - DNA, 601 bp, Human
tttaggctggtgctatatcccagcctgatgagtatgcgtccaaatacagcatcagagcagaacttgaaggataaggcaggatgagaaagctggacagctttcagcttttatcagatctggcttcatttttaaataacataagaatctccagaaaattagctataattacatgcaaatagaagcagtgaaattatttccaaatatgtaatcttagaaagggtaattcagtaatgaccctataattaatgttttttaccatctcctgcattatggctttttcttttttgtttttttgacacasagtctcactctgtcacccaggctggagtgcagtggtgtgatctcagctcactgcaaactttgtatggctttttcaaattcacaaatttactatttacaaacagatttagcacgagaagaaatgcagtgattttcaaacttttaatatgcatatgaatcaccaatagattttgataaaatgcagattatgtttcagtaggtctgagaagggatttgagattctgcatttctagcaaggcccacaatggtcctggtccacactgtaattagcagtgcttttaaattaagttaactcacctga

SEQ ID NO: 120342 - DNA, 601 bp, Human
attctatgcttccattttctcatttgagatatgaaaataatagtgactacttcaaagtatgtgaagattaaatgagattaaatgcacatagcatacttaatacacgacatgacacacagtaagtgctaaacaaattgttgtcatcattgtcacacactgggtttaaaattaatagtattaccatttctatttatctctgctccagatacagcccaataaagctgttacttcttaaggctgtttaaaaagtaattatttaattacttctttaaactacagaccaagtataagtcaaagagaygccaagattagaagcgtttaggctggtgctatatcccagcctgatgagtatgcgtccaaatacagcatcagagcagaacttgaaggataaggcaggatgagaaagctggacagctttcagcttttatcagatctggcttcatttttaaataacataagaatctccagaaaattagctataattacatgcaaatagaagcagtgaaattatttccaaatatgtaatcttagaaagggtaattcagtaatgaccctataattaatgttttttaccatctcctgcattatggctttttctttt

SEQ ID NO: 120343 - DNA, 601 bp, Human
aatggacaggtagcttcagtattctatgcttccattttctcatttgagatatgaaaataatagtgactacttcaaagtatgtgaagattaaatgagattaaatgcacatagcatacttaatacacgacatgacacacagtaagtgctaaacaaattgttgtcatcattgtcacacactgggtttaaaattaatagtattaccatttctatttatctctgctccagatacagcccaataaagctgttacttcttaaggctgtttaaaaagtaattatttaattacttctttaaactacagamcaagtataagtcaaagagacgccaagattagaagcgtttaggctggtgctatatcccagcctgatgagtatgcgtccaaatacagcatcagagcagaacttgaaggataaggcaggatgagaaagctggacagctttcagcttttatcagatctggcttcatttttaaataacataagaatctccagaaaattagctataattacatgcaaatagaagcagtgaaattatttccaaatatgtaatcttagaaagggtaattcagtaatgaccctataattaatgttttttaccatctcct

SEQ ID NO: 120344 - DNA, 601 bp, Human
ttaattcctgaatattgccagatgttgtgcatattataatgtgtcatagctaacaacactttcatctttgttgacattaacacattaggcagtttagcatcatggatggataacatggctgctgactgtggctgatctggctcgagacctggctctgctatggacctatcatctcaaatggacaggtagcttcagtattctatgcttccattttctcatttgagatatgaaaataatagtgactacttcaaagtatgtgaagattaaatgagattaaatgcacatagcatacttaatacaygacatgacacacagtaagtgctaaacaaattgttgtcatcattgtcacacactgggtttaaaattaatagtattaccatttctatttatctctgctccagatacagcccaataaagctgttacttcttaaggctgtttaaaaagtaattatttaattacttctttaaactacagaccaagtataagtcaaagagacgccaagattagaagcgtttaggctggtgctatatcccagcctgatgagtatgcgtccaaatacagcatcagagcagaacttgaaggataaggcaggatgagaaa

SEQ ID NO: 120345 - DNA, 601 bp, Human
gtaaatccaacattgcctaagtgaaggatgccagcaagtattcggaaaattcccatttgatgagattcactaattcctgaaacaagagagtgaatgaacaagtgattaatttcagaatagaaactaaacaattacagcagacaattttaagcctattgttaattcctgaatattgccagatgttgtgcatattataatgtgtcatagctaacaacactttcatctttgttgacattaacacattaggcagtttagcatcatggatggataacatggctgctgactgtggctgatctggctygagacctggctctgctatggacctatcatctcaaatggacaggtagcttcagtattctatgcttccattttctcatttgagatatgaaaataatagtgactacttcaaagtatgtgaagattaaatgagattaaatgcacatagcatacttaatacacgacatgacacacagtaagtgctaaacaaattgttgtcatcattgtcacacactgggtttaaaattaatagtattaccatttctatttatctctgctccagatacagcccaataaagctgttacttcttaaggctgtttaaaa

SEQ ID NO: 120346 - DNA, 601 bp, Human
gcttctttaaacaatctacaaatctaaaacataattcaactgccatcccactaaagcttattctgaacttacaggtattgtgcagctgtctgcatctcgggatgtaaatccaacattgcctaagtgaaggatgccagcaagtattcggaaaattcccatttgatgagattcactaattcctgaaacaagagagtgaatgaacaagtgattaatttcagaatagaaactaaacaattacagcagacaattttaagcctattgttaattcctgaatattgccagatgttgtgcatattataaygtgtcatagctaacaacactttcatctttgttgacattaacacattaggcagtttagcatcatggatggataacatggctgctgactgtggctgatctggctcgagacctggctctgctatggacctatcatctcaaatggacaggtagcttcagtattctatgcttccattttctcatttgagatatgaaaataatagtgactacttcaaagtatgtgaagattaaatgagattaaatgcacatagcatacttaatacacgacatgacacacagtaagtgctaaacaaattgttgtcat

SEQ ID NO: 120347 - DNA, 601 bp, Human
tggctagggaagaagagcaatgtatgtaccccagcagggagaatctgagcaaagccaggagagagaaacagcctggcatggaaatggctggatgtagagtgtgagaaacaatgagaaagaagctcaataggaagtcaggggtcagtcatgaaggccctttcatgtcatatcatgccaagtaaggtgttgggtctgcttctgaaggcagtggggagtcctgaaacatttcagtaagggcatgatatgatccctaatagctttaacttccatgagtttctgatcttgtggggccacatctgcrttatagtcactaatctcatctatccaaccctctctctttctctctctctctgtccacacacacacacacacacacacacacacacacacaatcactatgcaccagagattagaatccatatttctttattctcagtttgagattctcctttggataacatatgtctttgataattatgtttctgataatattgatagagagacttaaactatattgcttctttaaacaatctacaaatctaaaacataattcaactgccatcccactaaagcttattctgaacttacaggtattgtgcag

SEQ ID NO: 120348 - DNA, 601 bp, Human
aggccttaattaagaataccacaatgaatagcatggctctatccacaaggacttcaaatcctagtgggtaaaggcaagcaggagagacctttatagaacaatgtgatttgagctacaataaaggaaagcagaagggtgagtgtgtatctaagaagagatgctagagatctgcctgtgagacgtgagtaagagctggctagggaagaagagcaatgtatgtaccccagcagggagaatctgagcaaagccaggagagagaaacagcctggcatggaaatggctggatgtagagtgtgagaarcaatgagaaagaagctcaataggaagtcaggggtcagtcatgaaggccctttcatgtcatatcatgccaagtaaggtgttgggtctgcttctgaaggcagtggggagtcctgaaacatttcagtaagggcatgatatgatccctaatagctttaacttccatgagtttctgatcttgtggggccacatctgcgttatagtcactaatctcatctatccaaccctctctctttctctctctctctgtccacacacacacacacacacacacacacacacacacaatcactatgcaccagag

SEQ ID NO: 120349 - DNA, 601 bp, Human
aagctttctgtaaaccaaactgtctgcccatctagctcttggcccttggactaataaataagttacagggctggatgtggtggctcacacctcacacctataatcccagcactttgggaggccaaggtgggcggatcatctgaggtcacgagttcaagagcagcctggccaacatggcaaaaccccatctctactaaaaataaaaaattagctgggcatggtggtgtacacctgtggtcccagctactcaggaggctgaggcagaagaatcgcctgaacccaggaggcggaggttgcagtsagccgagattgcatgcctttgcgctccagcctgggcgacaagagtgaaactccgtctcaaaaaaaaaaaaaaaaaaaagttatggaacaagtcttctctttaaatcataaagtcatttattttatattatatcatgtctcacacatctaatatagtatcaaagtactatatccagaaaacacaagaaatagattcttttcttacaggagtagagaatctgtttttacacaagaggctatagatccagagaaaaaaggcaactaagtgagttgaataaacaccatttaaattaaggcctta

SEQ ID NO: 120350 - DNA, 601 bp, Human
acagaaatattttaaactgactgtggtgatggttgcacatatctgtgaatgtactaaaagccacttaatggtacactttaaatgagtatgatatacgaattatatctcaacaaagctcttttttaaaagactagcaatgtttcattagaagaaatgagggtttaaattagaatcatcattttgccttttacaaaaccaccattaggaaaagaggctgggggaggggaggaggaatcatgcatctaaaattaggacccatggcttaggaaaattacacctcaaatattcataaagaaaatcrtaaggatcaagctttctgtaaaccaaactgtctgcccatctagctcttggcccttggactaataaataagttacagggctggatgtggtggctcacacctcacacctataatcccagcactttgggaggccaaggtgggcggatcatctgaggtcacgagttcaagagcagcctggccaacatggcaaaaccccatctctactaaaaataaaaaattagctgggcatggtggtgtacacctgtggtcccagctactcaggaggctgaggcagaagaatcgcctgaacccaggaggcggag

SEQ ID NO: 120351 - DNA, 601 bp, Human
taaagggtactgggtttctttttgaggtcacagaaatattttaaactgactgtggtgatggttgcacatatctgtgaatgtactaaaagccacttaatggtacactttaaatgagtatgatatacgaattatatctcaacaaagctcttttttaaaagactagcaatgtttcattagaagaaatgagggtttaaattagaatcatcattttgccttttacaaaaccaccattaggaaaagaggctgggggaggggaggaggaatcatgcatctaaaattaggacccatggcttaggaaaaytacacctcaaatattcataaagaaaatcgtaaggatcaagctttctgtaaaccaaactgtctgcccatctagctcttggcccttggactaataaataagttacagggctggatgtggtggctcacacctcacacctataatcccagcactttgggaggccaaggtgggcggatcatctgaggtcacgagttcaagagcagcctggccaacatggcaaaaccccatctctactaaaaataaaaaattagctgggcatggtggtgtacacctgtggtcccagctactcaggaggctgaggca

SEQ ID NO: 120352 - DNA, 601 bp, Human
tgtatgtatttagaattcggcatcatttaaaagtgggtcaggctgggcgtggtggctcacgcctgtaatcccagcacttcgggaggctaaggcaggaggatcacctgaggttaggagtttgagaccagcctggccaacatggtgaaaccctgtctctaccaaaaatacaaaaattagctgcttgtagtggcagacacctgtaatcccagctactggggaggctgaggcaagagaattgcttgaacctgggaggtggaggttgcagtgagctgagatagtgccactgcactccagcctgggygacagagcgagactccgtctcaaaaaaaaaaatttttttcttaaaattaaaaaaaaaaaaaggtgggtcagcactctgtaaacatattctacttgaatgttgttaccttattgttctattacatcaagattgttaactgtttggtttaaattctccacagctttactcattttggacttcacctatcaataattaagagaagtcaataatctcccactctgatagcaaatttgtctcttcttgaggtttctgttgatttttgctatatatctttcgaggctatgtcattaagtatataga

SEQ ID NO: 120353 - DNA, 601 bp, Human
aaataagcagccatatatatgtatgtatttagaattcggcatcatttaaaagtgggtcaggctgggcgtggtggctcacgcctgtaatcccagcacttcgggaggctaaggcaggaggatcacctgaggttaggagtttgagaccagcctggccaacatggtgaaaccctgtctctaccaaaaatacaaaaattagctgcttgtagtggcagacacctgtaatcccagctactggggaggctgaggcaagagaattgcttgaacctgggaggtggaggttgcagtgagctgagatagtgcyactgcactccagcctgggtgacagagcgagactccgtctcaaaaaaaaaaatttttttcttaaaattaaaaaaaaaaaaaggtgggtcagcactctgtaaacatattctacttgaatgttgttaccttattgttctattacatcaagattgttaactgtttggtttaaattctccacagctttactcattttggacttcacctatcaataattaagagaagtcaataatctcccactctgatagcaaatttgtctcttcttgaggtttctgttgatttttgctatatatctttcgaggct

SEQ ID NO: 120354 - DNA, 601 bp, Human
aatcacatgtatcagtcaaatctgacattcctggggcatagggagggtgaacattgtctctggtggataactgaggaaataggacccaagagaacaaatagcttgtcaaaaatcagctggcaattgatgtcagagttggcattagaacctgggtctccttgacaccttcatctctagactcttcacactcaagcaccccttccttctttcatccccctttctcccaagtaatcactttagatacaaatcagcaccactgcctgctcaactcccttaaataagcagccatatatatgtatgkatttagaattcggcatcatttaaaagtgggtcaggctgggcgtggtggctcacgcctgtaatcccagcacttcgggaggctaaggcaggaggatcacctgaggttaggagtttgagaccagcctggccaacatggtgaaaccctgtctctaccaaaaatacaaaaattagctgcttgtagtggcagacacctgtaatcccagctactggggaggctgaggcaagagaattgcttgaacctgggaggtggaggttgcagtgagctgagatagtgccactgcactccagcctgggtgacaga

SEQ ID NO: 120355 - DNA, 601 bp, Human
gcattttgcaatctcttctggggctcacttcaaaaattccctcttcctttgactcttcatagtatttgtttgtatctctcttaaagcatcttcattcattcagtcaaaaaatcagtcagctagtcaacaattatttactgagtgctactatgcaccagaaaacaaaaacaaacatggtccctgccctcctagaacttatagtcacttggggaaatgggtattaatcaaatgattgctccctaaaatgaaaaataccacaaagaccaaggacactatgctgagtccatgtgagagtaatatrttctattttggaaggaggagacagttgccttgagaaaaggaaggtgctaactgggtgaaaggaggagaaaaggattttccaagccaaggaaacagctggcaaaaacattctgtggtgggaaggaaatcatcaataggaaggattgaagctgaatgagggagaaaatgtgagttgaaatcacagaaacagacagaggctatatcctagctggtctttatccttgaagcaatggtaggccactgaaggattgtaagcaggtaacttgatagttatttgtgtgactttttatattagaatgac

SEQ ID NO: 120356 - DNA, 601 bp, Human
caggcagcattttgcaatctcttctggggctcacttcaaaaattccctcttcctttgactcttcatagtatttgtttgtatctctcttaaagcatcttcattcattcagtcaaaaaatcagtcagctagtcaacaattatttactgagtgctactatgcaccagaaaacaaaaacaaacatggtccctgccctcctagaacttatagtcacttggggaaatgggtattaatcaaatgattgctccctaaaatgaaaaataccacaaagaccaaggacactatgctgagtccatgtgagagkaatatattctattttggaaggaggagacagttgccttgagaaaaggaaggtgctaactgggtgaaaggaggagaaaaggattttccaagccaaggaaacagctggcaaaaacattctgtggtgggaaggaaatcatcaataggaaggattgaagctgaatgagggagaaaatgtgagttgaaatcacagaaacagacagaggctatatcctagctggtctttatccttgaagcaatggtaggccactgaaggattgtaagcaggtaacttgatagttatttgtgtgactttttatattag

SEQ ID NO: 120357 - DNA, 601 bp, Human
tgatttcgttatgacacaaacaaggctaaattcacatacaccacctccttcccgctcttccactattctccctatattactatttttagatcctcttttgttttttaaccaaatttgtaacttgcagtgtctttaaacatctggtttgtgtgcatcaactacaaaccataccacttgacctctctctttacaagatgaggatttattaagggtgtctttcctgcccttgagctctatcttctaattcctatgggcatctcattttaatatcctctttcatcaacactaagaatcactcccmctcttgcacttagaactgtgcctggcacattatggaccctttacatattccaactcatttaatccataaaaccacacacagaaggtactattattatctccattttacagatgaggaagctaaggcccagggaggtcaactaacttgcccaaggtctcctagataactgacacagggtaggattccaactcacacagttcacctctgggctctgtgtccttcactattacaatctgctgcccctgatttttaagcatctctgaatctcccaaaaccacaatactcctctaagatatttaa

SEQ ID NO: 120358 - DNA, 601 bp, Human
ctcatttgcagtgttttttttttcttttctttttttttttgagacagagtcttgctctgtcacccaggctggagtgcagtggcacagtctgggctcactgcaacctccacctcccgggttcaagcgattctcctgattcagcctcctgagtagctgggactacaggcgtgtgccaccacgcccagctaaatttttatatttttagtagagacggggtttcaccgtgttagccaggacgctctcgatctcctgacctcatgatctgcctgtctcggcctcccaaagtgccggaattacaggygtgagccaccgcgcctggcctcatttacagtgtttacagtctaacgagctattataagctttaacaaaaaacagtcatccatatgaatatttatgtcatgctaacaagaaagcaaatttcttctgttcttttgattaatgagaaggcaaatagggcaccatatgtcagcaggacaccctgactgatggtacgagtatcttccaaaacaatgtgctctgtttttaaaaatttcattaatttatatgtagtctcaatattgacaatagaaacactgctctagacattaaatagagcatatta

SEQ ID NO: 120359 - DNA, 601 bp, Human
ttctttcacaaatcttgctatttttgtgggaagaaaagactttcgtggtgatgatcaaatgacccatattttctaggaccccatgccctgtgaaacttacgtgccacaagatttccaatgcatactctcctcatgtgtctggaactttcccactgtattctgtacttattgtaatgccactcttggctcatttgcagtgttttttttttcttttctttttttttttgagacagagtcttgctctgtcacccaggctggagtgcagtggcacagtctgggctcactgcaacctccacctccygggttcaagcgattctcctgattcagcctcctgagtagctgggactacaggcgtgtgccaccacgcccagctaaatttttatatttttagtagagacggggtttcaccgtgttagccaggacgctctcgatctcctgacctcatgatctgcctgtctcggcctcccaaagtgccggaattacaggcgtgagccaccgcgcctggcctcatttacagtgtttacagtctaacgagctattataagctttaacaaaaaacagtcatccatatgaatatttatgtcatgctaacaagaaagca

SEQ ID NO: 120360 - DNA, 601 bp, Human
aagatgaatggcagccaagctagtccgggtgggaagggcaatccaatcactgccacagctcctgtttcagggtgctgcccagccactgcccagccaatgcagctgacaccaccacttctagtatctacagatgctaatgactgctactcattcttggggagtttctgccttcctttacttatctcttttgtctcctttggttctttcacaaatcttgctatttttgtgggaagaaaagactttcgtggtgatgatcaaatgacccatattttctaggaccccatgccctgtgaaacttacrtgccacaagatttccaatgcatactctcctcatgtgtctggaactttcccactgtattctgtacttattgtaatgccactcttggctcatttgcagtgttttttttttcttttctttttttttttgagacagagtcttgctctgtcacccaggctggagtgcagtggcacagtctgggctcactgcaacctccacctcccgggttcaagcgattctcctgattcagcctcctgagtagctgggactacaggcgtgtgccaccacgcccagctaaatttttatatttttagtagagacggg

SEQ ID NO: 120361 - DNA, 601 bp, Human
atattcatatttctatagtgaaatatgaatatttccagcctaactgggataaagacagactataaataatctcatgttaattcagatcagagatcaggtttagctaaacgagttattaaaaaaaaaacagtttacagagattcctggatttcagaattatagaaccatacttatttcacaaataactcaatttaggttaaaggaagagaaaaccaacatgtcaacactgaagactgctgtcccttgagccctaaagaatgcaaacatcagcaaaagaaaaaaaaagatacctcctgactaytgggttttttccacatttaagtattcaaaaagaaaaactgatataaagcttccttactttgtcagcaaaatgttggatgatgaaagctttgtttgatagacgaggcttttcaaagagtgcacatttgttcaaatgtgtgttgtacaatttttgggcccaggtgtcatctgtgcctttaggcatctatattcatgggaaaaaggaagaaagaaaacaaggtaaatactgtgattcctctaaagcatcagctgtcaaaagatcttttattttttttttttggctttaactaataacttttac

SEQ ID NO: 120362 - DNA, 601 bp, Human
ggtaagaagtatgttaactttagagtaaaactcctcaaatatcgtttttcctaggaaacagtggtagcgctgattgtgatctaaaagatcctctcagttagtgggtgagcagattagatcctcttctcccatgctggccagagagctcttccaaggctgactccttgtatctccttccaacctaggttaccatcaagcagttgtgtttcctcttagaagagattacagcaggagtgagaatcagaaggaacaaatgagtgtctgatggggacagaggtgaaaagctgctgatggatgaagrtgaaggctggggaaatattgtatgatttggtaaagcaggactacttgagaatggactatttcttttccaaaactccagcaacttcagttgtctgccactcaagggggtcaaagcttgcatgacaaaacctttaggtggccctagggtcatctcaaggcttctagatggaattagggcagacttagaaagtcctcaatccctaaaggagaacctgtgaaacttaccccaaagcctacatcacagtctccttgaaatataaattactctcattgcttgtgattttctaagtacactatagaa

SEQ ID NO: 120363 - DNA, 601 bp, Human
gctaatgctttgcatacatcctggattagagtaagcctatccatagttaccttgcttgatttaagaactttaatttgttcttcaaaaacggtgtctttattcttttcgagaaatccttcacactggtattccacctgaaaacacatggaaaaatctccttaactgataaaacttttgaatagatattataatcatcaataataagaatctttattagtctcaggctatacgatcaactctcagcaaactggtattatcagtcttttccaagaaaccaaggccattcctggtaagaagtatsttaactttagagtaaaactcctcaaatatcgtttttcctaggaaacagtggtagcgctgattgtgatctaaaagatcctctcagttagtgggtgagcagattagatcctcttctcccatgctggccagagagctcttccaaggctgactccttgtatctccttccaacctaggttaccatcaagcagttgtgtttcctcttagaagagattacagcaggagtgagaatcagaaggaacaaatgagtgtctgatggggacagaggtgaaaagctgctgatggatgaaggtgaaggctgggg

SEQ ID NO: 120364 - DNA, 601 bp, Human
agtttaaaaccctacccatatcctgtacatttgatatttgttttcaagggatttataacttcaacaaataattcctgtaatcaattttgtgttctatcaggttagcaatgtgaaagattattaaaagatctggtactcaataagtaggtagatgatattagtcaatatggttgggagaaattttatggaaaaaaagagacttcaaatgaatccaaaggaacatcttgatgtatgtacatatctttacaacagtgccacatcccatataaataaaaccagttcttctaattagtcaagctayatttgcaactataattatatatctattaaccttaatacaacctatttaatcttcataacaattccataaattagatgctatcatgattctattttatagatgagagatctgaggcataaactcagtagatgaactgtgcttccccttattaatcagctatacagaaagtagagggttaaaactcattttaatggtatttggtagaactgaaatttagtggtatttagtcaagttgcaatttatttatatgcttcctgatattagatgtggccacagaagatttctttatggtggaaaaat

SEQ ID NO: 120365 - DNA, 601 bp, Human
caacatggtgaaaccccgtctctactaaaaacagaaaaattagccgagcatggtggcatacacctgtaatcccagctacttgggaggctgaggcaggagaatcacttgaacctgggaggtagaggttgcagtgagccaagatcgcaccactgcactccagcctgggtgacagaatgagattttgtctcaacaacaacaaaaagaaagtccactgagcacatttaaaacaacacaacatggctgggcgcagtggctcacgcctgtaatcccagcactttaggaggccaagggcaggcggatyacgaggtcagcagtttgagaccagcctggccaacatggtgaaaccccatctctacaaaaaatacaaaaattagccaggcatggtggcaggcgcctgtaatcccagctactccagaggctgaggcaggagaatcgcttgaacccgggaggcagaggttgcagtgagccgagaccacgccattgcattccagcctgggtgacagggcgagactccgtctaaaaaacaacagcaacaacacagcactcctttgcactttgcccatactcatttcatggcatggcctgacaagaagctctcaga

SEQ ID NO: 120366 - DNA, 601 bp, Human
agctttcagaagtcggagcagtgatcaaaatggaaaactatgagagaatggggaggagacgataagcagtaaaaataaagagctgtaaacattacctgcaactcaaaccacaaactcataagagtgtgctgggcgaggtagctcacacctataatcccagaattttgggaggcccaggagggtagatcacctgaggtcaggagttcaagaccagtctggccaacatggtgaaaccccgtctctactaaaaacagaaaaattagccgagcatggtggcatacacctgtaatcccagctactygggaggctgaggcaggagaatcacttgaacctgggaggtagaggttgcagtgagccaagatcgcaccactgcactccagcctgggtgacagaatgagattttgtctcaacaacaacaaaaagaaagtccactgagcacatttaaaacaacacaacatggctgggcgcagtggctcacgcctgtaatcccagcactttaggaggccaagggcaggcggatcacgaggtcagcagtttgagaccagcctggccaacatggtgaaaccccatctctacaaaaaatacaaaaattagccaggca

SEQ ID NO: 120367 - DNA, 601 bp, Human
gtccacaaagaacctggctggtggccacaaattactctcctcagtcagggtgtaaattctttcgtaagagcaaaatggataaatcagaaaagaaagctttcagaagtcggagcagtgatcaaaatggaaaactatgagagaatggggaggagacgataagcagtaaaaataaagagctgtaaacattacctgcaactcaaaccacaaactcataagagtgtgctgggcgaggtagctcacacctataatcccagaattttgggaggcccaggagggtagatcacctgaggtcaggagttcmagaccagtctggccaacatggtgaaaccccgtctctactaaaaacagaaaaattagccgagcatggtggcatacacctgtaatcccagctacttgggaggctgaggcaggagaatcacttgaacctgggaggtagaggttgcagtgagccaagatcgcaccactgcactccagcctgggtgacagaatgagattttgtctcaacaacaacaaaaagaaagtccactgagcacatttaaaacaacacaacatggctgggcgcagtggctcacgcctgtaatcccagcactttaggaggcca

SEQ ID NO: 120368 - DNA, 601 bp, Human
tcggcatcacccgggaaatacaaattcttgggcccaacctcagacctactgaatcagaaattctgatggcggggcccagcaatctgtattttaacaagcattccaggtcacagtaaagttggagaactctttagcctggtctgcaagactctctgtaacaccaacctacatttcctaaccatttctctactgtcccatacacaaatctcacactgcaaaaaactgttttctgagcaaaccctatgcttaccctgctcttactccctcttataatagtctccttccatttttgcataacctyacccattctcagggcctgactcaaaacacacctctttgatgaaatctctccttcccatagctggacgtcgctttgtcatcccctgatttcttgttccattcattcagcatttgatatagacactacagttaaatattatactcgtctttaaaaagtattactttccaagtaagactatattacctgagaacaagctttattttttcttaatcacacagcatttggcctggtgtcttctagatgtaagtactaggtacacttttatcaataataatcaagctgtctaagaagaatgtgttt

SEQ ID NO: 120369 - DNA, 601 bp, Human
actctgtccccaggagacctaccatcgggcctggtagccccgcacgtatctctgcatggtgatggctgccttccgcatgcgtaggtacttctttctcagcagccaccctcggatggtcttctggatccggatgcaggcagctctcagtttgtcagctctcaatttttctagataggccacttgaccggcacggaaaaagatctttgtcttaccaaactggtatttgtccttgtcctatttttggaagaaattgtatattcagaaataataatcatataagtgaaatttaaaagaaaaaatrtctaaaagcagaatcagtaaaggaatgactctattagctaaaacttgggctacatcacaattaactaatggagccagatttttaatcctatgcaagttgagcaaatagaagggattttaagaaaaactgcagtttaagagttattttccagaattattctacctggaattattatctgaggcccaaaacttggttgtgggttataggcagttattatttgcttgtttgtgttttaaacatctcaaggaaatggagatgctgactctctctgactgacccaggttgtaaggattacagcgg

SEQ ID NO: 120370 - DNA, 601 bp, Human
tcattctttctacaacaggatccatttaccccaggccatgcctctttatagaacagacagacatacacagtaatctcatacttagttatcaccagctttcttggatctagccattattcatctaccatatttttcctgattttgttaggctataagctcatgattaattcagttctacttatacttctcaattaaaattaaactaataagtaatcacactaaagtgtaattctcttccagaccctctcagttaattgctcccaaaaattatacaatgaagtcattattacctagctcataytcacgactgttttaattgatacatgatttcctcaagcccaatataaaagtatcaaaaataaaaattttgaggacataagtaagcagcagtttgtaaatgttttgaagataaatctgaatcattcataaggctgagtgaaattttattctatttagctgtcctatgagttaatttgttgtcccttggaactaagaaaaggtgaggtgttatcttttcagctatggtgaccagtcaaaactgtccttggttggacagtgaattagatgggcactctactctgtccccaggagacctaccatc

SEQ ID NO: 120371 - DNA, 601 bp, Human
tgtatagatgtgaaatttggttaatgctaatagaatgaataaacaaagttgaaaataatgcctcaccttgcgatacctatttctggccaagaagcctcgcaagtaagactgaagaacaatagtggcagctcgtctaatcttgtacctcctgcggaccacatacatgcgccagtacttttgaatgatggttgctgccttggttctgcgcagaaacttagcatagctggccaaagaaaataacattatgttgtcagtaatcagaaaaaaatgcaggaatacatattagagaaacttaaagagygtcactgttttaggcataaatagtacctccattgtattattctaataatgtgcatgctaagtcaacatttatatttacttacatttgtatagcaatttatagtttcccaaagtatttttgcatttattatctcatttgagccctccctaactctggaaagtaggatggcccacattgccagattttacaagaaagcaaaattcacaaaaattcattctttctacaacaggatccatttaccccaggccatgcctctttatagaacagacagacatacacagtaatctcatacttagttat

SEQ ID NO: 120372 - DNA, 601 bp, Human
ttgtccccatacagttcctaccttcattgtagcccctgtggtactctgtatagatgtgaaatttggttaatgctaatagaatgaataaacaaagttgaaaataatgcctcaccttgcgatacctatttctggccaagaagcctcgcaagtaagactgaagaacaatagtggcagctcgtctaatcttgtacctcctgcggaccacatacatgcgccagtacttttgaatgatggttgctgccttggttctgcgcagaaacttagcatagctggccaaagaaaataacattatgttgtcagyaatcagaaaaaaatgcaggaatacatattagagaaacttaaagagtgtcactgttttaggcataaatagtacctccattgtattattctaataatgtgcatgctaagtcaacatttatatttacttacatttgtatagcaatttatagtttcccaaagtatttttgcatttattatctcatttgagccctccctaactctggaaagtaggatggcccacattgccagattttacaagaaagcaaaattcacaaaaattcattctttctacaacaggatccatttaccccaggccatgcct

SEQ ID NO: 120373 - DNA, 601 bp, Human
ataataataataacttcctgccttagtttttgcaattgtgatccaccttatgagttcataagtacttccatgcccattatggaaataaatacggtcataattttactttttactaagaccgaagggtaaagtcaaagaaaaacaatattgaaaataatcctggtggatttcttcaggcatactccactctcagggcccctttgtgaaacacacctgctcatcaactttgcgctgcagctgcatgatcttgttctccatgccgatgtgcagcttcttatagcgctccactgagcgagcctcrattttgagcttctttagctcacgcttggccatcatccgcctgaagcagcactgaaggtagatgatggcatgcatgctcctcttgtagtgtgtgcgggccagccagccccggactcgcttctgaatgatgactgctttgtgctcacggagtatctgcagaaaaggataagggcaagcaatgtcaagaccctggactacactcatgattatcaatctatgtcgggctgaaaatccacacattacctagaggaaaagacataaaagttgaattgacaatgtactatgtagattatacttatca

SEQ ID NO: 120374 - DNA, 601 bp, Human
gagttacatagtaaattcttaatttcctgattcttaattcagaaataggaggatctatacttgtttttgaaaacagatcaaaatgttgctaaaaaccatttactagcttagtgatgcgtacgaatgattaaaacagcctcaaaatcccaagttggccaggtgtagtggctcacacctatagtctcaacactttgggaggccaaggcaggaggatcacaagaggccaggagttcaagactagcctgggcacataatgagaccccgtctttacaaaaaaatttaaaaattagctagacatggtggtgtgtacctgtagtcctagctacttgggaggctgaggcaggaggatcacttgagcccaggagtttgaggctgtagtgagccgtgattgcactgctgtactttagcctgggtgacagggtgagaatctgtcctaaaacaaaaaacaaaaaaaaaaaaccctctccctacacacacacacgtttctcacaaatctttatgtttactacctcaaaatttctccctcccactcagaaaatcttccatcccatttcattctgatccctgttttgctttgctctccttagcatttttatattct

SEQ ID NO: 120375 - DNA, 601 bp, Human
tctgtttcttgtttgtatcgatctgcatgttcctcaatgcattttttctctgaacgagtttgctccaggtctttccggagcttggcaatttcttcctgcagactaaggacccgcccagtggcaactttcgcttcctcttcacttagttgaagacgttctaagtcacttcgtagtttctcagtctcagagttgtatattccttccagattggttagtttctccacaaggcatttgtagtctttgttctttaaacatacacataagtaacaataagtaaatacacatatcatcaaatgtattyagtaagaaaaccatgtttattcatcatattcatgctatatcatcataacattgatatagtatccaaccaaaatactacaacatttgcaatagcacaaccaataccttctaggtgacacaaacagagaagaaaacaggcacaattaattcaattctgtttgatgtggtaagcaagatggatgtgattttctcatagtcacagggtgagttacatagtaaattcttaatttcctgattcttaattcagaaataggaggatctatacttgtttttgaaaacagatcaaaatgttgctaaaaac

SEQ ID NO: 120376 - DNA, 601 bp, Human
ttcacacaaagcttatgtgtacccatgattcaagtggggagattaaggaggttaagaaggatatgaggatgtttagtttgggaaattcactgaagagcttttgattctcccatctgatgtcaagaaagagaatttctctttcatctccctttaagagttttacaaggctgagaactagtccttttattccatgtttaaataagcattgacattacaacaatgtcaatgtacttaatgccacagaactgtccacttaaaaatggtgaaaatggtaaattttatgtcatgtatattttaaaacacacacacacacacacacacacacacacacacacacacaagttgactcttaactttctagttctttgctggataaggattcccaggaaggaaaagttaaaaccaaaggtaattttgcaaagtacataatttactcagctcatctttggaataaagtgtgtgcttatgatgagtaaaatctgaattcctttttctaagctaaagtttaaggaactctgaaaacaagagctttaataatagggagagaactggcaggcaaatctcttgtcatgtcagggggtttaggacaggaaaagagggc

SEQ ID NO: 120377 - DNA, 601 bp, Human
tttcacacaaagcttatgtgtacccatgattcaagtggggagattaaggaggttaagaaggatatgaggatgtttagtttgggaaattcactgaagagcttttgattctcccatctgatgtcaagaaagagaatttctctttcatctccctttaagagttttacaaggctgagaactagtccttttattccatgtttaaataagcattgacattacaacaatgtcaatgtacttaatgccacagaactgtccacttaaaaatggtgaaaatggtaaattttatgtcatgtatattttaaaccacacacacacacacacacacacacacacacacacacacaagttgactcttaactttctagttctttgctggataaggattcccaggaaggaaaagttaaaaccaaaggtaattttgcaaagtacataatttactcagctcatctttggaataaagtgtgtgcttatgatgagtaaaatctgaattcctttttctaagctaaagtttaaggaactctgaaaacaagagctttaataatagggagagaactggcaggcaaatctcttgtcatgtcagggggtttaggacaggaaaagaggg

SEQ ID NO: 120378 - DNA, 601 bp, Human
ctttcacacaaagcttatgtgtacccatgattcaagtggggagattaaggaggttaagaaggatatgaggatgtttagtttgggaaattcactgaagagcttttgattctcccatctgatgtcaagaaagagaatttctctttcatctccctttaagagttttacaaggctgagaactagtccttttattccatgtttaaataagcattgacattacaacaatgtcaatgtacttaatgccacagaactgtccacttaaaaatggtgaaaatggtaaattttatgtcatgtatattttaacacacacacacacacacacacacacacacacacacacacacaagttgactcttaactttctagttctttgctggataaggattcccaggaaggaaaagttaaaaccaaaggtaattttgcaaagtacataatttactcagctcatctttggaataaagtgtgtgcttatgatgagtaaaatctgaattcctttttctaagctaaagtttaaggaactctgaaaacaagagctttaataatagggagagaactggcaggcaaatctcttgtcatgtcagggggtttaggacaggaaaagagg

SEQ ID NO: 120379 - DNA, 601 bp, Human
tgaataccagtgtaatcaacagaatgtatatgaaaatgtattattttcatataatatatccccattccaaaccatcttttctcttccatttccaccactaattactgtatagatctgtatcttcttaccccatatttatatatatgtggattccttataaacttatcaccattctaacctaccccacaaacagaaaatagaataaatgtccatatctagttagttctctattttaaaaattagtgtttttttagactagcaaagagtggtgaatcttagaataacatccattgatttagcaaaaaaaaaaaaaaaaaaaagacaatacacacacacacagaaatatacacatatcagctcaaaaattcttactaaatcattaggaatcctataagccttaactagtaaatcacacatgcagaacaaattaattttaaaaaaaaattacatatgacactgactgaaccggagttcacatttgtacctagagataccagatttacaagtttatcaagcaacgaattcaaccaaaatatctgatctgttgcctcttggaactttataaatttgctgatgacagcctcaacttttaaaaatattt

SEQ ID NO: 120380 - DNA, 601 bp, Human
acatatttttattccaatggtattctattcataaaattattttgcccaaagtagtgtactctctcaaaatgacctcctcacagatatttctcaagagagatatttctcaagagaatggcaacttttcagtggacccggttgtcctactctacagagtctctcttaatttaccatctcacagttctgtcttacgttttctacgactttaacctcccctgctgtcctattacttcccagcttctaaccagataaaatgctcgggcctggccagctgtgttgtgtgcttgttggtcatccccaygcgctgctgaggaaaccttgccttctccatttacctacaccctcagccctctttgtggctgtggtttgcttttggctaggacatgatctggagattggagattagcccttgactgcagatgaagtaaagtaacaaaacctcaaatctcagctgtatgtcttaactcaatcagccaaccagtcacatttataatattaagcttctaccactttgctccatgttacccatatattttgaggctaaatcttaatctgccctgcctgcttctattgcttcaccactgctttctctgtgagcacg

SEQ ID NO: 120381 - DNA, 601 bp, Human
acttgtagggatgcttgggaactctttgtttcctgatagcaggatacatggaatggggaggatgtgcagaattattacaagtatgaaaggtacattggcaaatgcagaagagtccttgaaatagataattcattacaaatggagtctgaattttcttttcataggaatatatcttcaaaattataatcaaaaccagtctacatgtaaattttacattaggccattcaatatataaaacaaagtccaactggccgggcgcaatggctcatgcctgtaatcccagcactttgggaggccaagktgggtagatcatgaggtcaagagatcgagaccatcctggccaacatggtgaaaccccatttctactaaaaatacaaaaaattagctgggcatggtggtgggcacctgtagtcccagctactcgggaggctgaggcaggagaatcacttgaacctgggaggcggaggttgcagtgagccgagattgtgccactacactccagcctggtgacacagggagactccatctcaaaaaaaaaaacaaaaacaaaaacaaaaatccaactttactgactttatactatcacatagcccagtcttta

SEQ ID NO: 120382 - DNA, 601 bp, Human
aatatgctcagagagggatacatgtatggcacctgcttctctcattttattttctgaaattcatattgcatgcaccattaaagaatccaagaaattctccagaaaagacatttgtttatctctgtttaacctagtagattaccacatttattttacctaagaatttcttttccaatcccacttattaacatcccaaataactagggggtctcagaaacacctactgggttataaagcttagctctaaccataactgaaacagagattaaccataaatgttggcattgtcatctaataaatrgagtgaacaaaaacacaccaaagaatggaactggggaacatgaacactgaaaaagaagaaaaggattcaagagaaagctaagaattacagaatgtgaaggaagaaaggtttcaatgggaccaacggtagcacggtgatctaggaagatgaagcttaacaagggtctttagatttgtcaattataagaacagttataatggtgacttgcatctacttctaatttctctttgtcacacataaatcagagtagtgagggttgaaataatggtccaatgtgggatttatattagctttttggtc

SEQ ID NO: 120383 - DNA, 601 bp, Human
ttttttattctctgcaattctgggcaaatattttctgcaaaaactgtcatcttgattatatctggagctaggaaaaggagatctagtgaagaaatgagtgggaagcaagtgagctctgatctcccttcctctgctttctccttttcccttcctctgaccattttgtctcccaagaggaatgactgagtcacaggcatacaatggagaggacacatgactgagaaataagaaattgagcaactaaaactacctctagagcactgctgggaacagatggagagcaggcagacttgcttagcargaaggaggagccgtgtcaagctgctggaggaggcgtcactggaggacctttctagaaatggccacctcctcgactaaagagacccatgacctcctcacagatggatatctctggaatatgctcagagagggatacatgtatggcacctgcttctctcattttattttctgaaattcatattgcatgcaccattaaagaatccaagaaattctccagaaaagacatttgtttatctctgtttaacctagtagattaccacatttattttacctaagaatttcttttccaatcccacttatt

SEQ ID NO: 120384 - DNA, 601 bp, Human
gttggtaacttttcagttctctgtttttaggattttgttcccccgtttatacgtttttcaattacaaggatatatatttgactggatcatcacgttctccttcaagatctgcacctccctcctcttctgctcctgatttctcccatgattccttcttttccagaacatgttttatccctttgtcaagactaacgaccccatgattgacatgctggtttccctcccctctctggaattaatttatctttaaacacttcataaacctggatgcccatgcctcatgatcttttcatcattggcttgaaactccttagccctggattggtccttcctctttgcctctgcccctatattccctggacaaccgaatgttcttggagaaaaatgctacagtacttcttgtactagggccaacaactctagaggctggcaatgagtgacactattagtgttctttggcccatgtatcacataggttatgggaagcgctggaggcagtgtatcaagtcccctccctagagtttcctccattcatatgacgactctgtttacaaccaaatgcttcattagctctggattgaagcagtgagagtgtcattta

SEQ ID NO: 120385 - DNA, 601 bp, Human
gggcttttctaagacagcgaagctttttaactgacctaaaaaataacactagtctctcatctgaggaaaatcaaaataactgaatttattcacaaaattaccaccactacaggcctggcagtcattctgaaataactcctaatgatagctgagaaagttctggtgacccttcccagaggtgaaaggtgtgagaaagcttgacagcagaagcagaacagggatcatcagtcaagggctcctagaagaggtgcacaccaagcaggaggagcactggttccaaagcaatgtcatcccagcccaygaagatcggcaagcgtgggagggctgcaaaacaagtgggactggcaggcgaattctccacagagctacagactggtttccggcaagcacaccctttttatcatggcttccccctaccagcagagctgctaaagtggtactacactggaatgggcagcttgtaaatgtacttccctccgactattgcaagtgagtactcccactgagatcaacaggatgtaatcctaaaaccttcctatctactgaaggctcagaagtcctaatttttaaatcttcaaagtctaactttgtggtattctcc

SEQ ID NO: 120386 - DNA, 601 bp, Human
cccataaaaattaagcgtaaaatacttatattgaagcttatttacaatgtaaacattccatattatatattttaatgtttgttcatttatgaatgatgtacatgtccctgaaattttaaattatttaatcttttcttacactgtcatagaacctttcattctagaaatgaatataatacttcattcattatacctaaaatatcacttggaaatcattcctttgagccttgaatgggcactttttgtttaaaaggaatcctcttattaaaatgggatggtgttttgataactagaactagcaaaaaaaaaaaaaaaagaaaaaatgtgatgggttaactctttagacattggctaatactatataaacaactagttgattgctggacaagagcaaaattctgtggataagaatattaaaatagaaggtggaagatcacaaaagattacatttgaaaaatgcaaaatgactcgaggcataaagagtggtaattatttaagagtgctcccgatggtacccattctgagcccggatgacacatctaattaaagagatgctatcaaattaaagagctgtcctcactataccccatgagcaagaagg

SEQ ID NO: 120387 - DNA, 601 bp, Human
taggctgtcaaagtcatttgtccacaaattaattacacctgaactttttctttctgcctactttgtaatacttaacaattagaaaaagttttaggtatataatctttataataaagtctgtcctgacttagcagaacagatataacatcttgcctcaacacgaaatcaccacagaatttcattcatataaaaattcttctctatacgtcccccataaaaattaagcgtaaaatacttatattgaagcttatttacaatgtaaacattccatattatatattttaatgtttgttcatttatkaatgatgtacatgtccctgaaattttaaattatttaatcttttcttacactgtcatagaacctttcattctagaaatgaatataatacttcattcattatacctaaaatatcacttggaaatcattcctttgagccttgaatgggcactttttgtttaaaaggaatcctcttattaaaatgggatggtgttttgataactagaactagcaaaaaaaaaaaaaaaagaaaaaatgtgatgggttaactctttagacattggctaatactatataaacaactagttgattgctggacaagag

SEQ ID NO: 120388 - DNA, 601 bp, Human
tataaatatctaaacattaacttcttaaaagtccattaaattgggccaatttaaacttctatcagcaaccatcaccttgccttcaacagtagtaaccgttataattaaaaaaaaaaaaaaattagctcagttaatagaccaaaagtggcacttcgctgttgatttaatttgcatttctttgactttttttttttttttttattttcaggaattgtatattaattagctacctttggtctttcatgaattcagagtagtgttaagtgttattccaattcaaaaacaacctgagaagaatcarctgaacaaaaaagtaggcatttataggctgtcaaagtcatttgtccacaaattaattacacctgaactttttctttctgcctactttgtaatacttaacaattagaaaaagttttaggtatataatctttataataaagtctgtcctgacttagcagaacagatataacatcttgcctcaacacgaaatcaccacagaatttcattcatataaaaattcttctctatacgtcccccataaaaattaagcgtaaaatacttatattgaagcttatttacaatgtaaacattccatattata

SEQ ID NO: 120389 - DNA, 601 bp, Human
aggtgtgtcaccatttgcttagctattattttactgatgggtgttgaagttgtttctaattttttgctattggaatattactaaaataaacaccccagtatataaatatctaaacattaacttcttaaaagtccattaaattgggccaatttaaacttctatcagcaaccatcaccttgccttcaacagtagtaaccgttataattaaaaaaaaaaaaaaattagctcagttaatagaccaaaagtggcacttcgctgttgatttaatttgcatttctttgactttttttttttttttttwttttcaggaattgtatattaattagctacctttggtctttcatgaattcagagtagtgttaagtgttattccaattcaaaaacaacctgagaagaatcaactgaacaaaaaagtaggcatttataggctgtcaaagtcatttgtccacaaattaattacacctgaactttttctttctgcctactttgtaatacttaacaattagaaaaagttttaggtatataatctttataataaagtctgtcctgacttagcagaacagatataacatcttgcctcaacacgaaatcaccacagaat

SEQ ID NO: 120390 - DNA, 601 bp, Human
tatagacaggtgtgtcaccatttgcttagctattattttactgatgggtgttgaagttgtttctaattttttgctattggaatattactaaaataaacaccccagtatataaatatctaaacattaacttcttaaaagtccattaaattgggccaatttaaacttctatcagcaaccatcaccttgccttcaacagtagtaaccgttataattaaaaaaaaaaaaaaattagctcagttaatagaccaaaagtggcacttcgctgttgatttaatttgcatttctttgacttttttttttattttttattttcaggaattgtatattaattagctacctttggtctttcatgaattcagagtagtgttaagtgttattccaattcaaaaacaacctgagaagaatcaactgaacaaaaaagtaggcatttataggctgtcaaagtcatttgtccacaaattaattacacctgaactttttctttctgcctactttgtaatacttaacaattagaaaaagttttaggtatataatctttataataaagtctgtcctgacttagcagaacagatataacatcttgcctcaacacgaaatcacc

SEQ ID NO: 120391 - DNA, 601 bp, Human
ttaaagaattagaataataatgtcattataattttatatggtcttttaaacttggcattgcattgtttcccaaatttataatatgatatttcaatatatagacaggtgtgtcaccatttgcttagctattattttactgatgggtgttgaagttgtttctaattttttgctattggaatattactaaaataaacaccccagtatataaatatctaaacattaacttcttaaaagtccattaaattgggccaatttaaacttctatcagcaaccatcaccttgccttcaacagtagtaaccrttataattaaaaaaaaaaaaaaattagctcagttaatagaccaaaagtggcacttcgctgttgatttaatttgcatttctttgactttttttttttttttttattttcaggaattgtatattaattagctacctttggtctttcatgaattcagagtagtgttaagtgttattccaattcaaaaacaacctgagaagaatcaactgaacaaaaaagtaggcatttataggctgtcaaagtcatttgtccacaaattaattacacctgaactttttctttctgcctactttgtaatactta

SEQ ID NO: 120392 - DNA, 601 bp, Human
gtacactaattaaagctaaaaagaatggaaacaactaaccatcataatggaagttgtggatgccataattgttttaacatgtttacctaaggttttaatttttaatgaggtaagaagagaaataattgtactattagaattaatgtggaagataaagagtccctttgttagagagagacaagtggggctggaggagcaagagaatggcaacaatcatttatttaactaaatggtcaaagtataattcttaaatgattggtaaatctacccaattgtttaaaaagagaatgtttacttttgyttttctgatatgagaacagaataagcttttacagaaaatttaggaaataagaaaagttcaaagaagaaaaacacagccataatcctatcgccacagaaaaactacaattttttcttagtctttttctctatgcatctatagatttaaagaattagaataataatgtcattataattttatatggtcttttaaacttggcattgcattgtttcccaaatttataatatgatatttcaatatatagacaggtgtgtcaccatttgcttagctattattttactgatgggtgttgaagttgtt

SEQ ID NO: 120393 - DNA, 601 bp, Human
agcccctgccaccagttagtgctgcccactccatgctctgttcaaacaatggcaacaggaacccagaatagagtgccaccgacactagcacacaagtgtcacaagatactggttgggaaacacagatgcagacaggcacttaaaagcaccatggtgcctcatttagcacaggacacaaggcctgatgatactgaaacacttgtgtataaacattgaatattttattgtttcttcccagagacaaaaccttaggtttgtagcactatatcagtcctttcaatgtgttatattaaaactattyaggctgggcactgtggctcacgcctgtaatcccagcactttgggaggccgagacagttggatcacgaggtcaggagatcgagaccatcctggctaacatggtgaaaccccgtctctactaaaaaaatacaaaaaatcagccgggcgtggtggcgggcacctgtagtcccagctactcgggaggctgaggcaggagaatggcatgaacctgggaggcggtgcttgcagtgagccaagatcacaccactgcactccaatctgggtgacagagcgagactccatttcaaaaagaaaaaagaaa

SEQ ID NO: 120394 - DNA, 601 bp, Human
caaatgaaggcagggaaggacttcaaagggccatctatatcctcagtgcaggagtcctctctgttgaatccttaaacagcccctcccactgggacatcaccccgctactaaacagaactgcctaaagtgagcagaaatcatctccatgtaacttccactcactgatgtcacttctaaccggttcatctgttacttctccaattaaaccagctatttttgacaaatgattttaaagttgtatttaatgccttcccgcagtaagaaaatttagagatttttgtatttaataaaattttatttyagattaaaatttattgtggccagattactacaaaaagattaattttaaaactcatgagagatgaaactttgtgatcatttgggattcccctggctttttgctcattccaatttatacttacaatagttttaaacaacactgggatttttttaaaaaaataatgaatcctcaattagattaaaaatgctcttaagtgtttgctgcattataaactggagggaagggataagaagatattgaggccagtccccgaacacccagtttaattgtgtgcttgcgcttaccttgggttggatggcc

SEQ ID NO: 120395 - DNA, 601 bp, Human
gaccctgtgtcaaaaaaaagaaaagaaaaatgtagccacattgccatagacacatatatcctgtagatctatctataggatatgagaagccactgtctcagtaataaatcttaatctctcccccaatagtttgtgccctaattgaaagattatgtttttcttttaactcctgggagagagagattcacaaattttagtgtctgaagggaagtgtcttatattcaccaccattcaattttagctttaatagtatcttgtagtgaaggtttttaaagaaggtgtttggaccgggtgtggtggytgacgcctgtaatcccaatactttgagaggctcaggtgggcgcatcacctgaggtcaggagttcgagaccagcctggccaacatggtgaaaccccgtctctactaaaaatacagaaaattagtcaggcatgttggtgcacgcctgtaatcccagctactcaggaggctgaggcaggacaattgcttgaacccaggaggcagaggttgcagtgagctgagatcgcaccactgcactccagcctaggcaacagagtgagactccgtctaaaaaagaaaaaaaaaaaaggtgtttggctgaat

SEQ ID NO: 120396 - DNA, 601 bp, Human
ataggtcattaaaaatgttaatttaaaaaagacacaaatcaccaccaatcctaaacaatttttctcaaaatcgggctagcactacaatatagactttatatagaaatatgaaattatcactttttaaggatttttaatatagtaaatatatttgtcaaaaaactgtaaatcagtaataaaagttattatgtgactgagaaatattttagaaaatttttttggcaaaagaaaaaaaaaaaggaacaaggcaaaaaaaagaaaagaaaacagtcagactccatgccagggtttagaatctgasaaggaaaaagacaatttcctcacttgttatacaagttctgtttaaaagaacagaaaatatgtaaacctgaatcctaacacacacctccctgacctgggagctccatccaacatcaaccaaaaaccccggcttagttttgccaaccgcctttctcaacctcaactctaaccctacttgtctgctagaggtggagcctgggatggcctcagtggctgcttggggaccaaaggtaaaggaagcctgtccccagtctcagttgtgacaatcacataataaacctaggatggcagaggatctgca

SEQ ID NO: 120397 - DNA, 601 bp, Human
attttaaaacaataatttaaagcacagaacttgtatgccaatcaatcaacttattatattattcagtatatttggtaatacttagtcatcaaagcattgttagtttaatttaagcaacagtatacttgagctttgtaaaataacacttcaaaaaatatttcatgattcagaaaattttccccacaaattagtgagatgtcaatcactttggaaagagcccacacactgcccccaccctcctccctcattcccatggtggagcctcatacagacagactgtgaaaaagaatacctttgcgtkttgcttctaattcatataaaagatggttgaataaatgacactagaaaactgtttgtaatgtaaattatcacaaatggagtaatggagggataattcagattgttaaatcttcagagaaaattcatactattttattataggtcattaaaaatgttaatttaaaaaagacacaaatcaccaccaatcctaaacaatttttctcaaaatcgggctagcactacaatatagactttatatagaaatatgaaattatcactttttaaggatttttaatatagtaaatatatttgtcaaaaaact

SEQ ID NO: 120398 - DNA, 601 bp, Human
accaacctaatagctcattcaatccttataaaccatgtcagatagatgctattatctttctaatttaacagatgggaaagcacaggcatacagaggttcagaaacttgcccaatatcatatgattaataagtagaagagctaagatttgaacccaagaagcttgactccagaatccacattcttaactcctatgctatactgcctagcacattgtctggcatatagaagatattcattagatgcttacagagtaaaatctgtaaattattactacccatgaaaagaacatttttcctcatytaaaaatgtaaatttctactcaaaagaggttaggtttgccaaaagtcatattttgttattatccctaatatttgcatgcaaacctctattaggccacttatatagcctagtctttaagccaagactcaaaccaagactcagtgaccgtcttgaaaaaaaggtttaaataccttctagttcgccaatttttttggcaaatactttcagttgttttttcagtttacggaccgtcttatcctgtttttcaagttgttccatcaaatcctaaagatcaaaaagagaaatatattagaaaaatcg

SEQ ID NO: 120399 - DNA, 601 bp, Human
tgaaggctattccaaagactgtctcaaaatcccttaagcagtgagaacattgaaataagcttaaaatttggctttaggctggaagcggtggctcacgcctatacccagcactttgggaggctgaggcagatggatcacgagctcaggagttcgagatcagcctggccaacatggtgaaaccccgtctctactaaaaatacaaaaattagctggacatggtggcatgcacctgtaatcccagctactcaggaggctgaggcaggagaattgcttgaacccgggaagcagaggttgcagtgasccgagattgcaccactgcactccagcctcagcgacagagcaagactctgtctccaaaaaaaaaaaaaaaaaaaaaaaaaggagtttggctttagccttgttcactgctagatccctgtacctataactcttaacaaataaacacataaacacactaatagaaaagataagatccatttgtatataaataataacaacaactgatatttggttatttctcaaggaattttttcatcatcatcatatagaaatcatgagatgtttttaaaaatcttatttctttatcatcataattcatatt

SEQ ID NO: 120400 - DNA, 601 bp, Human
cttcactgtttgaaccaagcaagaattagatgcagaatgacaatgagagaaaatgattaaccgttcacacaggtttgaaggctattccaaagactgtctcaaaatcccttaagcagtgagaacattgaaataagcttaaaatttggctttaggctggaagcggtggctcacgcctatacccagcactttgggaggctgaggcagatggatcacgagctcaggagttcgagatcagcctggccaacatggtgaaaccccgtctctactaaaaatacaaaaattagctggacatggtggcatrcacctgtaatcccagctactcaggaggctgaggcaggagaattgcttgaacccgggaagcagaggttgcagtgagccgagattgcaccactgcactccagcctcagcgacagagcaagactctgtctccaaaaaaaaaaaaaaaaaaaaaaaaaggagtttggctttagccttgttcactgctagatccctgtacctataactcttaacaaataaacacataaacacactaatagaaaagataagatccatttgtatataaataataacaacaactgatatttggttatttctcaaggaa

SEQ ID NO: 120401 - DNA, 601 bp, Human
aagtaagtggtttaacagatttgttaattaattgatactaatcagaaatggttaaacatattttgactttaattcacaggaggaacaatcaatatcctacaaaggggcagaaggagcagaaacaattcccccttgctcttggctcaatgactttagccattaaaagcaaaagaacatttactttaaatgtatcattacaatcaattcaaaacacatacagatagctggtagaagagtgtttcttcataccacttggtccaaaatgtattatttttcacaaaggcctcatatggcaaagacytaattttctcctgccatcctcattcccagagaaatcatgaacagataaactatctctatgtagtatgatttcctaaatgttattattttttatttctttttaatataatgttaaaaattctacttataaagttgcaatcaatgaagtacaaccactggtttacaatgctttcagatgttaaaaatagtcactattgtcaagggcagcagctagagaattatgctaaaggttaaaaaaaaaagtctccaatttcatctcaaaattgagacttgagtgggaaatccaacaaaaagtaaaggg

SEQ ID NO: 120402 - DNA, 601 bp, Human
tccagctacttctcactgcttctaccagctacagatgtcccatggaggccaccatcatctcctgctgggctgctgcaatagctccctaactggcctccctaattcatctcttgctccccagtactgcattttccatacaacaatcagggccattctttcggaaaatgttggtcagatcatgtcactctcgttctgagaatcctccaagcagcttctcatgtcaagcatttataaaagccaaaatcctcaccatagcataggatctggccctattccccttccccactccagctcactctgytccaaatgggtctccttgctgttggttaaacatgccaggtatgctccctgccctgggcctacgtgcttactgtttttctgccttgaatgttctttcctcagatattagcatgacttgttagcttacttcctttggtgtctgtccaaagatcaccttaccaaagagtgtttcctgacaattttacacaaaccagtatacctgccttcactctttattctttttactccatcatatatttgtttattttattttctttatttctcccctggaatgtaaactctgtaagactgggtacttcac

SEQ ID NO: 120403 - DNA, 601 bp, Human
gaattactgagttcaggtcctgactttaccactaagtaaatatctgaaagacctaggtatatagtcttccaatgtaggaggattgtgaataaaataaattaaataaattatttactgccagtaaatacaattttattactttcccaaacacagaaaatcatcctatagcttaagtgtagatttgactaaaaataactctgcctcttccaaaaatctggattacaactgttcctagtggatgctctgggctaagctgacaaagacaatgaatgcagattgggaaactgtgctggtcactgtygggctatgggagagtgtcactaaagcaccaatctagactgtcttcactgacgtctacacaagtcaaactgcagagatcctcagaatagtcccagctggatgtaacggcacctatactgaagagttaccagataaaggtgattaaaacctaaggagaagacttcattctagaaataatccagcatctgttttcattagtgggctctaggctttgctaagccccccactttttttttttttttttgagacagagactcttgcccaggctggagtgcagtggcgtgatcatggctcactgcag

SEQ ID NO: 120404 - DNA, 601 bp, Human
caaacaaagcaagaacttccaagccacctctgaatttgggttcctaaataaatggttaaacattttgtgcttttacattttttccttaaaaaggtcagagaaagtatagcatgctggttttgtaatcaaggttttctcacctcttctccactgtactgtttcaagcagtgcaaaaatcggcatgtgttagagagccagaaggagacggtttcaaaatcatcacctcttttctgaaagagagaataagtctaaacttgccttttccttagggaaataacaacctaaaaaaaattgaacagayaccaaaagacccatttctttcagttaccattataaacaattataaaaataaatcacattacagttgtgaagtcttatgtcattgctagcagaatgtcagcgaccaggttcatcagtttgttgctttgcttgccattcacttttttggcatagaaaattaaactgatgcgaatttagctgctcctttaagcagaaaaaaattcacccggctgggcgcggtggctcacacctgtaatcccagcactttgggaggccgaggcagatggattgcctggggtcaggagttggagaccagcctggc

SEQ ID NO: 120405 - DNA, 601 bp, Human
gactataattcctacctcacagagatgctgtaagaattaatgatcataaataacaccatatacagtaagtgctgtctgacacatactaaagcagcccttaatagtcattattaatattctacatagttttgaaatatttgaagtctatcaaacaactaatgaacatatccccacaaacaaaaacaatagagtttttttggacaaatcgaaagacatgatttttgatcaccctttttttttttagagttaaaggattttaaggtcctcttattgtccaagagtattaatattaaaattttcttttttttttttaaactttaagttttagggtacatgtgcacaatgtgcaggttagttacatatgcatacatgtgccatgttggtgtgctgcatccattaactcatcatttaacattaggtatatctcccaatgccatccctccccccgatttttgatcaccttttaatgtattgtggcaagccaaaattgattaatttctttaaatagttcactattctgatattagctcttgaaatgcccactaaaacatactgacaaaaagttttacttctggtaactattcactgaccaatgcttatt

SEQ ID NO: 120406 - DNA, 601 bp, Human
tgtgcttcataaagccctagagtcataaggcaaagttaatgatacacatgaagtaacctgtctcttcagtttaactatctccaatttgatcagcatcttcatgctcttttctgctctgtccaaggagcttccccactaatgccaggactgacattctcaaatgctgatgtgtgtttgtttgcttccatcataaccccctccagttcttactagcttttgaacaataccttaacttggcaacctagcatttaagtcttcccaatagcaatgtcaatgaagcaaattggaggaacttaactaaaaaaaaaaaaaaaaaaaaaaatagagtgtttcacttctgaaacagcaggtttactgtcaaacactaaattatctaaattatctcttaacttcagttctttatagtcctattcttaaaaactacacccaaaggacatatataatcttgaaatagaccgatttctacagagactagtgaatacatacaaaaagttctctttactctatttcgtagtacccacaccatggttttcagtcagaggttagaagggaatctttggtggtatctgttaaaatggaactgaatgggcggcacttcttc

SEQ ID NO: 120407 - DNA, 601 bp, Human
cagacatgagatgcaagaactgaaaacaagtcatcagctctccacaaccctggcaggccagctgggcagcaaaaagacactgtcgcaggtgttggcatttgctcacctgatctgcatgcctttactccaggagcacatgtccttccgcaggagaaggttgttcagggtgatggcccctatgatgtagaacatctgcttgaccacctgcttgatcagttcagggtccatgccatgctgacacatgaccgagtggaaggagttgagctgccggaggatggagtccagtgtgtaggtgccctcrtcggcgatactggaggttcgctttctcaaccctgtgggcttcaccccagacacgccctgaatcgtttcatgttccagcatgcctgagactgcaggagtatttcaattgttagaggagatgatgtggaagggaacctttcatgtgcacatatccatgtgcacaaacacatgcacattcaacttaggaaaattagctgggcacggtggctcacatctgtaatcccagcactttgggaggccgccgaggtgggtggatcactggaggccaggagttcaagaccagcctggccaacataaggaa

SEQ ID NO: 120408 - DNA, 601 bp, Human
agccgagatggcgccattgcactccagcctgggcaacaagagcaaaactccatctcaaaaaaaaaaaaaaaaaaaaaaatttgcaaaaaaattatgttacaataatgaggttatgctgaggagtattgggcataaaattaagtgcagcttttcttaaaatatagaggggggatattttaagaattagtaaaagatctatcagacctgttcttgttgccataggtacaaaaaggtatttttccaaaaatatatttctaagagcaatcaaacattagaaatcttcattattataatttaatamtttcttattgtataattaaaacacacacataaggagaggaagcagctatctcatctttgtgtatttttgcatcatctcttcactcccccaaataagcaagcttcacagtggaaaagggtttcctatcaagaatgtgaagaacctgttggcagggtacagacagggagcaataatgagatgtggtgaaatccagccaggcaagggaaagtggctccgtgccagtttctcccttgctgcttggccacatggcaccagacatgagatgcaagaactgaaaacaagtcatcagctctccacaac

SEQ ID NO: 120409 - DNA, 601 bp, Human
atgctgtcactataatcctcaaatgcccttctcattcttccacttccttaaattcaatgcccagattaatgggaccttccctgaatactgctatcttccctcagtacttcctttaggcatcttactacagaatttgctagaacctctacggtagagtcagttggatacgactctgtcttccctactgaactgtaagctccttgaaggcaggaatttttccttatttattgaagcatcttccccagcaataaatatggtgccttgagatggaggcttaattaatcatctgttgaagtaacargaattatctgtctctaaaaacaaagtcactatttgataatccactcaattatcaaataagatagaaagctattttatggaatataagctgcatagactgtatactccatgagagcagagactttgttttgcctatgggtgtatcccagtgccttcaatgttatatagaacactgtaagtactcaataaatatttgctgaatattaaatatatttatactgtaattagcactgaaatgtattaatttctggcaaaatctccttgctttaagattggtagaggcatatatcttcttgaacac

SEQ ID NO: 120410 - DNA, 601 bp, Human
cccatctttactaaaaatacaaaaaattagccaggcgtggtggcaggtgcctgtagtcccagctactccagaggctgaggcaggagaatggcgtgaacctgggagggggagcttgcagtgagtggagatcataccactgcactccaacctgggcgacacagcgagactccgtcacaaaaaaaaaaaaaaaaaaaaaaaaagaaagaaagtctaagagtcagcacagaaaataaccgggcaaaagaaaattgggcatgttcatgcctgtgccttgcttcatgctgtcactataatcctcaartgcccttctcattcttccacttccttaaattcaatgcccagattaatgggaccttccctgaatactgctatcttccctcagtacttcctttaggcatcttactacagaatttgctagaacctctacggtagagtcagttggatacgactctgtcttccctactgaactgtaagctccttgaaggcaggaatttttccttatttattgaagcatcttccccagcaataaatatggtgccttgagatggaggcttaattaatcatctgttgaagtaacaagaattatctgtctctaaaaaca

SEQ ID NO: 120411 - DNA, 601 bp, Human
ggaggcaagtatttgaattttaaaaagtgggaccactttgttaactaatatttgctaaataaataaactgcaggtctgcctcactctgtgaaatatgcttaaagtatatttaagtattaaagtatattctttagaagttgaatggcagccaacttctataaagttgggcttcctccagggtattcttactttccacacttgcagaaactgggaggaaatctcaggaccattgttctgtcagatagttctgctttattcttagtaagaagttatgcaaacatgaattcaacattaagaagcygcaagtcttgattctgattgtctactgattgactttttttttttttgagatgaagtctctgtgcagtggcacaatcttggctcactgccacttctgcctcccaggttcaagtcattctcctgcctcagcctcccaagtagctgggattacaggcacccgccacaatgcctggctaatttttgtatttttgtagagatggggtttcaccatgttggcctggctggtcttgaactcctgacctcaggtgatctgtctgcctcagcctcccaaagtgctgggattacaggtgtgagccagcac

SEQ ID NO: 120412 - DNA, 601 bp, Human
tttttaaaaagttcaataatttttttttgtaaaatggtcatgtctcttttctaatgaaaataaatcatcgtctatataaggtagatatttccattttcaaggtattgtctaaacctgtgctgtccaatacaacagtagtagtcactagccacatgtggctattaacacaaaatgaaaataaaagttgaatgcaggacagtgctgatctataggaaaataaattaagcaccagagaactagaaagtgggcatgttgttatcaggtctgtgggtgacaaactgaattagggatcagtctctcrgaggcaagtatttgaattttaaaaagtgggaccactttgttaactaatatttgctaaataaataaactgcaggtctgcctcactctgtgaaatatgcttaaagtatatttaagtattaaagtatattctttagaagttgaatggcagccaacttctataaagttgggcttcctccagggtattcttactttccacacttgcagaaactgggaggaaatctcaggaccattgttctgtcagatagttctgctttattcttagtaagaagttatgcaaacatgaattcaacattaagaagct

SEQ ID NO: 120413 - DNA, 601 bp, Human
aaaaatgtcttgtgtcataaagcaaagcataggtctgtataaaattatttagtatagactagagctgtaaacttagagaagctatgcatcagtgattgctggaatggaaggcattatggagtcaaacagatttttcactatttagaagtagcgaagaattttaattggggaagagagaaaatgtgttatttaagggtacccatataaataagagtataagcctggtgcattcatgaatctgagatttgtgcaagttgtcaaataataataaacatatttatgactagttaagatggggtcrgaatactagaaagtatttagaaagtaggcagaggactttccatatggaaaagtaaggaatagtaggggtactgaagattttttagttggggaagtggtgtgatagtgattaaggcctttttctgtcttttgacataactttttccccctctatacccattttttttttctgagacggagtcttgctctgtcacccaggctggagtgcagtggtgcgatttctgctcactgcaagctccgcctcccaggttcacaccattctcctgcctcagcctcccgagtagctgggactacaggcgcc

SEQ ID NO: 120414 - DNA, 601 bp, Human
ttccacattcttaatcagtctttgagtctgtctgcacaaattccattgctagctcccttgctcgtaaccctgtagccactgtcacaacatccctgttcatatctaaatgagtcctctgtgggaacactttatttttattttttattgaaaaatagagacagagtcttccctgggctggtcttgaactcctgagctcaagcagcctttctgcctcagcctcccacagtggtagtattacaggtgtaagccaccacacctggccaaggagcacttttaaaatgctgaactagtaattctgaaktgggaggtggagtggggaacagggtgggtgtctgcataccctctctaaggtgtgactctgctcagccaggtgaagacactgtgtgcagtgataacctggatccacttcagagtagttgtcactaatcaagaggacggtgctgttgaagcatttgtaaccttgctgtataatgctatttgaatctttttcgtaccctcattagggtggggaccatgttttaatctttgaattaaactgaatatttggccactgactggggtttattaaccattgagcaaagatccttggtggtcacatgtg

SEQ ID NO: 120415 - DNA, 601 bp, Human; identical to SEQ ID NO: 26391

SEQ ID NO: 120416 - DNA, 601 bp, Human; identical to SEQ ID NO: 26392

SEQ ID NO: 120417 - DNA, 601 bp, Human; identical to SEQ ID NO: 26393

SEQ ID NO: 120418 - DNA, 601 bp, Human; identical to SEQ ID NO: 26394

SEQ ID NO: 120419 - DNA, 601 bp, Human; identical to SEQ ID NO: 26391

SEQ ID NO: 120420 - DNA, 601 bp, Human; identical to SEQ ID NO: 26392

SEQ ID NO: 120421 - DNA, 601 bp, Human; identical to SEQ ID NO: 26393

SEQ ID NO: 120422 - DNA, 601 bp, Human; identical to SEQ ID NO: 26394

SEQ ID NO: 120423 - DNA, 601 bp, Human; identical to SEQ ID NO: 29795

SEQ ID NO: 120424 - DNA, 601 bp, Human; identical to SEQ ID NO: 29796

SEQ ID NO: 120425 - DNA, 601 bp, Human; identical to SEQ ID NO: 29797

SEQ ID NO: 120426 - DNA, 601 bp, Human; identical to SEQ ID NO: 29798

SEQ ID NO: 120427 - DNA, 601 bp, Human; identical to SEQ ID NO: 29799

SEQ ID NO: 120428 - DNA, 601 bp, Human; identical to SEQ ID NO: 29800

SEQ ID NO: 120429 - DNA, 601 bp, Human; identical to SEQ ID NO: 29801

SEQ ID NO: 120430 - DNA, 601 bp, Human
cccgaaacacaccgaataggtggatgcatctaatttacagatgaagaaaccgagatcacacaatgggagatagcacaggctggtaagagagactggggcgctcatccacttcgttgtactgtctctcagcgagatcctaggaaaacccttacacttctttgtgaagacagaccttggctttccagattttctcaaaggagtctgggcccaaaaagcgatcctctacttcagagaaaagttcctttatggggcatatgaggttcttccaagcacacaaagcttagaaactctttaaaaacaracaaaacacctggtggacacagaggcctgtgagtcatgaaaggagaagggaaaaatcggaaaaccagatttagaagccatccttctttgaagagaacgagaaagtagaaagcagcccttcccctcttccacgaggcgtgactcagggacgttacctcccccgatttgctctatgcactaagagggtgaccctcctctgctttcgactctggcccagacactcacgggttacccggccaggcctggagaacccaggtctaaacagatgggactcgtgggggaacaagggggcccctgtgcg

SEQ ID NO: 120431 - DNA, 601 bp, Human
tgagcaggagaggttgccagaagactaaagacagaaaaatgtagtactcgtgttcaaaaaaagagaaatgggatcctgccaactattgatcactgaagttagatgtaattttagacatgattctagcatcattactaagagaagtttgtgaacacttagaaaaagtagtaatcagtgctcccttagtagcacatatactaaacgggaacaaatcagagattagcatggcccctgtgcaatgatgacacacaaattcttaaagcattccacatttttacttgaattaaaaaatccttttctsatacaaaaatcagccgggtatggtggcaagcgcctgcagacccagcaactcgggaggctggagaaggagaattgcttgaatccaggaggccactgcactccagcctgggtgacagagagagactctgtctctaaataaataaataaataaataaataatccttttccgaaaaaaaagacaaaaaagtagtaattaacatatgctactggaatatagtatagtttcactaaggacaagtaatgatagggtaaagaaaacgaagcatataaaatctgggttttagtaaggcaactgtcaaag

SEQ ID NO: 120432 - DNA, 601 bp, Human
gaaatgcagaaatcacccatcttctgcatcaatcacgctgggagctgcagactggagctgttcctattcggccatcttgaacgaagatctatttaatttcttttaaagtcaaaagaacataggccaggtgtggtgggttaagtttgtaatccagcactttgggaggctgaggcagcagatcagttgaggccaggagttcaagactagcctggctaacatggcaaaaccctgtctctattaaaaatacaaatattagccaggcatggtggcacatacctgttatcccagctacttgggaggmtgaggcacaagaatcacttgaacccgggagtcggaggttgcagtgagccgatatcatgccactgcactccagcctgggtgacagagcaagactctgtctcaagaaaaaaaaaaagtcaaaagagcatgaaatatgttgcaaaaggacatataggtcttaaataaaatatttatgttgcaaagaagttaagatactcaaaaaactggggatagaaggaacacaccccaacataataaaagccatatatgacagacccacagctagtatcatactgaatggggaaaaactagaaagcctttc

SEQ ID NO: 120433 - DNA, 601 bp, Human
gcttcgtcccaggggggcacccacctgtatgaggtgtctgtcgccccctactgggaggtgtctcccagttaggctacacgggtgtcagggaccccttgaggaggctgactgtccattctcagagctcaaacaccatgctgggagaaccactgctgtcagagatgtttaagtctgcagaagtttctgctgccttttgttctgctatgccctgcccacagaggtggagtctatagaggcagtaggccttgctgagctgaggtaggctccgcccagtttgagcttcctggccgctttgtttacytactcaagcctcagcaatggcggacacccctcccccaacccggctgcagcctcacaggtccatctcagactacttcgctagcagtgagcaaggctccacggatgtggggcccgccaagccaggcacgggagagaatctcctggtctgccagttgctaagaccatggggaaagtccagtatttggacgagagcgtcccatttttccaggtacagtctgtcacggcttcccttgactaggaaagggaaatcttctgatcccttgtgcttcctgggtgaagtgacgcccttccctgcttcggc

SEQ ID NO: 120434 - DNA, 601 bp, Human
tgtttgttagttttccttctaacagtcaggtccttcagctgcaggtctgttggagtttgctggaggtccactccagaccccgtttgcctgggtatcagcagcagaggctgcagaacagcaaatatttcagaacagcaattattgctgcctgatccttcctctggaagcttcgtcccaggggggcacccacctgtatgaggtgtctgtcgccccctactgggaggtgtctcccagttaggctacacgggtgtcagggaccccttgaggaggctgactgtccattctcagagctcaaacaccrtgctgggagaaccactgctgtcagagatgtttaagtctgcagaagtttctgctgccttttgttctgctatgccctgcccacagaggtggagtctatagaggcagtaggccttgctgagctgaggtaggctccgcccagtttgagcttcctggccgctttgtttacctactcaagcctcagcaatggcggacacccctcccccaacccggctgcagcctcacaggtccatctcagactacttcgctagcagtgagcaaggctccacggatgtggggcccgccaagccaggcacgggagaga

SEQ ID NO: 120435 - DNA, 601 bp, Human
tggggttttggtgtggatgtcctttttgttgatgttgatgctattcctttctgtttgttagttttccttctaacagtcaggtccttcagctgcaggtctgttggagtttgctggaggtccactccagaccccgtttgcctgggtatcagcagcagaggctgcagaacagcaaatatttcagaacagcaattattgctgcctgatccttcctctggaagcttcgtcccaggggggcacccacctgtatgaggtgtctgtcgccccctactgggaggtgtctcccagttaggctacacgggtrtcagggaccccttgaggaggctgactgtccattctcagagctcaaacaccatgctgggagaaccactgctgtcagagatgtttaagtctgcagaagtttctgctgccttttgttctgctatgccctgcccacagaggtggagtctatagaggcagtaggccttgctgagctgaggtaggctccgcccagtttgagcttcctggccgctttgtttacctactcaagcctcagcaatggcggacacccctcccccaacccggctgcagcctcacaggtccatctcagactacttcgctagca

SEQ ID NO: 120436 - DNA, 601 bp, Human
atggggttttggtgtggatgtcctttttgttgatgttgatgctattcctttctgtttgttagttttccttctaacagtcaggtccttcagctgcaggtctgttggagtttgctggaggtccactccagaccccgtttgcctgggtatcagcagcagaggctgcagaacagcaaatatttcagaacagcaattattgctgcctgatccttcctctggaagcttcgtcccaggggggcacccacctgtatgaggtgtctgtcgccccctactgggaggtgtctcccagttaggctacacgggygtcagggaccccttgaggaggctgactgtccattctcagagctcaaacaccatgctgggagaaccactgctgtcagagatgtttaagtctgcagaagtttctgctgccttttgttctgctatgccctgcccacagaggtggagtctatagaggcagtaggccttgctgagctgaggtaggctccgcccagtttgagcttcctggccgctttgtttacctactcaagcctcagcaatggcggacacccctcccccaacccggctgcagcctcacaggtccatctcagactacttcgctagc

SEQ ID NO: 120437 - DNA, 601 bp, Human
caggcgtgagccaccgcgcccggcccattccatgcattttcatataagtacctgcatgtagagaaatacacttttgttgtttttagtctttttaaattttagtcttgttcaatagtatcatactatgatgttgtttttttcatttaacaatgatagatttactattgctgttaaatgttacaatagtgctaccttcttgcagtaacagaacagttttgtatcttgattgtggtggtggctatacgaatctatacatctaataacatgtcacagaactatacacaaagacacaccaaaaaaygggcacatgcaaaaactagtgaaatccaagtaggatctgtagtccagtcaattatattgtaccaatgtcaatttcctgatttggccaatgtactacaattacataagatgttaccacttgggggaagttgggctacgggtaaatgggatttctctgtattcattttgcaactttttttttttttttcttgagacagggtcttgctctgtcacccaggctggaatgcagtggtgcaatcacagctcattgcaacttcaaactcctgggctcaagcaatcctcccgccttaactcccaagta

SEQ ID NO: 120438 - DNA, 601 bp, Human
taatcagattgtggtctgtctctgccaactaaagtataaattccttgagcacaggaaccctgtgcattttgttcacccttacatatcaaatgcctggcatatggttgaagctcaagaaatatttgttaaatgaattatagactcagtattttatttatttccatcctttaaaaatgtacgagaatcccattcagtatgacttggcagcagaaaatgaaaggccatgcagacatttaacacatcacacatctgaaatgtcagtaagctacattttttttttttttttgagatggagtctcgytgtcacccaggctagagggcaacggtgcgatctcggctcagtgaaacctctggcccctgggttcaagcgatcctcctgcctcagcctcccaagtagctggggttaaaggcatgcgccagcacccctggctaattttgtatttttagtagagatggtgtttcaccatgttggtcaggctggtctcaaactagcaaactcaggtgatccgcccgcctcggcctcccaaagtgctgggattacaggcatgagccactgcacctggccagctacatagtgttttgaatgtcatttttctttcat

SEQ ID NO: 120439 - DNA, 601 bp, Human
tttactatgtgacatgcattgttatctaagtgaactgtctaaattaatcttcacaacaacactatgaggtttgtaccatcttaatccccattttccaaataaaaactagggcttagaaaggttaactaatttgaccatgtcaactcagttcacaagtgctggagcctgggctttgaaatggtattaggctatgctgctttagaaaatccactgaaagaaacaccagggcttcttggagaaatggctgattctagtacaagataaacctagaacatcttattgtgcctaaagtaaggaaggkctcaaaaaatgatggagacatgtcaaaagtacacagaaatcagcttaaagagcctacagctggacaattttcaacaactgaacaccaaagtacatactgatagtaacagattataaacccattgaatagagcctacagctggacaattttcaacaactgaacaccaaagtacataatgatagtaacagattataaacccattgaataaaataataatccaggattactggggctaaagggggagatgagaaattctttgcagtagaacgccaactaataaatataaatgagtgatacagt

SEQ ID NO: 120440 - DNA, 601 bp, Human
atttagaactatcggtctgactcacaagaaaccctttatcatctttcctcacacactgtgctggaccctcagcagccatttcatgcaacaacacttgcttctcctggtcacaactaactaaagcactagtcaacatcagactttaactgtgccagaggctcctcctaaggagtctgaaactagaaaggcaggcaggatgcatcaagctacctccttccctttttttttcttgagacgaagtctcgctcttgtcccccaggctggagtgcaatggggtaatctcagcttactgcaacctccrcctcccgggttcaagggattctcctgcctcagcctcccgagtagctggaattacaggcgtctgtcaccgcgcctggctactttttgtatttttagtagagacggggtttcaccatgttggccaggctggtctcgaactcctgacctcaggtgatctgcccaccttggcctcccaaagtgctgggattacaggcgtgagccaccatgcctggcctgcctccttccctttcttcacacctctctctgaacaggctggtcccctaacatatagatggaaatgctgagtggggccatgttccac

SEQ ID NO: 120441 - DNA, 601 bp, Human
ttaaaagcaatgttctgaattataacccaaaataagcaaacagacataatgcaataaggatttgtttgttaacgctattgttcggctgcataatgggcaatatttagaactatcggtctgactcacaagaaaccctttatcatctttcctcacacactgtgctggaccctcagcagccatttcatgcaacaacacttgcttctcctggtcacaactaactaaagcactagtcaacatcagactttaactgtgccagaggctcctcctaaggagtctgaaactagaaaggcaggcaggatgyatcaagctacctccttccctttttttttcttgagacgaagtctcgctcttgtcccccaggctggagtgcaatggggtaatctcagcttactgcaacctccgcctcccgggttcaagggattctcctgcctcagcctcccgagtagctggaattacaggcgtctgtcaccgcgcctggctactttttgtatttttagtagagacggggtttcaccatgttggccaggctggtctcgaactcctgacctcaggtgatctgcccaccttggcctcccaaagtgctgggattacaggcgtgagc

SEQ ID NO: 120442 - DNA, 601 bp, Human
aaaaaaagaaatgacccaaaaatttctacctccattcctaagctttcccctgagcgccagagtcacttatcaaatcgcctagccaatatctccacttggaagtttttaggtttctcaactttagtatgttcaaaacagaatatttaagtttatcacaatatcctatacctccctaagaattcctcttctaattaaacagcacagtcatttacccagttacacaagtcaaatactgagaagtctctaacttctttcctgccctcatatcctaatgactcaataaatcttgatgactgtcccyaaatgataatgaagcaaaatctgtatctgcttctagttaccaatgcatgttaaaagcaatgttctgaattataacccaaaataagcaaacagacataatgcaataaggatttgtttgttaacgctattgttcggctgcataatgggcaatatttagaactatcggtctgactcacaagaaaccctttatcatctttcctcacacactgtgctggaccctcagcagccatttcatgcaacaacacttgcttctcctggtcacaactaactaaagcactagtcaacatcagactttaactgt

SEQ ID NO: 120443 - DNA, 601 bp, Human
ccctcaaaaattatatttcaaattatttactgtattattgcttaaattagaacacaactgcatttttggtctagaaaaatattactggatactagatactatttgatagcaatttcaccccagatacaataaatatgttgccagctcctcacctcttccttttgcaaagtgatcaatcctacatctcatgtagttctagtaagacaattaatcttagaggctcaaagtgggctcatgactcaaagcctggccacttaccgtatcccacttccatctccacggagtttaagcaaggtcaacwcaaacttctccatagattttgaaacataaatactaaaaaggggccaggtgcagtggctcacacctgtaatcctagcactatgggaggccaagtcaggcagatcccttgaagtcaggggtttgagaccagcctgggcaacatagccagactccatctctttaaaacacaaaagttctctctctccttctgagacaagtattatgaggccaatgcaagccattatgccaccatacagaaggcctaaagatggaagaagacagacccctgacatcatcgtttgatccctggaatctagatgtg

SEQ ID NO: 120444 - DNA, 601 bp, Human
tcacttttagataatttatttcatttaaggtaatatccactacactacttggcatcacagagctgaatacaggaatatcatcaaacagaatatcagaaatatattacaaagcctggaggaaaaaaaaccctcaatttttgaaaacttggcagaacgcaaacatccaaaaattggctctattattactatcaaatactttttgtaagcattgaagatttgtaaccttgaaacattacaattttgttacattacactaacttgtaacatcacaagtttgtggtatgatacctcaaactgtacttttttttttttttttgagatggcatttcactcttgtggcccaggctggagtgcaatggcaccatcttggctcactgcaacctccgcctcccgggttcaagtgattctcctgcctcagcctcccaggtagctgggattacaggcacctgccaccacgcccagctaatttttgtatttttagtagagaaggggtttcaccatgttggccaggctggtctcgaactcctgacctcaagtgatctgcccaccgtagcttcccaaagtgctgggattacaggcatcagtcaccacgcccagccct

SEQ ID NO: 120445 - DNA, 601 bp, Human
ttccatccccactgttgcccttaatttgtactattcttaatcactatctaaaatgctttcaatactatgacatgtgaggaatcaaataaagaccattaataccacaatgcagaagtaaaatacattggccttaagtccaactgcttggattcatattctggaccatcaagcctactaggggtttggccttggtcaagtcatgcatttcctcatctgtaaattggagggtgataccagtacttagcaattcaggttgttataaagactaaatgagataattcatgtaaagcatatagcacargatttggcacatactgctcaatccatgtcagcatacgttactgtcagtattatacttgagggactacccacagcaagtatttatgaattcacttttagataatttatttcatttaaggtaatatccactacactacttggcatcacagagctgaatacaggaatatcatcaaacagaatatcagaaatatattacaaagcctggaggaaaaaaaaccctcaatttttgaaaacttggcagaacgcaaacatccaaaaattggctctattattactatcaaatactttttgtaagcattga

SEQ ID NO: 120446 - DNA, 601 bp, Human
ccaccatgcccagctaatttttgtattttttagtagagacagggtttcaccatgttggtaaggctggtctcaaactcctgacctcaggtgttccacccccctcagcctctcaaaatgctgggattacaggtgtgagtcactgcgtccagcagggtttaagatatttaacctcaattgagttcagtgctgctctaacattctacaatttctttgtcaatgctcttgcatttgtgctttcaccctctctcctcagtagaaaaaaaaaaaacataaagaacccaatggaaattctcgaactgaraaatgcaacgtctgaaaaaaaaaatcactggctaggattaatagaatagtgataactgaaaaaaaataagctaacttgaagacagattaatgaaaattgtcatatgtgaagaacacagaggaaaaatggtaggaaaaaaatgaacctaacttcaggacctaacttcagggtgttgcaggtaagggatttgggattttattttaatttaaataggaagttgcttaaaagggtttaattaggcaggggagtgacccagtaactgcacttctgagtacttatcttaataaataaaaagaaaca

SEQ ID NO: 120447 - DNA, 601 bp, Human
tttatatgtgtctcacatctatactgttttcccttctgtagtactggctggatataacgaaaccctggagcagtccagctatcttttttttttcttttttctcttttttttttgagacagagtttcactctatcccccaggctggagtgcggtggcgtgatcttgacgcactgcaacctccacctcccgggttcaggtgattcttgtgtctctgccacccgagtagctgggattacaggcatgcgccaccacacctggctaatttctgtatttttagtagagacagggtttcatcatgctgcctaggctgggggctcgaacttcccaaagtgctggaattataggtgtgagccactgcgccaggtctttttttttttctttttttttttttttgagacagggtcatgctctgtcacccaggctggaatgcaattgtgcaatcatagctcactgcagcctcaaattcctggactcaggaaatccttccacctcagtctcccagggtgctgggatcataggcatgagctactgtgcccagaccagctatctttcttatcagtgctgctggacaaaagtagtcgacctcctggatttaatatct

SEQ ID NO: 120448 - DNA, 601 bp, Human
gtaaaaacagactattatcttatgggaccaccactggatagccattcattattgactgaaacatcattatgcagcacatgactgcatttcttattatttcacatacttcttttctttttttttttttttgagacagggcctcactctgtcacctaggctggagttcagtggtacgatctcagctcactgcaacctccaccttccaggctcaagtgatcctcctgcctcagcctccagagaagctgggactacaggtacacgccaccataccagctaatttttttgtaatttttgtagaggyggggttttgccatgttgcccaggctggtcttgaactgctgagctcaagcaatccaccccccttggcctcccaaagtgttgggattataggcatgagccatggcacccagcctattttgcatacttctttactgattcattaagtcgcagtctaattagcattacagattatgagtaataactttattatctaggtctctactgtgtagtcacctcctctgctacattgttacttcctcagtgcattcttctctgacccaccccatctaaagctgaatctccttgctgttgtatcctcagt

SEQ ID NO: 120449 - DNA, 601 bp, Human
gagggtagagctgaaagcttcaagcttacaatcgtgactttatctttctggtgactagcccccatccaggagtccaccaagggtcacctcatttgtacaaaagtcactcctaattacccaggaaatcctgagggatttaggagctctgtatcagatgctcctaccactcaggaaattacaaaggtcttaggagttctgtgtcaggaactggggtcaaagaccaaatattacaacaaaagatactcctagtactcctatctacaagggtattaggaactctgtctcaggaatcagggcagcratcaaatgatatgacaaatgattctcctagcacccctatcattcaggaaattacaagggttgtaagagttctgtgccagagagtaggagcagagactaatatatgtagtcatgtgtcaactggcaatggggataagttctgagaaatgctttgttaggtgatttcattgttgtacaaacatcatggagtatacttacacaaacctaaatgtgtagcatgttactgtactgaatactgtaggcaactgtaacacatggtaagtatttgtgtacctaaacatagctaaacatagaaaaggta

SEQ ID NO: 120450 - DNA, 601 bp, Human
ccggtcaataattatacatttataaataactaaaacagtgtaactggattgtttgtaaccacaaaggacaaatgcttgaggggatggatactccatttaccatgatgtgattattacacatttgataaagtatgactatatcaaagtaactcaagtactccataaatatatatgtatacacatctattatgtacccacaaaaaattttaaaaatttttaatcaaaacttcaaaatattagaaataaatatgattataaccttatttttaagctgcacataaaaaataataaaagaaaatayattgttttaatcttgtgtatttgaactagattttgtatttttctcatttttctttgtattttttaatgagcatttattactcttttattaagggggaaaagtaacaaaaatttcccctgccaactgtacatctgagcgcaaggacaagggaagctggaaacagttaaatcttaaaaaaagagctcttcagggtatgtgcatataacgcctcttgtcctacttcccattagaagtattgctaataacctcaggaagctccacccacattagcctcattttgtctaactgatatattggatt

SEQ ID NO: 120451 - DNA, 601 bp, Human
acttaatggaacagcatatgactattaaaatattttgatgcagctataaataaaatggaagaaatgtttcaagtttaaggcaagatgaaaaaaaatgaaacatagaaataatgtgatagtggtttcaatctttaatcttagatttattgcaaacgatcttccctatatatatagatgaggttgtgactagtaaaacacaaattaatttttaagtgttaatgaagtaatattagcttaacaatatgttcctcaatcaacattctaagattatgacttaacatgtagttctgtgtgcagtttyttcagttgtcacaaaatgtttctcaaacttgaaaatattagctggggaatgaagcaagatggccaaatagaagcctctacccatggtccctccatttacaggaacaccaaatttaacaactatctacacaaaaaagtacgttcataagaaccaaacatcaggagcgatcataatacctggttttaacttcatattgctgaaagaggcaccaaagagggtaggaaagagagtcttgaactaccaactccaccccttccctatcccctggcagcagccatgtggcagaaagagagaatctat

SEQ ID NO: 120452 - DNA, 601 bp, Human
gtatcaaagtatactataaagaagtgataacacaacctattgaatggaagaaaatatctgcaaatgatatatctgaaaagaggttaatatccagaatatataaagaactcctcaaactcaacaacaaaaaaacaaaacaacctaatttctccccttttgagccatcatgtttgcctcaatctctgccatcaaattcttccagccaataagattttgttttttctgcgaaagtttagtatcctgcgtagagcacactagtgcctgtcctctgactgaaactaaaaactaaaaaatggtaaaytcacctggctaaacaagtacaactctgttagtccctctctactgctttgagatacttttaaaaaaatatattgtatccaggccacacatggtgtctcatgactgtaatcccaatactttgggaggccaaggcaggaggatctcttgagaccaggagttcaagacaagcctgggcaatgtggcaaagccctgtctctacagaaaaaaaaaaaaaaaaaaaaaaaaaatagccagtgtggtggtgcatatctgtagtcccagctagtcaggaggctgaaatgaaaggattgcttgagcccag

SEQ ID NO: 120453 - DNA, 601 bp, Human
gctggagcagggtggcgcaatctcggctcactgcaacctctgcctcccaggttcaagtgatgctcccacctcagcctcctgagtagctgggactataggtgcacacccccatacctggctaatttttgtattttttagtaaagaggaggtttcgccatgttggccaggctggtctcaaactcctgacctcaagtgatctgcctgcctcggcctctcaaagcgctgggatttggacacctgccaaagaatttttattgaaatagcaaccaaatattgcttatacctattactcaaaataatrcaaaataaaacaggcttactagatattttggggcttaaatttgtgaagtaaaatccaaaaaagtaatgcaggtaaaagttagcagcttaagtaaacatgaaactctaaaacatataagctactgaatttttaagattttaaacactgaagtaatttctaataccaattctctactcttttccctttccaactccctttaaactttatcttactctcatcaagaaaagcacagttctcacatttgcatctcaccagaaatgcattattatggtccctacagggagccattccagcaactct

SEQ ID NO: 120454 - DNA, 601 bp, Human
cagatataccagatgtcacttttctccttatggcctataaaatagtcacaattatcttacaagattccacactcaaatttcacagaaacggagataaggatattgccttaaagtgcttacatctccactgatttatacagcctgatttaacccttgtttatttataaattagtattttattctattttttaaatgtccaagtcatttaaaaattaccttgataactaaccctcgatattaaaagagagaagccagtgatcatacacataaaatctacaccatctttgaatttaagtacctrataatgaactgtttttactcacaacacttctgacaccaaatgtttgggtttttttttttttttttaaatcacaccaaccaattctccaattcttcagacaccaattaggtgtctaacaattcaatacaattttgatagtaactacctggagttagcccagacctcacagactaagaggtcagtcccataagactgcctgccacagctgctagccacagatgacatgcccaggctactcccatttctgcctacagactacaaatttgagggttcccatgaccccgcctcagatttaataat

SEQ ID NO: 120455 - DNA, 601 bp, Human
tggcatgatctcggctcactgcaaccttcgcctcccaggttcaagcaattctcctgcctcagccttctgagtagctgggattacaggtacgcgccaccacatccggctaatttttgtatttttagtagagatggggtttcaccatgttggtcaggctggtctcgaactcctaaccccatgatccgcccaccttggcctcccaaagtgctgggattacaggcatgagccaccatgcctggctactgagtacctattataggtcaagcacagtgcttggcactggggatataacagtgaattaaaaaaaaaaaaaaaagacagtttattcccatggagaagtttcaccctagtgggaagatactggcaactaaatagacaattaaaatatagtgcggtaaatatagaagcgggatagcacagggtaccacaggtgcacagagaagacaaactaaacccagaaaggctgtcagataaaatataagatacctagttaaatttgaattttagatgaacaatgaataattttttagtagaagtatgttccaaatattgtcctctacttgctatatctggcaacccttggtgggagtgatgtttagaa

SEQ ID NO: 120456 - DNA, 601 bp, Human
ttattaagtaccttttttttttttttttttttttttttttgagacagagtctcgctctgtcgcccaggctggagtgcagtggcatgatctcggctcactgcaaccttcgcctcccaggttcaagcaattctcctgcctcagccttctgagtagctgggattacaggtacgcgccaccacatccggctaatttttgtatttttagtagagatggggtttcaccatgttggtcaggctggtctcgaactcctaaccccatgatccgcccaccttggcctcccaaagtgctgggattacaggcrtgagccaccatgcctggctactgagtacctattataggtcaagcacagtgcttggcactggggatataacagtgaattaaaaaaaaaaaaaaaagacagtttattcccatggagaagtttcaccctagtgggaagatactggcaactaaatagacaattaaaatatagtgcggtaaatatagaagcgggatagcacagggtaccacaggtgcacagagaagacaaactaaacccagaaaggctgtcagataaaatataagatacctagttaaatttgaattttagatgaacaatgaataa

SEQ ID NO: 120457 - DNA, 601 bp, Human
gttttcattcttggaaagcccacatgcatttattaagtaccttttttttttttttttttttttttttttgagacagagtctcgctctgtcgcccaggctggagtgcagtggcatgatctcggctcactgcaaccttcgcctcccaggttcaagcaattctcctgcctcagccttctgagtagctgggattacaggtacgcgccaccacatccggctaatttttgtatttttagtagagatggggtttcaccatgttggtcaggctggtctcgaactcctaaccccatgatccgcccacctyggcctcccaaagtgctgggattacaggcatgagccaccatgcctggctactgagtacctattataggtcaagcacagtgcttggcactggggatataacagtgaattaaaaaaaaaaaaaaaagacagtttattcccatggagaagtttcaccctagtgggaagatactggcaactaaatagacaattaaaatatagtgcggtaaatatagaagcgggatagcacagggtaccacaggtgcacagagaagacaaactaaacccagaaaggctgtcagataaaatataagatacctagtta

SEQ ID NO: 120458 - DNA, 601 bp, Human
caattataagaccaagtgttttcattcttggaaagcccacatgcatttattaagtaccttttttttttttttttttttttttttttgagacagagtctcgctctgtcgcccaggctggagtgcagtggcatgatctcggctcactgcaaccttcgcctcccaggttcaagcaattctcctgcctcagccttctgagtagctgggattacaggtacgcgccaccacatccggctaatttttgtatttttagtagagatggggtttcaccatgttggtcaggctggtctcgaactcctaaccycatgatccgcccaccttggcctcccaaagtgctgggattacaggcatgagccaccatgcctggctactgagtacctattataggtcaagcacagtgcttggcactggggatataacagtgaattaaaaaaaaaaaaaaaagacagtttattcccatggagaagtttcaccctagtgggaagatactggcaactaaatagacaattaaaatatagtgcggtaaatatagaagcgggatagcacagggtaccacaggtgcacagagaagacaaactaaacccagaaaggctgtcagataaaa

SEQ ID NO: 120459 - DNA, 601 bp, Human
atgtttataaatcagaagattcaggctgggtgtggtggctcacacctgtaatcccagcactttggaaggctgaggcgggcagatcacaggccgaggtcaggagttcgagcctggccaacatggtaaaaccccatctctactaaaaatacaaaaattagctgggcgtggtggcaagcgtctgtaatcccagctactcgggaggctgaggcagaatcgcttgaacccaggaggcggagcttgcagtgagccaagatccagccactgcactccagcctgggtgacagagcaagacttcatctcaaaaaaaaaaaaataaaaaaaaaaaaagatcctttatgataatggttcttgttttcatctttactcttatcccagacacctatccttctgcgacactgaattgcttttagttccctgttttctcttctagcctttctatatgctcccagtggcgggacacggtggctcacgcctgtaatcccagcactttaggaggccgaggcaggcggatcacaaggtcaggagatcgagaccatcctggctaacacggtgaaaccctgtctctactaaaaacacaaaaaaattagccgggtgtggtggc

SEQ ID NO: 120460 - DNA, 601 bp, Human
actggttctgtaaaccagtgagaattgctagcaaacaactttgtacagtccaccccctgtccccctattttgcctttcaaactccacttgtaactgctgctaacaggagtgtatattcagggaaacttgaatctatgttcccaggttgtaatcctcaagtttggcccaaataaactctccacttatattagttttgcctccatttcttcattttaggttgacatatccaattagaaacactcaagttaattcacaataatgtgtgcttgataaaacttgcaaattagtgaactaatatgcttttttttttttttttttgagatggagtttcgctcttgttgcccaggctccagtgcagtcagtgacgcgatcttggttcactgcaacctccgcctcccgggttcaagtgattctcctgcctcagcctgccaagtagctgggattaaaggctcctgtcaccacacccagctaatttttgtatttttagtagagacgcggtctcaccacgttggccaggctgatcttgagttcctgacctcaggtgatccacacacctcggcctcccaaagtgttgggattacaggtgtgagctaccactcct

SEQ ID NO: 120461 - DNA, 601 bp, Human
aaactgaagcactgtagcaactgagaaaagaaaagaacttttatctgaggaatgcaagtccttttaaatatcaggcccagatagacattaaaatgagattacaatcatgcctactcccctcctttgagctatgtattcatctgtttaaactgcttactattgccataagtagccataaattagcttaataatccacatcaggtgtgaattataataacactataatccataccttataggttaacaacgtatagtcaatcactaatcaattctcactggttctgtaaaccagtgagaattsctagcaaacaactttgtacagtccaccccctgtccccctattttgcctttcaaactccacttgtaactgctgctaacaggagtgtatattcagggaaacttgaatctatgttcccaggttgtaatcctcaagtttggcccaaataaactctccacttatattagttttgcctccatttcttcattttaggttgacatatccaattagaaacactcaagttaattcacaataatgtgtgcttgataaaacttgcaaattagtgaactaatatgcttttttttttttttttttgagatggag

SEQ ID NO: 120462 - DNA, 601 bp, Human
aagtacagaggtaatgataagagagatgggagggagaaaaagagccctggatgttgcagatagcagttgcaacacggcgttggtgggaagctgccaagtttctggttggtaaagatcctacttccttaaatttgtaggtatgaagtagagaagggtagaaatctacctttttcctgcctgtccccgctattttgtctcagggatcaatcttcatttctactcatcgaaattcctcctgttgcctggcacattttaatctgtattgccaatctctatttgtagctttgcttttttgtgtatwttcccaaatttgaccgaagcataagacagaaaattaagttgggtcccaccagctagctatcatctaaattcaggcttccccattgattttttgagcccaaaaggtcctaaaataatctagcacacattcaacctgggaaaagcagataagtggaagcaatagcttctcatgtgctcttgccccccttcagccttcagccacactacaatcttacataaacagaaatatgcctattgatactattgagcatattaaatacagtatagtaaaaaagaaagtggcattttctctcaaggatct

SEQ ID NO: 120463 - DNA, 601 bp, Human
tccttggtcttagacctgggggcctcagcctggtcagccaggagcttcttgcgggccttgtctgccttcagcttgtggatgtgctccatgagaatccgcttgtttttgaacacatttcccttcaccttcaggtacaggctgtgatacatatggcgatcaatcttcttagattcacagtatcttctaagcagccggcgcagaatccacatgaccttctctggcattcgcgcattggctgtacccttccgcttacctatgccactgtgcctgccttccggcgggccaaggtctttttccggcwtcaagcccaggaatggactgtcaacaggcttgctgatgatcagctcatctttgatcagcttccgcatctgctgacgggagttggcattggcaatttcactggtctcattcgggtccaaccagaccttcttcttgccacagcagaggacagaagaggcgagcctcttctgaagcctgagcatactcatggctgcggcggcggcagcagcaaaagggttttttttttttttttttttttttgagccggagtctcgctctgtcgccaggctggagtgcagtggcgcgatctcggctcactgca

SEQ ID NO: 120464 - DNA, 601 bp, Human
cccaaagtgctgggattacaggcgtgagccaccgtgcccggcgatgcttattttattattttttttgagacggagtctcgctctgtcgcccaggctggagtgcagtggcacgatctcggctcactgcaagctccgcctcccgggttcacgccattctcctgcctcagcctcccaagtagctgggactacaggctcctgccaccacgcccggctaatttttttgtatttttagtagagacggggtttcactgtgttagccaggatggtctcgatctcctaacctcgtgatccacccacctcrgcctcccaaagtgctgggattacaggcgtgagccaccgcgcccggccgcttatttttactcttatttatttatttatttttggagactgagtctcactctatcacccaggctggagtgcagtggtgcgatcttggctcactgcaacctccacctcctgggttcaagcgattctcctgcctcagcctcccaagtagctgggattacaggcgcatgccaccacactcggctaatttatttttacaagcagataaaggtttcttttattttaatggctgatctatgtaatcacggaggccagt

SEQ ID NO: 120465 - DNA, 601 bp, Human
actgtctttgctcctttttcagagatcaggtgactatatttgggtgagtccatttctgcgctctttattctgttctactgatatatgtgtccattcttttgccaataacacattatcttgattactgcagctttatagtaggcctcaaaaatcaggtaatgtgagtcttagatatggtttttgacaattcctgagtctatcttttaaacttatatgttaacatattcatttttattctaattactaataaggtggtcttatatttgtcactctattatgttcactgctcttcaacactatygcttattgtcttttgctaataacagtgcagacattttctttttcctaataacactgtaaatagtgtttctttttttttttgagatgaagtctcgctctgtcaccaggctggagtgttgtggcatgatcttggctcactgcaacctccatctcttgggttcaagtgattctcctgcctcagcctcctgagaagctgggactgtagacatgtgccaccacgcccggctaatttttgtacttttgtacttttagtagagacggggtttcaccatgttggccaggatggtctcgatctcttgac

SEQ ID NO: 120466 - DNA, 601 bp, Human
tggtaaaactgagattctaactgatatggtttcgctgtgtccccactcatatctcatcttgaattcccatgtgttgtgggagggacctggtggtaggtaattgaatcatgggggcaggtctttctggtgctgttcttgtgatggtaagactcatgagatctgctggttactataagtgggagttttcctgcacaagcgctcctctctttgcctgctgccatacacataagacatgacttgctccttcttgccttccagcatgattgtgaggcttccccagccacatggaactgtaagtccrattaaacctctttcttttgtaaattgccatgtctcaggtatgcatttatcagcagtgtgaaaatggactaaatactaatcaagttcttgacttctcaaagtccacatacttggtgactatcagtattaattacagatatgaattcaatgagtagattttaatcaaaaagctaactaaagcctaatactgttctccatgtcatatactagtccatttgtgccaagtaaactattctggatgggaaaaaaaataaagaagatcacttcagtcctctatatgagaacttttgatggttcctca

SEQ ID NO: 120467 - DNA, 601 bp, Human
tgtctaatcaagagtctcatttgactgtctcccccatctaacagcaacctcattacatctccttggtcaaaagtgcccataaaccactcataagcctcattgagagagatgagaaaacgtaggcttactaatatcaaataacttgcataaatgctagcaagtggtaaaactgagattctaactgatatggtttcgctgtgtccccactcatatctcatcttgaattcccatgtgttgtgggagggacctggtggtaggtaattgaatcatgggggcaggtctttctggtgctgttcttgtratggtaagactcatgagatctgctggttactataagtgggagttttcctgcacaagcgctcctctctttgcctgctgccatacacataagacatgacttgctccttcttgccttccagcatgattgtgaggcttccccagccacatggaactgtaagtccgattaaacctctttcttttgtaaattgccatgtctcaggtatgcatttatcagcagtgtgaaaatggactaaatactaatcaagttcttgacttctcaaagtccacatacttggtgactatcagtattaattacagatat

SEQ ID NO: 120468 - DNA, 601 bp, Human
ccaaggccagaatattcaggggctagatatggtcacacctactctgttatagtcttaaaacaaaaggaaattaaacatccaagtactcaagtatattcccgtgttctcttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacrgggtttcaccgttttagccgggatggtctcgatctcctgacctcgtgatccgcccgcctcggcctcccaaagtgctgggattacaggcgtgagccaccgcgcccggcgtattcccgtgttctctaaataggagagcacccccccggccctccaattgtccagagctagacaacaattacaagttaaaatataaactatttagtgtatgttttaacaataaacctaacagcaacccaaggtcagaaagatgtgataactgaggtcaagtgacaaataaaataaggtggggccaaagtagga

SEQ ID NO: 120469 - DNA, 601 bp, Human
aatattgctgctgcttaaagaatataaaataagagctgtaaaaactcacccagcagtgagaaacaaactgatctctcttacctggtctaaggaagcatgcctctcactgcagtaccaacaacattctacagtctttgttaccattcagtggaaacttgagactgtgtcagacgtaagcaatcgagctcagaaaagctcaatttaaaatacttctcagtaaaactaaaaagatgctcaagaaaactgtttagttaactggctttcaaaagacatatgaatactgtttacaacaaagacatckcaaaagaaattgaaaagtgcaggtcttagatgaaggggcttttctatgtagaaccttgttttcttattaaattaaaaggatatttttattttaaaaaatgcttaaagtacacacttgatcttagccaaaaggccgagaagcaataaaaatgcttaaagtaaaaagggtgaaataactacaagttaacatttttctaaatatcacttgccttttaactaacttaaaaaataagattaaacttactcgtgaaacctgcataatttgaattatacatatcagagtatctgctggctccaaagc

SEQ ID NO: 120470 - DNA, 601 bp, Human
tgtaatgtgtatacacgcacattatacaacagcataggacttctttgtgttacttgtaaaaggaaaggttttcactttcctcattatgaattccaaaaattcaaaaactgtttttcaaaattttgactgctttcattacacgcataatgcttccacactcttcattcctactcttttcagcagataaacattctcctctttccattagcaaccaatccaagcttattatctttctttttagaggcaaactgcaacatatcatttcaattaaacccaaaatattactcccatatttcttatkcaaaggtcttaggaataagcctcagcttctcacagaagatgaaatcatctatcaacatatgtaactgatgtttctcattttattttcattttgagattttgtacctactgtctagtgataaacttttgcaactgtttcctctatattttagatggcttaggctttaaaaaaatggtctatatgatttaattatcaattttttccttaagtgaagttcaacagaattaattttctcacattttcattaattatacaggctacaggcaatatttaaagtttttttttaaatattgggtatgt

SEQ ID NO: 120471 - DNA, 601 bp, Human
ttgacaacttttacatttaaaattaagtatagtaactcattttggtcttattttggttttaatatattgttatgagtatggctgaacactgagcatcttttgtttaaaagttatgtaaatgttccttcctgaaaattatgtccacctattggtttttggtgagttttttttttttttttttttggtagaacgtctttaaatattgaagaaatacgtttattctattatacttgctgcaaatatttcccccaattgaacagtgtttgcttttatatattattcttcgcacattttttttttytttttttttgttttggtgagacggagatttactcttgttgcccaggctggactgcaatggcacgatctcggctcaccgcatcctccgcctcccaggttcaatggattctcctgcctcagcctcctgagtagctgggattacaggcatgtgtcaccatgcccaactaattttgtatttttagtagagacggggtttcaccgtgttgcccaggctgatcttgaactcctgacctcaggtaacccgcccgcctcagcctcccaaagtgctgggattacaggcgtgagccactgcgcccggcct

SEQ ID NO: 120472 - DNA, 601 bp, Human
tctaccaccctatatcagcacttcctaatttactatactttatttttccaccatagtacttatctctatatgacacattacatatttatatttacttatataattactatctgtcttgtcactctcagaatgttaagttctacaacaataggggctttgtcatctcattcattgctccagctaggtgtctccaacactagcatacagcagagcttaatatttgttggatgaataaattggtaagtacatgaatgtctacatggaagtatatatacaaattcataaaactagagtgtacagwgaaaactgagtctcctgccatcccgaatcaccaccaaaatattcccttccttagtgacagctgtggtgccagtttgtagataagcttccaaaaatatcctcagcatatgcaaacacatatgcaaaaatattcttttttttttttttttttttttgagatggagtctcgctctgtcgcctaggctggagtgcagtggcatgatcttggctcactgcaacctgtgcctgccgggttcatgcgattctcctgtctcagcctcctgagtagcttggattacaggcacatgccaccatgcctggc

SEQ ID NO: 120473 - DNA, 601 bp, Human
catcttcttgtctaaaaaacatcccttcaactactgtcccttttaagtcagtctcctgcatcatcacaatctttccctctctgtcagatcattctcatcagcacataaacatgcataatttcttccatctcaaaaacaaaaaaccaacttttcttgaccatccacggtcctccagttaccaactaatttgttgccctctacagcaaaactactcacaaaatctgccagcatttgctgtttccacttcctccacatctcagtttcttttgaaccctctcttcccaattttcccccacaattscactgaaattcttggccttcaatttactttaaccttccatctactcttgacactttttaaaatcacaccttctttagaaacactaactccacttgatatccaagccaccattttctcctggttctcctcccaacctactggccattccttctcagccttagttgttggctccttctctctaaacatttgggagccccttagcttggtcctccaatctcttgtctgtgagcccttcctcatgagatgatcccatctaagtctcctggctttaaatacactgatgactctcgtgtatatttc

SEQ ID NO: 120474 - DNA, 601 bp, Human
ttaaaaacaacgatttttaatgttgcctggattttggttctggcaattccctcaattaactaaatgagatcaatcacctagagaagtggctaagaaacagaactaaaaacttatgccagatcttggcacaggcacaagattttggctcaaatattatttcaatttattgagtaactgaaatatttttgtcttccactagaattgtctagacaccacatatttttttttccactataattctttagggggttccagttacaattaatcaccttcaatatgtccaactaaaatgaaaaaaaatatccagttacataattgtggtttgtctatatgatgctaatataacttttttttcatggcacagactttctgaaaaaaatttttttttgcttgaattagctttaggaaaaaccttcttcacccaagcctacatcacatcctcctacaagaaccaaactggtaacttactataagaaataatacatattttttgtgggtttataaatctcttaaattagaagcaatggtatatcccatatatacagggtccaacttcccagaacaagctaacctattgcccaaaataaaagtgtttggtttg

SEQ ID NO: 120475 - DNA, 601 bp, Human
taagtgcatggcctaaattcatagctccttggcaataggagctcgacactgtccagaaactgattcctgggactcagtgtattaaaaacaacgatttttaatgttgcctggattttggttctggcaattccctcaattaactaaatgagatcaatcacctagagaagtggctaagaaacagaactaaaaacttatgccagatcttggcacaggcacaagattttggctcaaatattatttcaatttattgagtaactgaaatatttttgtcttccactagaattgtctagacaccacatayttttttttccactataattctttagggggttccagttacaattaatcaccttcaatatgtccaactaaaatgaaaaaaaatatccagttacataattgtggtttgtctatatgatgctaatataacttttttttcatggcacagactttctgaaaaaaatttttttttgcttgaattagctttaggaaaaaccttcttcacccaagcctacatcacatcctcctacaagaaccaaactggtaacttactataagaaataatacatattttttgtgggtttataaatctcttaaattagaa

SEQ ID NO: 120476 - DNA, 601 bp, Human
agcacgtattgccatggaaaaatgtcctattataagagaacacgattacatttacctgaaaaactacatatacatatatttttcatatatttttatatattcataaaaagtctgccaagagaaactacaaatttaatagtggttagcactgatgagtagcatggaggaagcatttgttttatacattttattatttaaaaaaacattttatgaagatgcatgcacttgttttataattttaaaagctactgttgccaggcgcggtggctcacgcttgtaatcccagcactttgggaggccraggcaggaggatcacgaggccaggagtttgagaccagcctgatcaacatggtgaaaccccgtctctactaaaaatacaaaaattagccaggtatggtggcacgcatttgtaatcccagctacttaggaggctgaggcaggagaatcacttgaacccgggaggcggaggttgccatgagctaagatcgcaccacttgcactccagcctgggtgacagagcgagactccatcttaaaaataaataaataaataaaaataaaagttactgtcattctgaaaaagagagagagaatgaatcagc

SEQ ID NO: 120477 - DNA, 601 bp, Human
aaaccaaaccccgcatattctcactcataggtgggaattgaatattgagatcacatggacacaggaaggggaatatcatactctggggactgtggtggggtggggggaggggggagggatagcattgggagatatacctaatgctagatgacgagttagtgggtgcagcgcaccagcatggcacatgtatacatatgtaactaacctgcacaaggtgcacatgtaccctaaaacttaaagtataataaaaaaaaaaagaaaaaaaaaaaagaagtgaggaaaacaaggaaaaaaaaaaaacaacaaacttttttaaaaaggaaacctttttgcatactagactgataaaaaattaacaagtctgataatgcactgagttggtaaggatgtggcaaaacaggcacattttaaaagtactgacttggcacctactattctatgtcaagaactaaggctaagcattaggatattcagtgaacaagtaacactgttccctgcactcaagggactaacatactttgttagtgaagggaatactgtagagcctttctggaggttctgacaatgtgttgattttaattagagaggaataaactgaccc

SEQ ID NO: 120478 - DNA, 601 bp, Human
caggtgcacaaatgataaaaactgtttgatcagcaaagattgaaagtattacctttcctaatctggatgccaaacttcctgcaatacagtttaattacaacccttattatttttccaaccaagatcataactcatcctgagtttgaaatcaatttaaacagcaggtcctttgtttattttgcttttaacatgactgaactggtattatcaaataaagtttccctaccttgtaattgtgcaactgattttcttaaaacaaaatgtggccgggcacggtggctcatgcctgtaatcccagcaytttgggaagccaagcagggcagatcacctgaggtcaggagttcgaaaccagcctggccaacatggcgaaaccctgtctctactaaaaatacaaaaattagccgggcatggtggtacacacctgtaatcccagctacttgggaggctgaggcatgagaatcttgaaccgaggaggtggaggttgcagacagccaagatagcgccactgcactccagcctgggcaacaacagagcaagactctgtctcaaaaaaaaaaaaaaagaaagaaaaagaaaaagaaattgacaaaacaaaaattac

SEQ ID NO: 120479 - DNA, 601 bp, Human
ttctgttcatgaccacggaggtaatctctaagaaaagtgaggctttctctatagctctccttttctgattcctcaccagaatcacccttaatggtccattcatctcaagaggctttttccagcctgttcctctgaactcttccagcctctgcccattatccagttccaaagccacttctacagttttaggtgtttgttatggccacaccccagttcttggcactaatttttgtcttagtctgctataacaaaataccttagcataggtaatttataaatgatagaaatgtatttcttatasttctggtggctgggaagtccaggatcaagacaccagcaaattcagaaggctcactctctgcttcatagatggtaccttcttgtagtgtcttcactacatgaagtggggcagaagggggcaaagagctcccttcaacttttttttttttttagatggagtcttgctctgtcacccaggctggagtacagtgccgcgatctctgctcactacaacttcttcctcccgggttcaagcaattctcctgcctcagcctcccgagtatctgggactacatgtgtgtcaccatgcttggctaatttt

SEQ ID NO: 120480 - DNA, 601 bp, Human
tttttttttttttttttttttgataaagatgaggtctcactatgttgctcaggctggtcttgaactcctgggctcaggaaatccttctgccttggcctcacaaaatgttgggattacaggaatgagccactgggcccagccttttgctactctgtaacaaggatggcttttcctccagtttccaataacatgtccctcactcctatctgatacctcattataatggcctttaccatccatatttgtgccaacattctgttcatgaccacggaggtaatctctaagaaaagtgaggctttcyctatagctctccttttctgattcctcaccagaatcacccttaatggtccattcatctcaagaggctttttccagcctgttcctctgaactcttccagcctctgcccattatccagttccaaagccacttctacagttttaggtgtttgttatggccacaccccagttcttggcactaatttttgtcttagtctgctataacaaaataccttagcataggtaatttataaatgatagaaatgtatttcttatagttctggtggctgggaagtccaggatcaagacaccagcaaattcagaa

SEQ ID NO: 120481 - DNA, 601 bp, Human
aatttattgctcactgttctggaggttgctgagaggtccaaaatgaaagtgccggcagattcagtgcctggtgagggtttattctctgcttcaaagatgatgccttctggttgcatcctaatagcagaaagggtccagggtgctcccttcaacctcttttataagggcactaattccactcataagggtgaagccctcatgacttcatcacttcccaaaaggccccgcctcttaataccaccacagtagggattaggtttcaacatgaatttttggaggaacccattcaaaccacagcatycagttcctggccctctaaaattcatgtctatttcacaggcaaaatacattcatttcattccaatagtctcacaagtcttaactccttcccaaaatcagatatgggtaagactcaaaggtgcaattcatcctgaggcaaattcccctccagctgtgagtctgtgaaatccaacctgtttccaaaatgcaatgatgggacaggcacagaacatgcattcccattccaaaagggagaaaatagaaaagaagaaagggataataggtcccaaccaatacaaaacccaacagggcaaacattaac

SEQ ID NO: 120482 - DNA, 601 bp, Human
agctccgcctcccgggttcatgccattctcctgcctcagcctcctgagtagctgggactacaggcgcctgccaccacgcccggctaattttttgtacttttagtagagacggggtttcaccttgttagccaggatggtctcgatctcctgacctcgtgatctgcctgcctgagcctcccaaagtgctgggattacaggcgtgagccaccacgcccagcctaatccaagaattctttaactaaacaaaaacttttttaaaaatcatggatgagggagttagaggagaagcgataaatggctrtaactgggtgtcttagtccattcaggctaccataacaaaccaccttagactgggtaattaattaattttctttaaagtcttctgcaaggagtacaaaactgggtaatttacaaaccacagaaatttattgctcactgttctggaggttgctgagaggtccaaaatgaaagtgccggcagattcagtgcctggtgagggtttattctctgcttcaaagatgatgccttctggttgcatcctaatagcagaaagggtccagggtgctcccttcaacctcttttataagggcactaattccac

SEQ ID NO: 120483 - DNA, 601 bp, Human
agtcggtaagacttgaacagccacagaatataagaaaattggtttatagggtgatgagccggtcatgctttctaaccctgaaccttaattttgaaatcccaggccaggcacagtggctcactcctataatccccgcactttgggagcctaaggcaggtgaggtaggctcccatttgaggtagggagttcgagaccagcctggccaacatggtgaaaccccatatctaccaaaaatacaaaaaaaatcagctgggtgttgtggtgcacgccggtaatcccagctactcaggaggctgaggcrgaagaatcacttgaacctgggaagcggaggctgcagtgagctgagatcgtgccactacactctccagcctaggtggcagagcgagactctgtcaaaaaagaaaaaaaatttgaagtactgaagttggaggtaaaaatatacttttaatattcacttgatatgctaaggaaaatggagttttaaatttcagagtcctcctaccaaaaatccagacatccttaacttaaatgttatcatgtggtttctctgacaatagaattagttactctgggaaaatcacatagcaattgaacattactc

SEQ ID NO: 120484 - DNA, 601 bp, Human
tccttaataaacatttcctacatgaacaaattagagagatgacgcacctgaataggaaagataaggcctaagagtatgtgagatacagtaagttcctaaactaggataatgagagtgaaacgtaagaaataaaacagaaggaaagtcggtaagacttgaacagccacagaatataagaaaattggtttatagggtgatgagccggtcatgctttctaaccctgaaccttaattttgaaatcccaggccaggcacagtggctcactcctataatccccgcactttgggagcctaaggcaggkgaggtaggctcccatttgaggtagggagttcgagaccagcctggccaacatggtgaaaccccatatctaccaaaaatacaaaaaaaatcagctgggtgttgtggtgcacgccggtaatcccagctactcaggaggctgaggcagaagaatcacttgaacctgggaagcggaggctgcagtgagctgagatcgtgccactacactctccagcctaggtggcagagcgagactctgtcaaaaaagaaaaaaaatttgaagtactgaagttggaggtaaaaatatacttttaatattcacttg

SEQ ID NO: 120485 - DNA, 601 bp, Human
tgggcgacagagtgagactccatctcaaaaaaaaaaaaaaaaaaaaaagagaaagaaaggaaaaaaagagagaaggaagggaaagaggacatagagaaaaactggctatctttatgaaaatgactttgaaagtgaattctagtttacattttctttttttccctccctcattgtcagattgttagctgcggctgatcggagagtgattagcaacactctgctcctttctcttagcacagggcctggtacatagcaattccttaataaacatttcctacatgaacaaattagagagatgacrcacctgaataggaaagataaggcctaagagtatgtgagatacagtaagttcctaaactaggataatgagagtgaaacgtaagaaataaaacagaaggaaagtcggtaagacttgaacagccacagaatataagaaaattggtttatagggtgatgagccggtcatgctttctaaccctgaaccttaattttgaaatcccaggccaggcacagtggctcactcctataatccccgcactttgggagcctaaggcaggtgaggtaggctcccatttgaggtagggagttcgagaccagcctg

SEQ ID NO: 120486 - DNA, 601 bp, Human
cctataatctcagctacctggaaggctgaggcaggagaatcacttgaacccaggaggcagaggttacagtaagcagagatcatgccactgcactccagcctgggcgacagagtgagactccatctcaaaaaaaaaaaaaaaaaaaaaagagaaagaaaggaaaaaaagagagaaggaagggaaagaggacatagagaaaaactggctatctttatgaaaatgactttgaaagtgaattctagtttacattttctttttttccctccctcattgtcagattgttagctgcggctgatcggaragtgattagcaacactctgctcctttctcttagcacagggcctggtacatagcaattccttaataaacatttcctacatgaacaaattagagagatgacgcacctgaataggaaagataaggcctaagagtatgtgagatacagtaagttcctaaactaggataatgagagtgaaacgtaagaaataaaacagaaggaaagtcggtaagacttgaacagccacagaatataagaaaattggtttatagggtgatgagccggtcatgctttctaaccctgaaccttaattttgaaatccca

SEQ ID NO: 120487 - DNA, 601 bp, Human
atacaccaagggtattaaataaggcactcagaagtttgcctcatgagaaaacataaaaacagacaatgtgtctgtacctctcatcaaattctgccttgcattccaagtatgcttgcacttcccactccacacatctggtcccacatccccactttcagtgcatcccccatttcagtgcaggatctttaggggtggcgagtaccttgctaaactatgtcctttgcagggtttaacacagtggtaggggatgctcataggaaaggtacaataaatatttactaactgggataaaatactcaayttttaaaataataggggaaaaagtaacttcatttattgatatgctaaaaggtttatataaaatccactaaaaaaatacagcatagtttccaccaatcactacatcacattctctatcatgctgaccttggatggacaacttataaagaaaaatgtgagttatttgattagcctctggtcaaccctattccttgaacagcagtgtctacaaagctattctaagcattccaatttacccttgaaacagattgtattactactgcagtatttctatatggtattagcagcctacatgcttggt

SEQ ID NO: 120488 - DNA, 601 bp, Human
catgctggcaacaagcttaacttcaggttgtatttgctgctaagcagacaagcaggcagccagtctggtctctctctcttcccacaaatacaaatgccagtatgaggaaaacctgttctggggcatactaaaattcttaaaccagctgaagcaggcagttgtttccctgggatcagttctccaagtttcagccctaggggagaaatgtttttggggcaactgctctgtgtatggaggtgggataagaggtacaaggggatttgaagggttgggatggttcagctggcccagctgctaaaaktctttattcaatcgccctccttacttcctccaacaattcattcttgctttctacgcaggtcaactttaagcctggagcctctctgtgacaatgtagggtacaatggctaccatttctgatgctgacttcttccacgcaatatgcgatgtagatttctctactttcacttttcattataataacactagctttcattttctagttggaaaatctatacccctatcattttttacagcacttttacagatttactttaataataataataattattattattattattattgagacagagtc

SEQ ID NO: 120489 - DNA, 601 bp, Human
caatcatgttttaaacttcatagaatgtttttcttctttgcttcttttccataggatcttctttttctttcatgaatattatctcttctcaggaaccttcagacctctcaaagggtgataattacaactttattttattgttcttttttatcttacatcctcttgggtcataacttttgtttattcatcttgttccttttctttcatcatagttttccaaaaatgtcctgttctttcatgttcacgaatgttggattcaagttttcaatatatagagtttacatgagcttcttgtatgcasgcttgttttcctaagaaggttcccccacttgtggagggctaaccacaacttctctggatgtgagtgggccatgctggcaacaagcttaacttcaggttgtatttgctgctaagcagacaagcaggcagccagtctggtctctctctcttcccacaaatacaaatgccagtatgaggaaaacctgttctggggcatactaaaattcttaaaccagctgaagcaggcagttgtttccctgggatcagttctccaagtttcagccctaggggagaaatgtttttggggcaactgctctgtgta

SEQ ID NO: 120490 - DNA, 601 bp, Human
gcctcagcctcccaaagtgctgggattacaggcctgagccaacacgcccggctggcaatcatgttttaaacttcatagaatgtttttcttctttgcttcttttccataggatcttctttttctttcatgaatattatctcttctcaggaaccttcagacctctcaaagggtgataattacaactttattttattgttcttttttatcttacatcctcttgggtcataacttttgtttattcatcttgttccttttctttcatcatagttttccaaaaatgtcctgttctttcatgttcacraatgttggattcaagttttcaatatatagagtttacatgagcttcttgtatgcacgcttgttttcctaagaaggttcccccacttgtggagggctaaccacaacttctctggatgtgagtgggccatgctggcaacaagcttaacttcaggttgtatttgctgctaagcagacaagcaggcagccagtctggtctctctctcttcccacaaatacaaatgccagtatgaggaaaacctgttctggggcatactaaaattcttaaaccagctgaagcaggcagttgtttccctgggatcag

SEQ ID NO: 120491 - DNA, 601 bp, Human
ttatatgcccttatatccagcaaccttgctaaattcatttttctcataaattgtctgtagattcttttgttttttcttggtatacaatcacatcatctgcaaatagtgccattttatttcttcatttacaattcttttattaaggctttccattttgtttcttggcttactgcactagcaagaatttccactacaatactgaatagaggtggtgattaactagggattctccttgtttcttatgccaagttgaaagctttttattcactactaaatgtaatgtttgctgtcagatttgtgggtgtgtgtgtgtgtgtgtgtgtgtgttttagccagagtctcactctgtcacccaggctgcagtacagtggtgtgatctctgctcactgcagcctctgcctccaggttcaggcaattctcctgcctcagcctcctgagtagctgggactacaggtgcatcctgccacgcccagctaatgttttgtattttttctagagatggtgttttgccatgttgcccaggctagtctcgaattcttgggcgcaagagaatcgcctgggttggcctcccaaagtgctgggatgccaggcgtgagccacc

SEQ ID NO: 120492 - DNA, 601 bp, Human
cccaactgcccaccaatgaatggataaacagataaaatgtggtatatacatataatgaaatacattcatccttaaaaaggaataaaattctgatacatactacactacagatgaactgtgaagacataagtgacataagccagacataaaaagataaatattgggttgggtgtggtggctcacacctgtaatcccagcactttgggaggccgaggtaggcggatcatgaggtcaagagatcaagaccatcctggccaacgtggtgaaaccccgtttactaaaaatacaaaaattagctggygtggtggcgcgtgcctgtagtctcagctacttgggaggctgaggcagaagaactgcttgaacccaggaggcagaggttttagtgagccgagatcacgccaccgtacacgcctggcgacagagcgaaactccgtctcaaaaaaaaaataaaaagatattgtatgattccacttatatgaaatcaaattatagtcaaaatcatagaaagtagaacagagggattgtgggggagtggtaaatgtagtgttgttgcttcatggggacagagtttcaatatgggatgatgaaaaagttctcaaga

SEQ ID NO: 120493 - DNA, 601 bp, Human
tgatacagccactgtggaaaacaatatggcaatttctcaaaaaaagtaaacatagaattaccatatgatccagtaatttcacttttgggtatacacccagatgaatctgaaagcaggaacaacagatatttgtacacccatgctcatagcaccattattcacaataggtaaaatgtggaagcaacccaactgcccaccaatgaatggataaacagataaaatgtggtatatacatataatgaaatacattcatccttaaaaaggaataaaattctgatacatactacactacagatgaacygtgaagacataagtgacataagccagacataaaaagataaatattgggttgggtgtggtggctcacacctgtaatcccagcactttgggaggccgaggtaggcggatcatgaggtcaagagatcaagaccatcctggccaacgtggtgaaaccccgtttactaaaaatacaaaaattagctggtgtggtggcgcgtgcctgtagtctcagctacttgggaggctgaggcagaagaactgcttgaacccaggaggcagaggttttagtgagccgagatcacgccaccgtacacgcctggcg

SEQ ID NO: 120494 - DNA, 601 bp, Human
ttgaagaaaacttggttaaatatcaacattagtaaactatcagatacatattttgagcagtttactcgatttaactctgatccacagtccttcatctgaaaaatgcagaatacacatctcacaagttgtgaggatgaaatgcatataacatatggtacactacaagtgatcttatccccttcatgagctgctagaattttcataagcaatataaaaccaaagggcactattcaacaatggctggatcaagaaattaagcttattatttggaaggttaatagaatatcatgccaaaactcarttaacatcaacattaaaattcaacaaaggaggttaaaagagtcaacacctgccatacacagatgagagatttggtcctgcaaccaatccagtaagccactttgaaagttaagcaaaaaatgtctctagttaaagaacactaaaaggcaaaaggctatataaagaattacaacaaaaaacgaaacaactcaattcaaaaatgggcaaagggccaggtgcagtggctcgtgcctgtaatcccagcactttgggaggccaaggcaagtggatcacttgaggtcaggagttagagaccagcctg

SEQ ID NO: 120495 - DNA, 601 bp, Human
cctgcttcagcctcccgagtagctggcattacaggcgcctacccccatgactggctaatttttgtagttttagtagagatggggtttcaccatgttggtcaggctggtctcgaactcctgacctcaagtgatccatccgccttggcctcccaaagtgctgggattacagatgtgaaccactgctcctggccaatattgtttgtgttttaagtcaagtgttactacacgagtaaaacagtttgagaacattaaaaagtttataaagtaaaaaatttatagtaagctaaggttaacttattaktgaagaagaaaaaaatctttttaaaataaattactgtagcctaagtatacagtgattataaagtctaaagtagtgtgcagtaaattcctaggccttcacattcactcaccactcactgactcacccagagcaacttccagtcctgcaagctccattcatgaaaagtgcactataaaggtgtatcattaaaaaaaatcttttacaaggtatttttactctacttttttctatgtttaggtatgtttaaatacacaaatacttatcactgtgttacaatgacctatagtattcaaaccagta

SEQ ID NO: 120496 - DNA, 601 bp, Human
aggctggagtgcagtggtgagatctcagctcactgcaacctccaccttctgggttccagtgattctccagcctcagcctcccgagtagttgggattacaggcgcccaccaccacacccagctaatttttgtatttttagtacagacagggtttcatcatgttggccaggctggtctccaactcctgacagtgtgatccgtccacctcggcctcccaaagtgctgggattataggcgtgagccactgcacccggcctatagtagtagtattattctttttaacaaatatactaatatatctmatctgagtcccatggtagaagagaaaaatggaagacagaaaaaaacatatgtttttcttcataaccaatagatactgtctacaggtggtaactcaaggaacttaagttataaaggtaaccaactgaagaactgagactacaagcattctaaattatcagaaaaataacaaagcagtgaataaagagaaaaaaactcaacctttgtttatatcctgggaaggtggtggtgatagggtattagtaaaaatgtattttagatattgaaaagtgctaagaagaaatgcttcattgtggtgacag

SEQ ID NO: 120497 - DNA, 601 bp, Human
gtatacatgaaaaattggaaatattttatattagaattacatttttaaattaaaatgcctgtgatgtaaaataatgcaaacagctattcataaacagattttctcacttacctccagattctgacattcctgagcagaattggtaggcaggccaatccacttgatttcttttttttcctttgaaattatgttcattgccattagcacatttaaagcatcataaactcttcgcctaatgttcttctgatcataagcctgctaaaaaatattttcactgagtgataaatcttaagggttaagctacagtcacatgatatgaatatatcaaattaatattacaacttcaaagtgctggaaggattctatttttttatttagccaactgacaaaaacatccaaaagaattctatattccgagaaaatatccttcaaaattaaagatgaaataaaaatactttcaaacaatataaaacaaaataatcttaaaaataaagatcatgttacctgcagatctacactgaaatatactaaagggatttcttcaggtagaagaaatatcatctaagatgggagcttaggtatgtaggatagaatgaagacc

SEQ ID NO: 120498 - DNA, 601 bp, Human
tccaattctaaaattctacagtctgttaaaaaatgacatggtatacatgaaaaattggaaatattttatattagaattacatttttaaattaaaatgcctgtgatgtaaaataatgcaaacagctattcataaacagattttctcacttacctccagattctgacattcctgagcagaattggtaggcaggccaatccacttgatttcttttttttcctttgaaattatgttcattgccattagcacatttaaagcatcataaactcttcgcctaatgttcttctgatcataagcctgctaaaaaatattttcactgagtgataaatcttaagggttaagatacagtcacatgatatgaatatatcaaattaatattacaacttcaaagtgctggaaggattctatttttttatttagccaactgacaaaaacatccaaaagaattctatattccgagaaaatatccttcaaaattaaagatgaaataaaaatactttcaaacaatataaaacaaaataatcttaaaaataaagatcatgttacctgcagatctacactgaaatatactaaagggatttcttcaggtagaagaaatatcat

SEQ ID NO: 120499 - DNA, 601 bp, Human
attctcctgcctcagctttccaagtagctgggattacaggcgtctgccactggctaatttttgtatttttagtagagacggggttttaccattttgacacccacctcggcctcccaaagtgctgggattacaggcgtgagccaccgcccctggcccagaagccatatttaacctcagtttactccatttatggccatgatagtaaaattatgtcaagtcaatttagaaacagtatgtcagggaacatgctcatttaggaagagttttctataatgcttaaagttaacagaacttaaaatgyttctgcatacatcattccaaaattctatccattctggtaaagacacaaatgaaacactattcattctgttgctactatttcaaagtaaaagtctgacttccacagctatattcagaatattgtgtaaccaataaaggaaataaacagccggcttgatcctttttttttttttttttggatacatacagcaagcatctcatcaaataagataccatttcaccaaaagtttattagtagagtgctcagaattaacttaggatgaaataaaaatcttctctaagaaacagtaaaatcaaattg

SEQ ID NO: 120500 - DNA, 601 bp, Human
gatcacaaggtcaggagttcgagaccagcctggccaagagaccagcctggccaataaggtgaaacctcgtctctactaaaaaaaaaaaaaaaaaaaaaaaaattagccaggcgtgttggcaggcgcctgtaatcccagctactcgggaggctgaggcaggagaattgctcgaacccgggaggcggaggttgcagtgagccgaagattgcgccactgaactccagcctgggtgacagagcaagtctccaactcaacaaaaaaaaaaagaaaatttataggagcccattggtttggactgagytcctgcactaagctcaacagaccaaacaaaaatggagtcactcatgctgaaatgccaccaggccaaaactgagttgtttatctgacctaggaaatcaggagagaaagagaatagcaaactacccaaacaggccagttgcagctggcataagagagtcttctctattttacccttacaaggaaagtgacattgatatgtccagtctgctttttgttctgtttctgcctctatccgcctttgctgcttctctatctttaaaacactgaagaatgttcaacctcttctgctcagcttatagga

SEQ ID NO: 120501 - DNA, 601 bp, Human
aagccaatgacatttattaagaaaagttatggccaggcgcggtggctcagcctgtaatcccagcactttgggaggccgaggtgggcggatcacaaggtcaggagttcgagaccagcctggccaagagaccagcctggccaataaggtgaaacctcgtctctactaaaaaaaaaaaaaaaaaaaaaaaaattagccaggcgtgttggcaggcgcctgtaatcccagctactcgggaggctgaggcaggagaattgctcgaacccgggaggcggaggttgcagtgagccgaagattgcgccaytgaactccagcctgggtgacagagcaagtctccaactcaacaaaaaaaaaaagaaaatttataggagcccattggtttggactgagctcctgcactaagctcaacagaccaaacaaaaatggagtcactcatgctgaaatgccaccaggccaaaactgagttgtttatctgacctaggaaatcaggagagaaagagaatagcaaactacccaaacaggccagttgcagctggcataagagagtcttctctattttacccttacaaggaaagtgacattgatatgtccagtctgctttttg

SEQ ID NO: 120502 - DNA, 601 bp, Human
actcagagaaaacagacattagggtctgaacttccttgcagttgagttcctcactgtctccttgggcaaaagccaatgacatttattaagaaaagttatggccaggcgcggtggctcagcctgtaatcccagcactttgggaggccgaggtgggcggatcacaaggtcaggagttcgagaccagcctggccaagagaccagcctggccaataaggtgaaacctcgtctctactaaaaaaaaaaaaaaaaaaaaaaaaattagccaggcgtgttggcaggcgcctgtaatcccagctactcrggaggctgaggcaggagaattgctcgaacccgggaggcggaggttgcagtgagccgaagattgcgccactgaactccagcctgggtgacagagcaagtctccaactcaacaaaaaaaaaaagaaaatttataggagcccattggtttggactgagctcctgcactaagctcaacagaccaaacaaaaatggagtcactcatgctgaaatgccaccaggccaaaactgagttgtttatctgacctaggaaatcaggagagaaagagaatagcaaactacccaaacaggccagttgcagctg

SEQ ID NO: 120503 - DNA, 601 bp, Human
aaactcattaacatctattccagaggctgaacagctttaagtgtgttcattcattttcctatgcgtttattatggaaaaggtttaagggctggaaagggcaattatagagataaaagtaggatattgggattatctacaggtttgctttactcactccattcttctacattaccaaaaataaaagagaggtggtagcaaggaggtaatagttacctgtgtcatgtgacatgagtgagttgtgacatgagcttataaaaaaaaatcaagtgagcttagccacagcaaatggattacttattaaaaaaaaaaaaaaaaaaaaagacagagtcttgctctgttgcccaggctggagtgcagtggtgcaatctcggctcactgcaacctccgcctcccgggttcaagtgaatctcttgcctcagcctcctgagtacctgagatttcaggtgtgcaccaccatgcctggctaatttttttatttttagtagagacggggtttcaccatgtttgtcaggctggtctcaaactcctgacctcgtgatctgcccacctcggcctccccaagtgctgggatgacaggagtaagccactgtgcctggctgc

SEQ ID NO: 120504 - DNA, 601 bp, Human
tttgaaaagcacaaaaaataatgaacaccaatttattgtagacctaagtgtgtccaaaaatcactatcaataactagcactatcaatatcattaccaaacattattgaggttacatttcattattttctgttgctaaaaaacgaattcattgcttaattcctttaataatgaggaaaaattatgattaaactgtggaactgagaaaaagaattacatgcttaaatactcctgcatagcttctcttcccttttactagaatacacatctcaagagctgttcctacactttgcctaacttggtgtctgtccctagtgccacaagaggaccctggtatatgggggaatataagcagtgataactaatggcccttatgtatttgtgattcactatttaatgctgtgtacatttaatagtatcaatggtttttcaagtgaagagagcagtaaaaacataatgtttttattattattatttattattatttttttgagacggagtctcactctgttgcccaggctggagtacagtggcacgatctcagctcactgcaacctccgcctcccaggttcaaatgattttcctgcttcagcctcccgagta

SEQ ID NO: 120505 - DNA, 601 bp, Human
agcgatttgctgtaatgatcaataaaaacaatatggtcaattgtgcataagtgagttggaatttaaaagaattaagataatacctttaaatatagtttaaaattagagtttaaagagacatcccgcctgcactaatgaattaatttaaaaaattaaacatttaagaaagaatgatccaactcaataaatacatttttccatcatccatagaaacaggacctcacaatctgggaaagaaccagtaggcacctggaactcttcagcaaatgacacagcaagggtgataccatttatctaacayagactcctgacagtttggggtcaaatatgcccccaaactttaggatgtgtagcccagggatatgcaaacattttaaaggcacaaaattgtttcttcaaataaaatctcgagggaggctgggcacagtggctcacgcctgtaatcccaacactttgggaggccaaagcaggttgattgcttgagtccaggagtttaaggccaacctgggcaacatggcaaaaccctatctctacaaaaaatacaaaaactagctgggcatggtggtatgtgcctatagtcccagctacccaggaggctgag

SEQ ID NO: 120506 - DNA, 601 bp, Human
gtatgaaaccactgattaaacaacaaagtgaaaatatgagctttgtaacattttctagggatgggggtcgacaagttgtgtcttcagagctcccacgttcttccttcctcagcagggacaggcttctcagcacgctgctgcctcagggagcccaaagggacaccaggaatgctcagcctgtgttagctcacgactatttccctgcctctaacttctctagttccccacagttcaacccagggtgggtagcctggtgtctgtttgagctcaacctccccaaaccaggaagcccacaagctgyaccagtcactgtcaaacagctagctgagcatacagggaattcccctcttggaactgacagggaaaatgatccctagggattagggcctccactgggctgtgtcaaacatatttcatagttcctgcaactctgaccagggatcgttttgaaattcgggttttgttgttgttgttgtcgttgttgttgttgttgcaaggaacaaagactcaccaaactaaagggtgattcttgcaagaatgcacatggagtaatatgagtagccgcgttctcatggaatttaataagaattataaaacaaca

SEQ ID NO: 120507 - DNA, 601 bp, Human
caccaaagactaaaacccgctacaatgtggaaaagaaataattagattaaagcttttcaaccaagctccaatggagagagggcaagggattgtgggtgtgcatgtacttaagagacacagacatacagaaagacacagaccgggcttcagaaaaacaacaacaacaacagaaaaaaggcttttgtccatgtttagatttaccacaaaaacaaatctttttttttgttttgttaagtaaaaaacttattcattatgtttggtgaggttgtagggcaacaggcactcacatacattattggtrgccacataaactggcaaagtctccatgaaggaccactttgcaacgtccattaatattacaaatgcatttaccattgtcctactattccgcatctaggaatttatcctgtacctctatttgcatatgtacaaaatggttcatgtttgaggatattcactgtagctttgtttgtatttgcaaagcctgaaaacaaattaaaaatttattaggggattaaataacgtctggtgtatcattaaaatggaatatcatacagttgttaaaaagaacaaggaaattgtgtacgaaattgctatggaa

SEQ ID NO: 120508 - DNA, 601 bp, Human
tttgagatctcagacaaagaagctctgtaaatactgagcattagcaaccccagtatcattcccctcagtattatcaaggctttggaaaaattaaccaagaaatgggccctggcatattgagagcagcaatcgtttctggaaagctttaaagaccctctacattgggaaatgtagggcttagtgaaaacacttgcccaagaactacttttcttcgtttgcaaattcaaaccaccaaagactaaaacccgctacaatgtggaaaagaaataattagattaaagcttttcaaccaagctccaakggagagagggcaagggattgtgggtgtgcatgtacttaagagacacagacatacagaaagacacagaccgggcttcagaaaaacaacaacaacaacagaaaaaaggcttttgtccatgtttagatttaccacaaaaacaaatctttttttttgttttgttaagtaaaaaacttattcattatgtttggtgaggttgtagggcaacaggcactcacatacattattggtggccacataaactggcaaagtctccatgaaggaccactttgcaacgtccattaatattacaaatgcatttac

SEQ ID NO: 120509 - DNA, 601 bp, Human
ctcccaaagtgctgggattacaggcatgagccactatgcccggccatgtcataatctttgattgcaaggttgcagctacccagtgagaccctggaaaccctgaggaatgccgtgtcttccctgtgtcttgcctcacttattcactcccttctttttttccctgaaaccttgaaatttacagtgtaaaagagccaggatagcagtgaagcccaccacaggtgtgctctgcaaagtccctgaaagaggagggcccaaaagatgttgcttgcctctctgcagtgtagggacccccaggaatctrgagaggggtcagtctaaaatatttaaaattctttagtaatgcccaggagggggcagtcagcttagcaaggatttgggatctatcagcaactacaattctattgcacttgcttatgatacatttttaaaagcagaaagcaaaaattaaaaataataacagcagcagctaatatttacccagggctgatataccctaggcacttgtctaactacttaacatggacatctcattgattcccccatgaaagcaccatgaggtaggtactgctaatgttcccatttaacagacaagggaactaag

SEQ ID NO: 120510 - DNA, 601 bp, Human
tggccaatacggtgaaaactcatctctactaaaaatacaaaaattagccgggcgtggtggcaggcacctgtaatcccagctactcaggaggctgaggcaggagaattgcttgaatccgggaggcggaggtcgtggtgagccaaggttgcaccgttgcactccagcctgggcaacaggagtgaaactgtgactcaaaaaaaaggaaagtggaatgttccctccatgtagtacccatagtatgtgtatactccctctataatagtatatataacagtatttatacatggggatgagaatgataagcaagtagagcacaaggttaataattagtgaatctggataaagggtgggtgggagttagttatgctacacttgcaacttttctataagtttgaaattatactaacacaaaatgttaacaaaaatgtataaaatacaaaagatactaaatcagcttctaaaataccaagatgcaggctgggcgtgatggctaacacctgtaatcccagcactttgggaggctgaggtgggcagattgcttgagctcgggaatttgagaccagcctggggaacatgtgaaaccccgtctttactaaaaata

SEQ ID NO: 120511 - DNA, 601 bp, Human
gggggccgggcgcagtaactcacacctgtaatcccagcactttgggagggcgaggcaagcagatcacctgaggtcaggagttcgagaccagcctggccaatacggtgaaaactcatctctactaaaaatacaaaaattagccgggcgtggtggcaggcacctgtaatcccagctactcaggaggctgaggcaggagaattgcttgaatccgggaggcggaggtcgtggtgagccaaggttgcaccgttgcactccagcctgggcaacaggagtgaaactgtgactcaaaaaaaaggaaagyggaatgttccctccatgtagtacccatagtatgtgtatactccctctataatagtatatataacagtatttatacatggggatgagaatgataagcaagtagagcacaaggttaataattagtgaatctggataaagggtgggtgggagttagttatgctacacttgcaacttttctataagtttgaaattatactaacacaaaatgttaacaaaaatgtataaaatacaaaagatactaaatcagcttctaaaataccaagatgcaggctgggcgtgatggctaacacctgtaatccca

SEQ ID NO: 120512 - DNA, 601 bp, Human
attgtgggttggggaacagtattgtatcaatgttacattccctgattatgatcattgtactgtggtcatggaagagaaagactatgttcctaggaaatctacactgaaaaagagtaaagggtgggggccgggcgcagtaactcacacctgtaatcccagcactttgggagggcgaggcaagcagatcacctgaggtcaggagttcgagaccagcctggccaatacggtgaaaactcatctctactaaaaatacaaaaattagccgggcgtggtggcaggcacctgtaatcccagctactcrggaggctgaggcaggagaattgcttgaatccgggaggcggaggtcgtggtgagccaaggttgcaccgttgcactccagcctgggcaacaggagtgaaactgtgactcaaaaaaaaggaaagtggaatgttccctccatgtagtacccatagtatgtgtatactccctctataatagtatatataacagtatttatacatggggatgagaatgataagcaagtagagcacaaggttaataattagtgaatctggataaagggtgggtgggagttagttatgctacacttgcaacttttcta

SEQ ID NO: 120513 - DNA, 601 bp, Human
tcttggggctacaaatatggcaacccatattcacagatgatgtatcatgatgatgccttttacgtcagttcataatcatcagggctgaggaaattttgttttgctttgtttcctaaaatcttttaaaattttattgcataagaatatcataacatataagtcaactgagaaatttagtagtaatcctgtaacactaaacacattagctgcttccctccttcccctcatctcatagcattgaaatctgtctgcatacaagcgggagttctgcctacaagttggtccccacattttctgtatygccactttatcataatgagtcataatgtattatcacacaaggatcatccatcttgaccacttcactgtggctcaggagctgtgaggtccaccaaaccactcaagatttcagggctttatgcttttaagatccagaaccacaggcattgtttgaggcactttctgcagaaggtgtaccgcatctttgcctgcttttgcaggcctcaatggacagacagccgtagttcactaggctgattctctctgttcatttattcaggtttccaagagctccatccaccttctctgacgtcttccccag

SEQ ID NO: 120514 - DNA, 601 bp, Human
gcatttgaacaatttggggacaaactatcttggggctacaaatatggcaacccatattcacagatgatgtatcatgatgatgccttttacgtcagttcataatcatcagggctgaggaaattttgttttgctttgtttcctaaaatcttttaaaattttattgcataagaatatcataacatataagtcaactgagaaatttagtagtaatcctgtaacactaaacacattagctgcttccctccttcccctcatctcatagcattgaaatctgtctgcatacaagcgggagttctgcctrcaagttggtccccacattttctgtattgccactttatcataatgagtcataatgtattatcacacaaggatcatccatcttgaccacttcactgtggctcaggagctgtgaggtccaccaaaccactcaagatttcagggctttatgcttttaagatccagaaccacaggcattgtttgaggcactttctgcagaaggtgtaccgcatctttgcctgcttttgcaggcctcaatggacagacagccgtagttcactaggctgattctctctgttcatttattcaggtttccaagagctcc

SEQ ID NO: 120515 - DNA, 601 bp, Human
ttccctgttcaaatgcaaacttgacaggtattctcacagggaatactggcacctttccctcaacagctgtacaaaaggttaaaacttgttcctggcaaacacagttacactaatgcatcctacatggattgtcccttcttgtgcttcactaagctctaattgcaatcatgttggacatcaactgcttactgtaatgtttcataatgtaaagtgcactccaggattcagtggtgctttcttcgagttaaagcatgatcgtggtaacgaaatgactacaaaaattgacacacattcttcaatrgatcatctttctttggagacaaagacaagttgtgactcctcctattattgaggattgaatttagttttatgcactgtcagcagccacctcagctgcatttgaacaatttggggacaaactatcttggggctacaaatatggcaacccatattcacagatgatgtatcatgatgatgccttttacgtcagttcataatcatcagggctgaggaaattttgttttgctttgtttcctaaaatcttttaaaattttattgcataagaatatcataacatataagtcaactgagaaatttagta

SEQ ID NO: 120516 - DNA, 601 bp, Human
atcccatacacgcacatcttgaagcccgtcctttgtgttcagtattgcaccccaggcacctggcacacagcagtgccccaaaaatgtgtcaaatgttggatgactggattaaaatattaggaggcaggatacctactttatgttatagttgcccctaccaaatttcaactcactataaaatatgtgaacacaacttaaaaaaaaagtatttattctccaggagctttataagaggcaggatacataggtaacatgttctttatactttgatgacaaaaagaaaaatgaatgtattttctcrtttcaggataggagaaagtcatccttcttttgagttttacctcttaaagataatccccttctcactctccaaatgtcactttccaacatttctatgttatgggaataggtgatttctttgtaacttttcctgccttgccatttctccaaatcttgctaatctgctgggtttgaagctcatgcatttgtttttcccatctgccttaacacctccttgctgacacatgcccaaaggtgctcagcataaaaagggagtggtcttcacaaacataaactaggtgttccctgttcaaatgcaaac

SEQ ID NO: 120517 - DNA, 601 bp, Human
ggaatagactactacaggccacagataaggtgttaaacagatgttcttttaatagttatccatatctttcttttcttggccagtaacacttagcttggctggttttcttctcctgtgttgctggaggtggggcagaggtgactggggactctaagaatctgacagtaacaccatcctcagaaacagtgatggagtaatgcttgggtaccagcattcaagactcaatcaactttggccaaggccaagggcaacctctgctacattgctctctgctctgacccctgcctacccacacagcccytacagatacatgtagcaggtggtgacacagatcccatacacgcacatcttgaagcccgtcctttgtgttcagtattgcaccccaggcacctggcacacagcagtgccccaaaaatgtgtcaaatgttggatgactggattaaaatattaggaggcaggatacctactttatgttatagttgcccctaccaaatttcaactcactataaaatatgtgaacacaacttaaaaaaaaagtatttattctccaggagctttataagaggcaggatacataggtaacatgttctttatactttga

SEQ ID NO: 120518 - DNA, 601 bp, Human
ggaagaaagagtaaagaaaaaatacacacacacacgcacatacacacatacagacagagagagagagagagagagagagagaaagagggagagagagagaaacctaaaactgtgagcttcttctcagcctggtcttcattaagaacttcaaacctggcgatgggcagatttgccctgtggtgggaaggaggcctcagttcatccagttcttgataacagttgctaagcccaagtttgggcaggactgttccagaggctgggcctggctatgtcagggtgttgctgtgggtatgggggaaaratagagaggcagctagggataagaggtgctcaagaagtctgctgtactcttggcaagccaaactctggttcttaaaactaagaagtcatagagaagtgaatggggcttgtaaccgagggcaatttttaattatcagttaggaatagactactacaggccacagataaggtgttaaacagatgttcttttaatagttatccatatctttcttttcttggccagtaacacttagcttggctggttttcttctcctgtgttgctggaggtggggcagaggtgactggggactctaagaatctg

SEQ ID NO: 120519 - DNA, 601 bp, Human
gagaaaatacattgaagaagacttgatgtacatgcttttactatgatgggcaagattcatataaaagacaatgcatttgggggaagacttgcacaatatagaattgcttctgaaatcaatcaaacaaaaaagcccacaacaacacaatcgccccaagctttctctcctttctgtcctagcacaacttatcagaggcaggggtgatatgatgatatgtattctttactagtgagtacagtaggacagggagtgtatctgtctggctcagtgttatagtcacagaacccatcacagtgcctgktatacagtaggtgccattttattgctcatatttgttgaatcaatcaatcactcatacaagggagagcacccagccccagtcttcattaagtgcttgtccactaattgaggcaaagaaatcatacctggtccattgaaatttgggggccctatttttaccacagaaacacaggagcaaagggtgaactctgtactgagttttgaaggcagcaaggtctgaggaagcaactgcgcaaaaggcagaacgtgacagtgagaattcctcttggagaacatcctatccatagactcccccggaggg

SEQ ID NO: 120520 - DNA, 601 bp, Human
ggtgaggattgagaaattttgatttgtttgttgttttactggtatctgttgtgaaccaaaagttagaaaatattccttgagtccttgtgaaggctcagaaagaaacaagagccgggaagagcagcagaggggtgtttgggggaagttgtgaagaattccaggggtcatggggtttaagaaattctgatcttggaacagaaacagaccccaaacatgtcagaactgcatttcaggaaaagagcttaggaaagaaagtttctcaggtacaaatgaactgattttccctgagtaatcttgtgcrttgcacaaataagaatgatcatacctgcgttctgtggttgaggtacatccaggttcagctcgactagctgcaaggtttgctgagtcaggggaaaggctgtaggaaaccccctggtcctcaaaaccccccttgttctcagaccagcctcacgtctacctctataagtaacaggttgagttctcagagaaaatacattgaagaagacttgatgtacatgcttttactatgatgggcaagattcatataaaagacaatgcatttgggggaagacttgcacaatatagaattgcttctgaaatc

SEQ ID NO: 120521 - DNA, 601 bp, Human
ctccaggagaagcaaatgcacctctattggactcttataaaactcaatgtgaagagcattataaaatacctcaaattttgtccacatatatacactcacacgcataaaacactttatgtcctgtttaatgtatgcatgcacaaacttaggcacacatatgtatttgtggtttggggatcaaccgagagcaaggtaaattagggaacatgtgaattggcagtgttaagcaatttgataaaagtgttgatcaaatcccataagggtgtgtgtgctcagggtggtgctatgacgcgtcttcagygtgtgtgagactaatgccagcgcatgcgtctgccctctcatctctcaccttgttgtctgttaaaatctcatctcccacacctgccaggcaacctcccagttgcacgagggctgtcattggttggtgaggattgagaaattttgatttgtttgttgttttactggtatctgttgtgaaccaaaagttagaaaatattccttgagtccttgtgaaggctcagaaagaaacaagagccgggaagagcagcagaggggtgtttgggggaagttgtgaagaattccaggggtcatggggtttaag

SEQ ID NO: 120522 - DNA, 601 bp, Human
cctataagcatgattgttatgagcatgtctcatttggggggtgctgaatttagttcctctaaaaagtgccattgctccaggagaagcaaatgcacctctattggactcttataaaactcaatgtgaagagcattataaaatacctcaaattttgtccacatatatacactcacacgcataaaacactttatgtcctgtttaatgtatgcatgcacaaacttaggcacacatatgtatttgtggtttggggatcaaccgagagcaaggtaaattagggaacatgtgaattggcagtgttaarcaatttgataaaagtgttgatcaaatcccataagggtgtgtgtgctcagggtggtgctatgacgcgtcttcagtgtgtgtgagactaatgccagcgcatgcgtctgccctctcatctctcaccttgttgtctgttaaaatctcatctcccacacctgccaggcaacctcccagttgcacgagggctgtcattggttggtgaggattgagaaattttgatttgtttgttgttttactggtatctgttgtgaaccaaaagttagaaaatattccttgagtccttgtgaaggctcagaaagaa

SEQ ID NO: 120523 - DNA, 601 bp, Human
gctgcctgaaaccccttagctgcatggagttctgtggatggaggttgagagggctgcttcgaaaataactctgctttctcactctccattcacccatgtgccccagctcttgacatgtgagcaacctataagcatgattgttatgagcatgtctcatttggggggtgctgaatttagttcctctaaaaagtgccattgctccaggagaagcaaatgcacctctattggactcttataaaactcaatgtgaagagcattataaaatacctcaaattttgtccacatatatacactcacacgcataaaacactttatgtcctgtttaatgtatgcatgcacaaacttaggcacacatatgtatttgtggtttggggatcaaccgagagcaaggtaaattagggaacatgtgaattggcagtgttaagcaatttgataaaagtgttgatcaaatcccataagggtgtgtgtgctcagggtggtgctatgacgcgtcttcagtgtgtgtgagactaatgccagcgcatgcgtctgccctctcatctctcaccttgttgtctgttaaaatctcatctcccacacctgccaggcaacctcccagttg

SEQ ID NO: 120524 - DNA, 601 bp, Human
ctgctgcctgaaaccccttagctgcatggagttctgtggatggaggttgagagggctgcttcgaaaataactctgctttctcactctccattcacccatgtgccccagctcttgacatgtgagcaacctataagcatgattgttatgagcatgtctcatttggggggtgctgaatttagttcctctaaaaagtgccattgctccaggagaagcaaatgcacctctattggactcttataaaactcaatgtgaagagcattataaaatacctcaaattttgtccacatatatacactcacaygcataaaacactttatgtcctgtttaatgtatgcatgcacaaacttaggcacacatatgtatttgtggtttggggatcaaccgagagcaaggtaaattagggaacatgtgaattggcagtgttaagcaatttgataaaagtgttgatcaaatcccataagggtgtgtgtgctcagggtggtgctatgacgcgtcttcagtgtgtgtgagactaatgccagcgcatgcgtctgccctctcatctctcaccttgttgtctgttaaaatctcatctcccacacctgccaggcaacctcccagt

SEQ ID NO: 120525 - DNA, 601 bp, Human
tcagtgggtggaggaagaatgtgagctcacgatagcccaggtccggggaagctgctccctgccagcctagctcataaggaagttgtttatgttttctgtttgccaaaaaacctttgtgcgctgctgaaacctgtttatcctgaactcctaacaatcaacgcatggcaaccagttcttcagatgacaagtccttttgttaatgagcaaggaatgactgacgaggccctgctgcctgaaaccccttagctgcatggagttctgtggatggaggttgagagggctgcttcgaaaataactctgytttctcactctccattcacccatgtgccccagctcttgacatgtgagcaacctataagcatgattgttatgagcatgtctcatttggggggtgctgaatttagttcctctaaaaagtgccattgctccaggagaagcaaatgcacctctattggactcttataaaactcaatgtgaagagcattataaaatacctcaaattttgtccacatatatacactcacacgcataaaacactttatgtcctgtttaatgtatgcatgcacaaacttaggcacacatatgtatttgtggtttgggg

SEQ ID NO: 120526 - DNA, 601 bp, Human
taataggaaagaataacaccccagccggtatctctaaccctcaccttgcaacaagtgtaaaatgagaaggggagggaagattcgccccaaagtctcacgagatggggcctccaaggacttatcaggagcttgctaagcaggtaactctgtaccgggggctccagcagcagccggggaggagaaggctgataatgggatttgcgtttacccagcaaaaccaacagggagcaatcttcagtgggtggaggaagaatgtgagctcacgatagcccaggtccggggaagctgctccctgccagcstagctcataaggaagttgtttatgttttctgtttgccaaaaaacctttgtgcgctgctgaaacctgtttatcctgaactcctaacaatcaacgcatggcaaccagttcttcagatgacaagtccttttgttaatgagcaaggaatgactgacgaggccctgctgcctgaaaccccttagctgcatggagttctgtggatggaggttgagagggctgcttcgaaaataactctgctttctcactctccattcacccatgtgccccagctcttgacatgtgagcaacctataagcatgattg

SEQ ID NO: 120527 - DNA, 601 bp, Human
cttgatttcctcacctgtgagggtaatagtacctttccacggggttgttctacgattcaaatacaacaacttgctgtaacatgcccaccagattgccaggcacgtctggcattcattaaatgaatgtctctttgtgaactcttttgaaaatcctaaaaattactaatatataagagaaaataataatcacaaaatctcaatttgatatctgtgtgtgtgtgtgtgtgtgtgtgtgtgtgtgtgtgtgtgtgttaggattacagccacaaagtcacctgaaaaaaaaaaaaggtgtcaaagrgaaagactttcttcttactatttggtaaaagggcaccctcaaaatctcaggtagacagttcatgggaaggccttatgggacaataaatttctgctgcaacctcagtagcctttctttcagacaaacaactgatatctcatatggggaaattatgtgaaaaaaaaaaaagaatacaacattgagtctatgccataattggaaaaacatgaaaatgacatacatatatgataaaaaatgaaaaaggaaaactggaaattttttggtaggttagtaaaaaaatggtcattttttttcctttgt

SEQ ID NO: 120528 - DNA, 601 bp, Human
gcatttcctagagaaggaaactgtatttttttttttacttatctttaaggccactgttcaggaatttttttttttaattctatttaaagtgtaggtgaaggtgattatatctttccaaagtcagtaaaacaaatgtgttgcataagtcatttcaattcaattaagagaaacaggtcagatgctaaaatattagtaaaatcaattatgagtaataggtctcctgtataacatgtatcactacaaccgcctctctcataatatttgaataaatttacatttgtttcgtatctctgtgtgcctrtaatatacaggggcgtcacttgaccataaaaccttctctatttccttctctttgttacattttctctggtgtgccttggaaatgacatgtagactaaccctttagagtgaaggtttttctaaggagagaaagcccggtgacaaattaaaaagagctctggagtcagatccagctttgaatcttgtcctgtcgcttgtcagttgggcagggaacttcatccttgggagccttgatttcctcacctgtgagggtaatagtacctttccacggggttgttctacgattcaaatacaacaactt

SEQ ID NO: 120529 - DNA, 601 bp, Human
tttttttttttctctctctctgttttactctgtccccaggggtaaagtattttctgcaaacatgaaattagtttatattttaagggctttggatttactaattttgactaagttaaaaagggcagagcagtctcctagtactctcctgagtgactcaatctgtgattcttgggaagggtttaatggacatattttattttcgttcagggtgacctcactgatcattgtgcaaaatgccttttcttttttttcctccttaaaacaaaataactgcaattttctaggcatttcctagagaagraaactgtatttttttttttacttatctttaaggccactgttcaggaatttttttttttaattctatttaaagtgtaggtgaaggtgattatatctttccaaagtcagtaaaacaaatgtgttgcataagtcatttcaattcaattaagagaaacaggtcagatgctaaaatattagtaaaatcaattatgagtaataggtctcctgtataacatgtatcactacaaccgcctctctcataatatttgaataaatttacatttgtttcgtatctctgtgtgcctgtaatatacaggggcgt

SEQ ID NO: 120530 - DNA, 601 bp, Human
ccaacttgaaaaataaaaatgaacctcccctctttttggcatgttcctccaagcctcaactaaccccgggcagaaactagtggatgtatgcccagttgaagcctgaggttagagtcataatttttacctcctttagcgaacaattccctggtatgttcctgaattgtcattcttagtatattgctagaccaggcattagcaaacccagcagactggcattctctgcagtttggtagaacaagcctgctgtcatacggaagctgaaatccgagacacctctgtacctagaagaatctctctstctctctctctgttttttttttttttttttctctctctctgttttactctgtccccaggggtaaagtattttctgcaaacatgaaattagtttatattttaagggctttggatttactaattttgactaagttaaaaagggcagagcagtctcctagtactctcctgagtgactcaatctgtgattcttgggaagggtttaatggacatattttattttcgttcagggtgacctcactgatcattgtgcaaaatgccttttcttttttttcctccttaaaacaaaataactgcaattttc

SEQ ID NO: 120531 - DNA, 601 bp, Human
tctttccctgttgggcacagggagaaggaacccagagaaatgtttcctcaagctcattttctaatttttccttggatgctatcactgaagttctgagatcatgtattaagaaacagacacattggaaactaacatacaacagatgtcaacctagggccaggactggccagcaagactgattttttgcaagttctcaaaaataatttttttctttttgcttgccttttttcccctgtgcccttgtccaatgcccagtcatcttataatccattaaagctggtataccaattctgtttccttcccaagacaagacctgccaacttgaaaaataaaaatgaacctcccctctttttggcatgttcctccaagcctcaactaaccccgggcagaaactagtggatgtatgcccagttgaagcctgaggttagagtcataatttttacctcctttagcgaacaattccctggtatgttcctgaattgtcattcttagtatattgctagaccaggcattagcaaacccagcagactggcattctctgcagtttggtagaacaagcctgctgtcatacggaagctgaaatccgagacacctctgtacc

SEQ ID NO: 120532 - DNA, 601 bp, Human
cggctctttccctgttgggcacagggagaaggaacccagagaaatgtttcctcaagctcattttctaatttttccttggatgctatcactgaagttctgagatcatgtattaagaaacagacacattggaaactaacatacaacagatgtcaacctagggccaggactggccagcaagactgattttttgcaagttctcaaaaataatttttttctttttgcttgccttttttcccctgtgcccttgtccaatgcccagtcatcttataatccattaaagctggtataccaattctgtttccttcccaagacaagacctgccaacttgaaaaataaaaatgaacctcccctctttttggcatgttcctccaagcctcaactaaccccgggcagaaactagtggatgtatgcccagttgaagcctgaggttagagtcataatttttacctcctttagcgaacaattccctggtatgttcctgaattgtcattcttagtatattgctagaccaggcattagcaaacccagcagactggcattctctgcagtttggtagaacaagcctgctgtcatacggaagctgaaatccgagacacctctg

SEQ ID NO: 120533 - DNA, 601 bp, Human
aaaggacattttcccctaagtccttttaacttcctggcattccgtttttcaaccccacattaaaggtgctgatgtttcatcctagtcctaccagccaatgggtggcctcaagttagactaggcagggcttctatcggctctttccctgttgggcacagggagaaggaacccagagaaatgtttcctcaagctcattttctaatttttccttggatgctatcactgaagttctgagatcatgtattaagaaacagacacattggaaactaacatacaacagatgtcaacctagggccaggaytggccagcaagactgattttttgcaagttctcaaaaataatttttttctttttgcttgccttttttcccctgtgcccttgtccaatgcccagtcatcttataatccattaaagctggtataccaattctgtttccttcccaagacaagacctgccaacttgaaaaataaaaatgaacctcccctctttttggcatgttcctccaagcctcaactaaccccgggcagaaactagtggatgtatgcccagttgaagcctgaggttagagtcataatttttacctcctttagcgaacaattcc

SEQ ID NO: 120534 - DNA, 601 bp, Human
ctgcaaaacgtccgtgaaaactagttaatttgtaagaggcatggaaactgctgcctctccacctgccaggctagatccacatcgtacagactctacaatggcaggagctgagggtcctgagataaattttctcggctcctgcatagacggaggaaagggaagtgattgctgagaatgtcctagacatggacgcggagctcagatgcttttgggtgttctgtctctttcactccacatattgtcctggatgcagaataatactttttgtattaaagtcaccgtggccacctccaaattgctkttacattttattgttattatcattatgttgttgttaatgagaatgcagctgaaaggctaagtttgacacttaaaaacgaccaaaaatccagcaggcaggaatcatccccactcacagatagggtaagtgaagctcaaagaggcctctggttcagcagatcacaccgctgatggtagagctgggacttgaacgggggtttctgactcccactctagtgctcactacatgttgcaagatgctaagtattgaaaactgatttcctgttcctgaagagtttatattttgagaaacacaggttgg

SEQ ID NO: 120535 - DNA, 601 bp, Human
aaattatgtcaatcttcccgcatacaactaaggctaacaacataatctaaatgttaaactatagtggaaaagaaactacgtaaacaatgcataaggttacttcactcaaaatttatacagatggttttcttacaaaattacgatgatcagatatgattaatgatacgatttaagattattggtctttaatagaggcaaaacatgatgactcactgacaaagcaagctaatagcagggagggagagaaggtaagtttgtatatttgattacaaagcaaaacagataagtaaaaccacagagyaaataatgattatattatatgaaactttcattgtttcctaacttacatttatattaacttttctggagatgacgttttttaaacatataaatcgtcattaggaacctgacaacagttctaaatcaaacctagggtttaaaacatcatttgccgacagacatcctccaagtgttttccgcagaggcacatcacttctgattattcccaggctattttaaatgatcttggacagggctactgaatgacttgtcagcgaacaggaaaacattatgacaccacttctccagatttcttcccaga

SEQ ID NO: 120536 - DNA, 601 bp, Human
aaactagaagaattgcactttgattcgtctttcagatctcagttttttaatcttattaaaatataatttacatgttggaaaactcaccctttttaggatacagttctttgagttgtgactaaggcatttaattgtttaaccacaattaaattaaaagacacagaacagttctattcccctctcccccaatattcctctgtgcccctttatagccaaccctccaccccaaatcctggcaaccagagatgttttgtgtccctacagctttgcctttaaagaatattatttcagtggaatagtrtattatgcagcctgttgactggtttcttctacttagcataaagcatttgagattcatcccgtgttgttgagtacaataatttgctctgttttattgttgagtaatattccattccacagtttgtttattcattcctcaattgaaggacagttgggttgtttccattttatggcaatcaaaaataaagctggtataaatattcatggtacaggctgtggtgtgaacctaaatttacatttatattggtaaatacctaggaatgggactgttagatcatatgggatggatatatacatttaa

SEQ ID NO: 120537 - DNA, 601 bp, Human
tatgatttgcagatttcagcacttgtcaaaaaactagtaagaaactgtttcctgtcaccatgttagatttaggcgtaacaaaacaagagaaaagaaaacatgttttatatgttcagagagatcgctgctcagtttgcagtataacataaattactacatagtggttattttacactaacagtattttatcaactagaactactgtaaaacatatagagtgctctctattttaatggtattttctgatgtcaccgtgtcaaactagaagaattgcactttgattcgtctttcagatctcagytttttaatcttattaaaatataatttacatgttggaaaactcaccctttttaggatacagttctttgagttgtgactaaggcatttaattgtttaaccacaattaaattaaaagacacagaacagttctattcccctctcccccaatattcctctgtgcccctttatagccaaccctccaccccaaatcctggcaaccagagatgttttgtgtccctacagctttgcctttaaagaatattatttcagtggaatagtatattatgcagcctgttgactggtttcttctacttagcataaa

SEQ ID NO: 120538 - DNA, 601 bp, Human
acaaaagttttgtcctcttatgaataatgcatatattggaatcatattatgatttgcagatttcagcacttgtcaaaaaactagtaagaaactgtttcctgtcaccatgttagatttaggcgtaacaaaacaagagaaaagaaaacatgttttatatgttcagagagatcgctgctcagtttgcagtataacataaattactacatagtggttattttacactaacagtattttatcaactagaactactgtaaaacatatagagtgctctctattttaatggtattttctgatgtcaccgtgtcaaactagaagaattgcactttgattcgtctttcagatctcagttttttaatcttattaaaatataatttacatgttggaaaactcaccctttttaggatacagttctttgagttgtgactaaggcatttaattgtttaaccacaattaaattaaaagacacagaacagttctattcccctctcccccaatattcctctgtgcccctttatagccaaccctccaccccaaatcctggcaaccagagatgttttgtgtccctacagctttgcctttaaagaatattatttcagtggaa

SEQ ID NO: 120539 - DNA, 601 bp, Human
agtgacttgtttgtgttagctacagtatacattattgagaaactactgatatgcattattgaatttgttgtaaagccttaagtacgtaatagtcttggaaagcccaactcgcccattatttcaaaggttaggtacatgttatatggtgaaactgactttcatagaccagaatgtaacggtgatttgatttacaacatctttgctccttgaaatataacagaggtaatgtagcaaagccattataaacagggaagaataaaaaagggaaatatcagagttcaagacactcaaagagggcatwtggtaagtctctctgcttccaaggacacgaacagttaactgtctgtttctgacagttgcctatcattaaataatcatattcaagcaagataagtgatattatcatatttgctctgttgtcttgtttgttatattatcccaaggtcagctgccattaaactgggtaatccaaatcaaacaaaagttttgtcctcttatgaataatgcatatattggaatcatattatgatttgcagatttcagcacttgtcaaaaaactagtaagaaactgtttcctgtcaccatgttagatttaggcgta

SEQ ID NO: 120540 - DNA, 601 bp, Human
gtatttcggaataatcaaacaactctaaatgttgttaatggatgttagataggattacaaggaaactaaaaaatacacaaatcaaagctgacgttcctaaaagactccaaaccaaaaacatctgttaaaaaggtaaaaaaataatgatttcatagttcatgatattctacagaaaaagcacaagatatatttactgtttttacttttccaaattgtttcactgctgctcttttcacagtttttgcaacatatataatatagcagtttgttcacctactttaatcacccaacaaatggcttygatagcttaataatcttaagcagagccatttattttcaatgtactttgagtaaactgttatctacgtttattaagtgactgtagttatgcatagtcttgttatttataaaagaacacagtacatacatagccctgggatgttttgacaacacatcttaagtaaaatattagtaaaataattttcaaaatataataaaagtgagaaagagtgacttgtttgtgttagctacagtatacattattgagaaactactgatatgcattattgaatttgttgtaaagccttaagtacgtaatagt

SEQ ID NO: 120541 - DNA, 601 bp, Human
tacatggttgtaattattctgttggaaaacaatgttgccatttgtacatttaagaaacacttgctacataccaaattaactcttgagggaagtttattttgtatttcggaataatcaaacaactctaaatgttgttaatggatgttagataggattacaaggaaactaaaaaatacacaaatcaaagctgacgttcctaaaagactccaaaccaaaaacatctgttaaaaaggtaaaaaaataatgatttcatagttcatgatattctacagaaaaagcacaagatatatttactgttttwacttttccaaattgtttcactgctgctcttttcacagtttttgcaacatatataatatagcagtttgttcacctactttaatcacccaacaaatggctttgatagcttaataatcttaagcagagccatttattttcaatgtactttgagtaaactgttatctacgtttattaagtgactgtagttatgcatagtcttgttatttataaaagaacacagtacatacatagccctgggatgttttgacaacacatcttaagtaaaatattagtaaaataattttcaaaatataataaaagt

SEQ ID NO: 120542 - DNA, 601 bp, Human
aatctagtaggaaaataaacgcaatgcttataatgtaaggcagaatgtgtggcacatactcgaagtgttccagaaataaagtgccatgtaagtcaagaataagagtggttactatgtgcggggttcatctgaaactttaagagaaggaggacttcatgaaggatatttgagctagaccttgaaggccaaatcacatcttggtggatagaagtaaaaatgaagagcctcttagaaggacgatagaacacagttgtaaaagtacaggctgggtgctgtggctcacgcctgtaatcccagcacyttgggaggccaaggtgggcagatcacctgaggtcaggagattgagaccagcctggccaacatggcgaaaccccatctctactaaaaatacaaaaattagccagctgtggtggcaggtgcctgtaatctcagctacttgggaggctgaggcaggagaatcacttgaatccgggaggcggaggctgcagtgagctgagatcgtgtcactgcactccagcctgggcgacagagcaagactctgtcttaaaaaagtaaagaaaataaaagaacacagttgtaaaagtacagagacagaaaatgc

SEQ ID NO: 120543 - DNA, 601 bp, Human
cctgtaatcccagctactactcgcgaggctgaggcataagaattacttgaacccaggaagttgaggttgcagtgagctgagatcacaccactgcactccagcctgggcgacagagcaataatctgtctcaaggaaaaaaaaaaatacaatcaagtagaaatacaataaaatattaaaatgcaataaatatgtaggaataatcgtttggattttattaaataaatgcttatgagtaccgactgagggagaacacagtgctaaggaacatattctttctttttctttttaccaagtgttctgaaaaaaaaaaaaaagtaaagtaatattgcttacatgaagataattaaacagaatgggacttctttaccaggaatgggagtttgttatatattaatttgcagctcaaaggtttctgttgactaatctcagaaaaagaaggcacacaacatacttataaacacatgtaactcatctcagagtctcccaggatggtcacagccccacgtggtgttcctgtgtgctgggttccacactgagtctgccacacagtaagaaagtagagagacacttctaatgccaagttgttcccaaaaacacctag

SEQ ID NO: 120544 - DNA, 601 bp, Human
tatagatatgtccccaatagaaatataatctcaagtacttatctgaaatatttacacatttattcaacaaagacatttccagaataatgtaatactgaccttgccctttggagatgtacttcattcacttcctacaactaatgagcaacagaatttcagatatgaagtcctaaccttccaatgtagctagatgctatttgtaatacatgcctctattaaatgtcttcagcttttaacccaggttatattactgttctttatattaacacaaagctctttgagagtaaaaactataggctgtttttttttttaaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcaggagttcaagaccaacctgggcaacatggtg

SEQ ID NO: 120545 - DNA, 601 bp, Human
tcaaatgaatcagccatacccactgtaatgtttacaattatgaaattaaatcacaccacgttcctatgatgcaactatatctcccaatgaggcaacgcccctcagttacactgacaccatcattcacatttggttattgatttcccttgtgctaacgactaatgccaagctatcctataagcaggtcccaggtacaattttctttcttttgtatcgttaaaggatggaaaaccatcggagactgcatcctcggaagtatgttcttccctactcaatgcaagtgaacccagatatacaactsggatgattcacaatgctactttaaaacagtatcctgctttagaaaacaatgttttcaaaagaaccaaatctattagctctagcgtgccttgtgagacatctgactccaaggtgaataatctgacatcactagtaatcagtatttatttccagatcatttcaaatgaaatcagtcattgggaacaacatgtaacatgacatctgctcctgcagttataagtagaatcattcattctatagatatgtccccaatagaaatataatctcaagtacttatctgaaatatttacacatttattca

SEQ ID NO: 120546 - DNA, 601 bp, Human
cttaagagcgcggatcacgggaggtttcctctcttttacttatatgaattacatattctaaaaatgattaaatcccattcccctcaagccacaggggaaaagagaaaatttgctgtgggcacattatatagaaagatttcatctcaagcagctcatcttaacgtccagtacgtttcggcctgttaataattaataaaagagatgccacccaatctctagtgaagaaaggcaaagctcggtgatccgaaagtaaacccagcgcagataccgaactggtgtccttcattccagattgcaacamaaccccaaactagcaaacgtttaacaggcgcttggcacccgcaccggtggctaggacccgcaggacagtctgggtctgcacaattgctgcgcattagggaagccgcgtccgccgcaaacagatggggctctaaatccccaagcctggcggccgggcctgcgaagcagctcgggcagattatccacggcgaggaacctgcgggcgcacaagcgggcggcgggcggcgggcggcgtgctgcgggctgagtttctccggagctgtttgcaaccgtcccaagagcgagtctcggtttctccggc

SEQ ID NO: 120547 - DNA, 601 bp, Human
atctcaagtaacgtgattgaaatatataaaatcaagaggctgcccatgaaaatggtgcttttaaaatactctctacttcatggagggtccaggcttctccctcctcccatggacaaatggattcagaaatcctctttgtctttaaaagaactgatcccttcttgccagataagcattctgctcagtagtggcaaccatttgggttttctcttttcaagatccagccatcaccttctcccaatccttcccatcacaagtaacaaaaatggtacaaaaatcccagtgaagggataccaggcartgggtccttacagtgagatcagagatcgaattctaatttcatttcgtagaaagaaaggccaagttcttcaaaactacagaatcgtatttattacagttggacatactaccaacacatacagtattttcaaagtggtgaggagtcttgcatttgcacatgaatcaggccggacgaagaatctacgggccagaaattccctttaagcctccctgtgctcttataactccatttgcacaaacacaggctgagcactcatatgaagcaaaggggtatatcatctactgaaactgatgaacgtct

SEQ ID NO: 120548 - DNA, 601 bp, Human
tctgcatttatctagttcattgatatgtttacttaagtattacctacctctcccaccagaatgtacactcacagagaccagagactgacatgatcactgctgtcccctcggccgccagcatcacatctgccacaataatgagatagatactacaccagcattttcaaaagaaaaagggggctggtgtcgcagtgtggaagcaggcaggtagtccttctccacaccagccagaggaagtctactttcatctatcccaccagactagaatctaagctgcacgaaggcagcatttggtctcccytgtttggatgtcacctccagagcctggacactggcagatacacaccagatgctcagtgcctgagaaaggccatgtgctaaacaggaagcactgatcagcttccagggcactgaaacctttactttgtcgctgaataaagcaaccttgaaaagacatcactgtttccactgagttggccttgacttctgcagtaagactcttagcctgctcctgctaagtggtcacagtattggcaagacccagcccaggcacacagtgaaggctaaaatacattgtgtctatgtcacatgcagaggctgg

SEQ ID NO: 120549 - DNA, 601 bp, Human
aatatttcccctaagcagccactgaaattgcatagaaacttccaggccacttcaaaagggattctgaacgtaacagcagcagggggcttagaaagactgccaaaaccctgagacatcttaactcatcttaaacaactttgtttctctgcaatagtggaaacaaaatgcttctgttttacgagattttgcttgtggtagaaacattgcttttgaaatggatttctatcaaaccaattgttttgttaaacaatatcattttcaaaagttgcttgatgttacggatgcaacttaagaggaggakgatttttcataatcttgtgtctagggcaaacgtggctgtgaatgcaatggaggtacaatttcttagatatatacaaaataggcggtatgcaaatctttaaagatctctgttgaaaaagatatggctctaatttcatttaccagctcccatcagattttcttttcaaactcctttatcgcttctgaaactgctgaatattatcaaaccccactgggaaattccacacaaggaaataaacttaaggtgcttacatcacaccatgctggtttataatgaactgctgtctttttgaataaatgt

SEQ ID NO: 120550 - DNA, 601 bp, Human
ttctagactttattgttactagcatgcctacaaagagagctgtcagtcatttcttacatctgaacaaccatgtttctttacagcgcctcttttacaagcatcaatccttaaatacatgttttcacattcctgctgattaccacactatctttgttgggggagggctgtgctcaaatataactacagcacccacattttctgtaaacaccctgaggcatcttcagatggctggtaaccaaccttcttcaacaagagaagccccagtgcaaaacatatttctagcaaacgaaaacattctgaraacactcgatccatcttaacagtcgaaatgagcagtttagccaatatttcccctaagcagccactgaaattgcatagaaacttccaggccacttcaaaagggattctgaacgtaacagcagcagggggcttagaaagactgccaaaaccctgagacatcttaactcatcttaaacaactttgtttctctgcaatagtggaaacaaaatgcttctgttttacgagattttgcttgtggtagaaacattgcttttgaaatggatttctatcaaaccaattgttttgttaaacaatatcattt

SEQ ID NO: 120551 - DNA, 601 bp, Human
tctaaaaactgcaaagaggcctggtgtggtggctcacgcctgtaatcccagtactttgggagtctgagacaggcggatcacctgaggtcaggagttcgagaccagcctggccaacatggtaaaaccctgtctctactaaaaatacaaaaattagccgggtgtggtggtgcgtgtctgtaatgtcagctactcgggaggctgaggcaggagaatcacttgaacctgggaggtggaggttgcagcaagccgagatcgcgccactgtactccagcctgggtgacagagtgagactctgtttccaaaaaaaaaaaaaaaaaagctgcaaacagcttttgtttttgtaggttatacatcagtcattgccatattagaagttaaaactgggaacatttacacaatttacttataattcaacttaaaataatagtaataaacacattgcatattaacatataaaaataagtatattttataagacaaaaagttagcatgaagaataccattattttacatttttgtgaatctttttatatctggctattaaaagaagacaagtagattctcatagctgcttctgcattcaatctgttgtgttatgctc

SEQ ID NO: 120552 - DNA, 601 bp, Human
tctctgtatacttttatgcttctaaaaactgcaaagaggcctggtgtggtggctcacgcctgtaatcccagtactttgggagtctgagacaggcggatcacctgaggtcaggagttcgagaccagcctggccaacatggtaaaaccctgtctctactaaaaatacaaaaattagccgggtgtggtggtgcgtgtctgtaatgtcagctactcgggaggctgaggcaggagaatcacttgaacctgggaggtggaggttgcagcaagccgagatcgcgccactgtactccagcctgggtgayagagtgagactctgtttccaaaaaaaaaaaaaaaaaagctgcaaacagcttttgtttttgtaggttatacatcagtcattgccatattagaagttaaaactgggaacatttacacaatttacttataattcaacttaaaataatagtaataaacacattgcatattaacatataaaaataagtatattttataagacaaaaagttagcatgaagaataccattattttacatttttgtgaatctttttatatctggctattaaaagaagacaagtagattctcatagctgcttctgcatt

SEQ ID NO: 120553 - DNA, 601 bp, Human
agaaggtctgagggggagtgaatggtgtatgtgttaaggtgcccatcacttgcatggtcgcaggcctgcaagggctttccatctctacacacagtgataaaattctccaaggtgcctacattcatgacaaaagtttcacatctttcaggagctgggatagctctggaagtggtactaattgtataaaagctttttcctccacaccagcccaaaacaaaaagaaaaacagccatcatttactagtactatttttgctaatataggttgcagatgattaaagataaactgtaaagcctctgtwaaccacaaattttatgcccaggtctttgctatattaataaaaaaaacaaaaacaaaaatctctgaaaatagaatatcaccaaagattctggtcttccactgttatgaaagatgaagacattataaagaaaacgaggattacaaaatttgctcttgaattcatgtttgaaagtgctttctttaatataatttatagctcatctgataaatctgtctgaatttaaagccccttctattgttaccttgtgctttgtcatacaattttcagactatgtctcctacagtaaattgtagagcaaga

SEQ ID NO: 120554 - DNA, 601 bp, Human
atggaagctattcaagccaatatggtttgatttagcagatattaactgcagctaaagtgatgcaaatacgtcagcaaaaggagagcaagataaacatgagaaacccacactcgttaaaaaggaagatgagaacagagactgacatttaaagatcagattaaaaggataggaaaaacgagagaaaagtaagacaatgtgagcgtgagatccttcgacagaagggaggtgaaggggacagatccaacaatccccctgcttatttgactccgagacaagagagaagatagccgatcacgggccrtcagtaacacaaacacagcccgggcacttcataaatatttgttgagtaactaaatgtgcatgaaaaatgccttcctttctggatgtgaagataaactgagattttatatggtaccgtattaacaagtttttgtcttcaggagaatgcttaaaaccatggacagtattatttttgttttgtgtgggtgtatgtgtttgtttttcagacaaggtcttgctctgtcacccaggctggagggtagtggtatgatcacagctcactgcagacttgacttccccagcctcgggttatcctcctacc

SEQ ID NO: 120555 - DNA, 601 bp, Human
gagtttttaaaatatgtttctagccattaataaccagggaatttcacattaaagttcagatttatagattctcttaaaaaaaaaaaaaagacctggtgatgacagaccagttattccaaacggcgacagagccaagggaggtgctccctttccaaagcatatgtgccgtccagcggtccaagtgcctcctctacctgccacactcacaccacctgcctaggggcactaaatgtttgggtttgcaccttttcttttagagagatgccctcttttattatcattattattattattattattwtttttttttttctgagactgagtcttggtctgttacccaggctggcgtgcagtggtgtgatctcagctcatgcaacctccatctcccaggttcaagtgattctcctgcctcagcctcccgaatagctgggactacaggcatgcaccaccacacccaactaatttttgtatttttagtggagacagggttttaccatgttggccaggctggtctggaactcttggccttaagtgatccgcctgccttggcctctcaaagtgcagggattacaggtgtgagccaccaggcccagccgatacc

SEQ ID NO: 120556 - DNA, 601 bp, Human
ttcccagcagcagctgctaatgtttaagtgtaattttacgctaaattttttttaattaaaaaaattaaaagttacaccagcttattgaagcaaatatagaaaatacagagaagtatatggaataaaaaataaaacatattgtcttcactgcagagacaaccaagtctttaaaaatgtacatgtctgtatatacacatctgtactcccacatgagcacacacacgttggcagtgatgttttaaaatgtaagtgtttttatacatgggaagttttaacttgtgttttttttttttttgttttktttttgtttttttttttgtttttgagacggagtctcgctctgtcgcccaggctggagtgcagtggcgcgatctcggctcactgcaagcgccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcct

SEQ ID NO: 120557 - DNA, 601 bp, Human
tgtccattttttcccagcagcagctgctaatgtttaagtgtaattttacgctaaattttttttaattaaaaaaattaaaagttacaccagcttattgaagcaaatatagaaaatacagagaagtatatggaataaaaaataaaacatattgtcttcactgcagagacaaccaagtctttaaaaatgtacatgtctgtatatacacatctgtactcccacatgagcacacacacgttggcagtgatgttttaaaatgtaagtgtttttatacatgggaagttttaacttgtgtttttttttkttttgttttgtttttgtttttttttttgtttttgagacggagtctcgctctgtcgcccaggctggagtgcagtggcgcgatctcggctcactgcaagcgccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagc

SEQ ID NO: 120558 - DNA, 601 bp, Human
actgtattcaaatgactttcttcttctaatgtggctgcctgggcaatttgtccattttttcccagcagcagctgctaatgtttaagtgtaattttacgctaaattttttttaattaaaaaaattaaaagttacaccagcttattgaagcaaatatagaaaatacagagaagtatatggaataaaaaataaaacatattgtcttcactgcagagacaaccaagtctttaaaaatgtacatgtctgtatatacacatctgtactcccacatgagcacacacacgttggcagtgatgttttaaratgtaagtgtttttatacatgggaagttttaacttgtgttttttttttttttgttttgtttttgtttttttttttgtttttgagacggagtctcgctctgtcgcccaggctggagtgcagtggcgcgatctcggctcactgcaagcgccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgt

SEQ ID NO: 120559 - DNA, 601 bp, Human
aaaatgtgagtgtatttctaaaattttttcttttgttttgtttgtgttctcaagaatgctttctaaaacaaactcatgtgacataaacagggccagcttgccctagttacacccttactatttcattaacaaaggaactgggctgccattctgtttttgttatgcttatgctgaataactgtactcagccagctgccatgacttgtctgtaatcccagcactttgggaagccaaggtgagaggatcacttgagctcaggagttcaagaccagcctggacaatatagtgagaccctgcctcaaaaaaaaaaaaattagccgagtgtggtggtgccagtctgtgcctgcctgtagtctcggctactggtcggggagaggggcctgaggtgggagggatcacttgagcctgggtcacggctgcagtaagctgtggcaacagagcaaaaccctgggtgacacagcaagatgtgtctcaataaaaataagtatataactgtattcaaatgactttcttcttctaatgtggctgcctgggcaatttgtccattttttcccagcagcagctgctaatgtttaagtgtaattttacgctaaattttttt

SEQ ID NO: 120560 - DNA, 601 bp, Human
atttagccactgttttttttccccttgactgttttattcttgactgccatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaacatttgactcccttcttaaggagatttatgttgaaaattctcayatagccacaaaacgcagtccattttatattaaaatgtgagtgtatttctaaaattttttcttttgttttgtttgtgttctcaagaatgctttctaaaacaaactcatgtgacataaacagggccagcttgccctagttacacccttactatttcattaacaaaggaactgggctgccattctgtttttgttatgcttatgctgaataactgtactcagccagctgccatgacttgtctgtaatcccagcactttgggaagccaaggtgagaggatcacttgagctcaggagttcaagacc

SEQ ID NO: 120561 - DNA, 601 bp, Human
ataaatttagccactgttttttttccccttgactgttttattcttgactgccatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaacatttgactcccttcttaaggagatttatgttgaaaattmtcacatagccacaaaacgcagtccattttatattaaaatgtgagtgtatttctaaaattttttcttttgttttgtttgtgttctcaagaatgctttctaaaacaaactcatgtgacataaacagggccagcttgccctagttacacccttactatttcattaacaaaggaactgggctgccattctgtttttgttatgcttatgctgaataactgtactcagccagctgccatgacttgtctgtaatcccagcactttgggaagccaaggtgagaggatcacttgagctcaggagttcaa

SEQ ID NO: 120562 - DNA, 601 bp, Human
tccaaaaatatttcaaagccaaatacacataactttataaatttagccactgttttttttccccttgactgttttattcttgactgccatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaacatktgactcccttcttaaggagatttatgttgaaaattctcacatagccacaaaacgcagtccattttatattaaaatgtgagtgtatttctaaaattttttcttttgttttgtttgtgttctcaagaatgctttctaaaacaaactcatgtgacataaacagggccagcttgccctagttacacccttactatttcattaacaaaggaactgggctgccattctgtttttgttatgcttatgctgaataactgtactcagccagctgccatgacttgtctgtaatcccagcactttgggaag

SEQ ID NO: 120563 - DNA, 601 bp, Human
ggtaattgaaagaccctgttcttcaaattaccaagagaaagatgtcgtgcaaggaataggacaatgacctttctgttatttgcattacggcttgataattatcacaagtacattcagtttgagagtttctcgatctcttctcaatgccttcaaatagatatgttacaagacatggcaaattgattctttacctaagcgaggccagtttcatgttccaaaaatatttcaaagccaaatacacataactttataaatttagccactgttttttttccccttgactgttttattcttgactgcmatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaacatttgactcccttcttaaggagatttatgttgaaaattctcacatagccacaaaacgcagtccattttatattaaaatgtgagtgtattt

SEQ ID NO: 120564 - DNA, 601 bp, Human
ctaacttctcagatggtttgtgacagagaaggttgccagaggacagattcatcacaggtgaggtattgctgtagtaggaaggcaaaaaaggtaattgaaagaccctgttcttcaaattaccaagagaaagatgtcgtgcaaggaataggacaatgacctttctgttatttgcattacggcttgataattatcacaagtacattcagtttgagagtttctcgatctcttctcaatgccttcaaatagatatgttacaagacatggcaaattgattctttacctaagcgaggccagtttcatrttccaaaaatatttcaaagccaaatacacataactttataaatttagccactgttttttttccccttgactgttttattcttgactgccatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaaca

SEQ ID NO: 120565 - DNA, 601 bp, Human
cctaacttctcagatggtttgtgacagagaaggttgccagaggacagattcatcacaggtgaggtattgctgtagtaggaaggcaaaaaaggtaattgaaagaccctgttcttcaaattaccaagagaaagatgtcgtgcaaggaataggacaatgacctttctgttatttgcattacggcttgataattatcacaagtacattcagtttgagagtttctcgatctcttctcaatgccttcaaatagatatgttacaagacatggcaaattgattctttacctaagcgaggccagtttcaygttccaaaaatatttcaaagccaaatacacataactttataaatttagccactgttttttttccccttgactgttttattcttgactgccatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaac

SEQ ID NO: 120566 - DNA, 601 bp, Human
tcttccattagttcccacatatatttaccttcccacaatatatggcccctagaagcctcaaaccattttcctttatcttgtcacttctccataagtttattgccctttgttaaaatggtatataagcctccagatctgatgaccttcttgggggtattcacttaatttctgtgaggccccctcacatacatataaaataatcctttttctcccgttaacctgtcttttgtaagtttattttgtggggccccagacactgaatataagcgggtagaggaagaagttgggttttttcctctcyaacactgagtaagtgattttaatccagtcacttctctttctctgtgaagttatttcccattgaagtactgtgatttgctgataattgattttttaaaatgtaagtaaagtgaaacacatatagctatgacagggcctggggtacaggatgggtatttgttatgattatttgaaagaaaaataaaagcacaaggctattatatggaagtgtaacagttaaatattttctgtcctcattcaaaaagattgactcttcctatcaatgaggaatatattcacaatgagataaaattgcaatatt

SEQ ID NO: 120567 - DNA, 601 bp, Human
ttgttttgtttagtgtactctaaagagctacatggaaccttttaaatcattcaatgccaggtccataaagacctctgtgattaacaaatcaaacccctttcttttcagtcaaggcacctgagactgagaggtaaagtgactgtcctaaggttaccaagcttgggcaagaccaaggtgatactgccaccatctgttcattctcctgccaccttttcaactggggtttatcccaacctcctcatttcacagagaaaaacagaaccagtgtgaacagaaacaattcacttgggaagagtgagcsgaggctcttttatcagtgtaggtggttgaacttcggtagccacaggggacctgactttgaggacacaaaacacaggatccttcgtggttcacagtggtggtgttagggagaggcagtgagccttgcatcataggtagaacacgatgcagctgcaggtgcagagagttatcagggagagaagggcccagaagactgggaaaatgatagtggtgtcaaacaggaaaattacactgaaattacaccatgtctttttacattttcctcagtctccgtctgagccacaagtgcactgcagtcatt

SEQ ID NO: 120568 - DNA, 601 bp, Human
aatagctttaccactctgacctcaatatggagtaaaatgacagataacaagcagaagccggtcagtttcacaagtaagtgattctgatgctttggctcatcctggtccctgctcggttcccacatcctcatctggctgacttagttaaaacctgccatttctaaagtttaagaaattaaacatagtttgggagtacaaagagccatctttgctctgatctcattaacaacctcataagagttcatttccctcactaactgtcctcaggaatgaaagttaaaagaccttgaataatttttcmtaccgccccacaatgatactgtactactgtcctctttcctggtctgaaactcctctggaaagagatgcacagcctctagtaaatcatagtttttgttttgtttagtgtactctaaagagctacatggaaccttttaaatcattcaatgccaggtccataaagacctctgtgattaacaaatcaaacccctttcttttcagtcaaggcacctgagactgagaggtaaagtgactgtcctaaggttaccaagcttgggcaagaccaaggtgatactgccaccatctgttcattctcctgcca

SEQ ID NO: 120569 - DNA, 601 bp, Human
tgaaatcaattaagaaataactatagctatatagggaatatgcaacacattaatatatttatggagactatatctaggcacatttattttcagcatttgaaaattactggtgagagtgagtaacgtcccttccctgttgttttgataatctcatgtcttttaagcaaaaggaaatgtatactgcaaaatagctttaccactctgacctcaatatggagtaaaatgacagataacaagcagaagccggtcagtttcacaagtaagtgattctgatgctttggctcatcctggtccctgctcrgttcccacatcctcatctggctgacttagttaaaacctgccatttctaaagtttaagaaattaaacatagtttgggagtacaaagagccatctttgctctgatctcattaacaacctcataagagttcatttccctcactaactgtcctcaggaatgaaagttaaaagaccttgaataatttttcctaccgccccacaatgatactgtactactgtcctctttcctggtctgaaactcctctggaaagagatgcacagcctctagtaaatcatagtttttgttttgtttagtgtactcta

SEQ ID NO: 120570 - DNA, 601 bp, Human
cccaatcaacaaaacaaacaataaaattcatattttactatgtgtattgtgaaacagcctacaataggacaccagtgctttttaaagtcctactttttataaagggtctgattttcttctggccatcaactgaattgtaaggacaacatagctcattttatgaaacgaaagtgatattaaaaaactaagtggctgaagatgtaattgtctatatgtgagctgcttccgaccttgaaaaaagtgtagaagaggggccgggcgcggtggctcacgcctgtaatcccagcactttgaaagaccrtggtaggtggatcatgaggtcaggagttcaagaccagcctggccaagatggtgaaatcccatctctactaaaaatacaaaaattagccaggtgtgatggcacacgcctataatcccagctactcgggaggctgaggcagagaatttcttgaacctgggggatggaggttgcagtgaaccaagatcgtgccattgcactccagcctgggcagcagagtgagactccgtctcaaaaacaaacaaacaaacaaacaaaaaaccaagaggcacatttaagacttgaaatttagatggaaatttt

SEQ ID NO: 120571 - DNA, 601 bp, Human
ctgtgggcgtggagatgctcctatgttgtggtggatgatagccttcgaatgctctttgttgtcttcattgtcatccactctattaatgttctagaagaaagctagtggccaatattttcttccaacaaattcactggctccaggaaccttgacaccaaaatgaggattgagcgtcaaagttcttatgttgtcattgccccaaactacttggagctacttcttatgcagctgctctcagtgccaatgagataagacacagctgtactttatagtccctctcctcctttttttttttttttttaagatagggtctcgctctgtcacccaggctggagtgcagcggcgtgatctcggctcactgcaacctccacctcccccagggttcaaaggattctcctgcctcagcctcccgagtagctgggattacaggcgcccaccaccacgtctgggtaatttttgtatttttagtagagacgggtttctccatgttggccaggctggtcttgatctcctgacctcaggtgatccacccactttggcatcccaaagtgctgggattacaggtgtaagccaccatgactggcctttttttttttttttt

SEQ ID NO: 120572 - DNA, 601 bp, Human
ggcaaagcccacagcagatagtgtcagtaatgcaaatccatttcctattgtaattcacttttcagaacaaaaccttttccatcagcaaagcattttagaacctcaagctacactgttcccacctgcaactgtctaaggtattggaggtcaaggacagtccaaggccaagtcaaggaccatcaggacacagaggagtaacttctgaggcagcccccggtggtaacataaaagcttaatatgcatcagacaagtgccttcgctgtgagatgttggggaaccaagcccagtggggtggctggcrtcagctcagtgttccagaaaagccaaactgttcaccacgacttgccctgattttgccttcactgctattcaaagaggcctgaagcagttactgaaagcaattccaagaaattgagttaaaaaaagaaaattaaagtttagaaaaaaatcatttgaataagtgcgtagacttacaaataaattctgaatggaacagaatatttggggggttcataacctttggtatatttgttttaaaaaccagccgcacctcaaacacacccaccaacaatgagacgaatggctagcacttatgaggaat

SEQ ID NO: 120573 - DNA, 601 bp, Human
ttcatctcgtcagggaaaagggatagaaagtggaagagaattctacctagtaactaatttttcattttcattggtttaggaaaggaaatacaatgaactgttctcttcgagatccagaataaaagttctggcagctagaacaccgtttttatacaccgaacccctcgtgctctccctgcttttttttgttgttgttgttgtgcttaatgttagaaaataacattactactatgaaacgaagagaattttttttcaaaaccatgtcttgccattacagatgagacaaggcaacaccatgctratacgctgttgatgtaaaaataaaagttttttttcccttcaaagtaaacaagttaattgaacgtgctaggacagagttaggttatttttttttcccctctctttgaaggccactaattgtgcccttttgctttaaatcaatagaggcaaagcccacagcagatagtgtcagtaatgcaaatccatttcctattgtaattcacttttcagaacaaaaccttttccatcagcaaagcattttagaacctcaagctacactgttcccacctgcaactgtctaaggtattggaggtcaaggaca

SEQ ID NO: 120574 - DNA, 601 bp, Human
tacataatcttccagagccagtcctgctgtattacactgtgatgtgaagagtgagctgaactctcatttccccaacagggacctctttttatggcaaaacccagcaggtttcatctcgtcagggaaaagggatagaaagtggaagagaattctacctagtaactaatttttcattttcattggtttaggaaaggaaatacaatgaactgttctcttcgagatccagaataaaagttctggcagctagaacaccgtttttatacaccgaacccctcgtgctctccctgcttttttttgttgktgttgttgtgcttaatgttagaaaataacattactactatgaaacgaagagaattttttttcaaaaccatgtcttgccattacagatgagacaaggcaacaccatgctaatacgctgttgatgtaaaaataaaagttttttttcccttcaaagtaaacaagttaattgaacgtgctaggacagagttaggttatttttttttcccctctctttgaaggccactaattgtgcccttttgctttaaatcaatagaggcaaagcccacagcagatagtgtcagtaatgcaaatccatttccta

SEQ ID NO: 120575 - DNA, 601 bp, Human
cactacataatcttccagagccagtcctgctgtattacactgtgatgtgaagagtgagctgaactctcatttccccaacagggacctctttttatggcaaaacccagcaggtttcatctcgtcagggaaaagggatagaaagtggaagagaattctacctagtaactaatttttcattttcattggtttaggaaaggaaatacaatgaactgttctcttcgagatccagaataaaagttctggcagctagaacaccgtttttatacaccgaacccctcgtgctctccctgcttttttttgktgttgttgttgtgcttaatgttagaaaataacattactactatgaaacgaagagaattttttttcaaaaccatgtcttgccattacagatgagacaaggcaacaccatgctaatacgctgttgatgtaaaaataaaagttttttttcccttcaaagtaaacaagttaattgaacgtgctaggacagagttaggttatttttttttcccctctctttgaaggccactaattgtgcccttttgctttaaatcaatagaggcaaagcccacagcagatagtgtcagtaatgcaaatccatttc

SEQ ID NO: 120576 - DNA, 601 bp, Human
aacgctttgtgaccctctttctccagagctcagcctcctcttctgttcttaggcatagtgctgcactacataatcttccagagccagtcctgctgtattacactgtgatgtgaagagtgagctgaactctcatttccccaacagggacctctttttatggcaaaacccagcaggtttcatctcgtcagggaaaagggatagaaagtggaagagaattctacctagtaactaatttttcattttcattggtttaggaaaggaaatacaatgaactgttctcttcgagatccagaataaaagttctggcagctagaacaccgtttttatacaccgaacccctcgtgctctccctgcttttttttgttgttgttgttgtgcttaatgttagaaaataacattactactatgaaacgaagagaattttttttcaaaaccatgtcttgccattacagatgagacaaggcaacaccatgctaatacgctgttgatgtaaaaataaaagttttttttcccttcaaagtaaacaagttaattgaacgtgctaggacagagttaggttatttttttttcccctctctttgaaggccactaattgtgccct

SEQ ID NO: 120577 - DNA, 601 bp, Human
aaagtgcctgtagcatcagtgcccaccacatagtaagtgctccataaatgttagctataatcatcatcactgtcttttttttttctttagacagggtctcactctgtcacccaggctggagcgcagtggtgcgatcacagctcactgcaacctccacttcctggcctgaagcaatcctaccacctcagcctcctgagtagctgggactacaggcacacaccaccacacctggcttttttttatatttttttcagtagagatggggtttcaccatgttgcccaggctggtcttgaactcccrgactcaagtgatctagctgccttggcctcccacagtgctgggatcactgtctatcttttaaggatgatagtatttggcaggggctgcagctggagttgagggaactatcagaagaatgaaggataggtcactgtattccttttgttgtataacgacatggagtttagcagctttatttctaacacagaggcctaatgtgagaaacaacactaaccagggcacgatagaaagaaaccagtgtttctttctagggaaagcccacagtgaggctggcatcttggagaggtggtaagtggagga

SEQ ID NO: 120578 - DNA, 601 bp, Human
cttaacaaccattgattactaattccacctgcacaatttccatgaccccccccccccaaaactgtgcggtcacaaaacccagctgcatgaagtaagatgtgcagaaatgggtcaaaataacaagaatccagattaagtcataaaagcttaccaggcaaaggaacccatcatttctttccatgagctccgatggcattctgaagatctgctactgctcattgaatagatgtcactcaagaaatattccccaactaaataaactggattcatggtaaaagattggaaataacttagaacattmaaccttgaaaatgcatttacatccctctatagcaagcccagaacactaaaaagacaacatatttatagtcacaggaacatggtgtcatgacaccaaaacttccttggtccacagatcattttagtgggtgaggactgttaagagaattagcccacagcctgtatttctgctccacctctgtgctgttttccatttcaaaaaagtgtccttagaattaataagaggatgaagctttggatgagagatgagggaaggatccggtttttattaaaaatcacaggcaaattatttaggcttgcc

SEQ ID NO: 120579 - DNA, 601 bp, Human
accaccaggatcagcaatacaatccttttttttttctttttgtttttcctctcttttgcctttgtaaacaacagaacgtatttgttgttaaggatttatggggttatgtgatatcaagggctaagataaaggtaattggctatttaaccaatggttctcagttggcgtaaggtccctctaagattctagaattaactacattttaaaatataaagtccttgaagattttctaggaccctgggatcagtaacatttaacaaaagtcctctttctctagaatctctcggggtgggttaaatgycatttcatatcagcaggaaagagaacccatttattttgctaagtgattagactatgctcaagggaaattcctaataacgttgtttccaacaatggtgtcccttacataattctggataatactagacaaaaaaagtcatctgactcacagaactgcatacgtattttcttgcgatcaacctcactctagataccaattcctttttttctccttaacaggaacaattacgctacatttaggtgaaatcctccttacagctgagagcactggggtcaactctttgctttcattgctcaaggt

SEQ ID NO: 120580 - DNA, 601 bp, Human
tagtgcacaaactgtttaaggcagttgactctataccttttttggtatctacctggtaaccagtttaaaccttgagtgaaagacctgaacagcaagagaataagcttcctaatacttcatcctactcatccagtgggtcagatactaaataagtaagttctcacccaataaatgataccaccaggatcagcaatacaatccttttttttttctttttgtttttcctctcttttgcctttgtaaacaacagaacgtatttgttgttaaggatttatggggttatgtgatatcaagggctaasataaaggtaattggctatttaaccaatggttctcagttggcgtaaggtccctctaagattctagaattaactacattttaaaatataaagtccttgaagattttctaggaccctgggatcagtaacatttaacaaaagtcctctttctctagaatctctcggggtgggttaaatgtcatttcatatcagcaggaaagagaacccatttattttgctaagtgattagactatgctcaagggaaattcctaataacgttgtttccaacaatggtgtcccttacataattctggataatacta

SEQ ID NO: 120581 - DNA, 601 bp, Human
gtcaatgccttgcaaatttttcaaaaggaggcagtttagttttgtcaatttgagttttcagtccaacaagaaggaggaagacaaaaatccctctgccctttgcctttcatcgtgtaggcttttcagtttcccaccaggtagtgtggtgtcttctcaaaacaatcttcttttaacacaaattatgaatcttggcccatatatatactgcacacattaactcagccagcatttcaaaggatgagttctgtcagacagcactactgtcaacgttcacaagtatattgattaaattagcccacayacatattcatcccagcaaagaggtttattgtgtagtggaatatctggagcaagatgcgcacatataatcatgaattggcttcacaatgaacaatcttgctatgaaaaattctaatttgcccacattttcagccctattgcctaaataatttgctctctcatgcaccctgtgtaattcaagcaggctctccacacctgcagaggcaaatgcagtttcaaggagctgacaacaagtggcagcgggcatcaggaaatcctggaatgcaagggtgctaattaaccaagtggtccttggggctag

SEQ ID NO: 120582 - DNA, 601 bp, Human
ccttccaatataagcatgaggatttaaatcttaataaattgagatttgaataacagaggtaatctgggcttggggggtcttgaattattgggataaacatctctgtttctcatctgcacattatgcatgtgctgtacacattgccccatgaccaaggtcagaaataataaaatagtcatagcagaaataatactgataatatttagagttaaatagcacttttctgtttgtaaggacttttttatgtacaggttctccttctattcttggaatagtcctaaccagtagaaagatcaggtgytatacccactttaaaaatgaagcaactgagtgacaaagagattaagacacattcaaaacaatatggacaagtggaggcaataggactggaactcaggtcttcctgatagctttcccacaattttgccagatgtgttaacattatgtgtgctaacaataagactcaactcagtgacattccaattaaacttactggagatgtctttttataagcttatgacagggacattgtagaagtctggagttagctcttttttaaaaaagattgccacagagattgctcatgagttcaactctgggg

SEQ ID NO: 120583 - DNA, 601 bp, Human
tatgtctttggatcccttacagtgcttacatagtgcttggtcccaagggagtgctcatagtattcttttttattggcagattctacataacacattgcaaatggtcacaacaatcaagactatatccatagatgtcccagaaataatatctgactatacagagcagcattaccaagccaccaagaagtctgcctagtaatgacaatgataacaacagctaacacttagtaagtgcttgtgatgcatctggcattcttccaggtactttccttaaatgcatgtgacaaccctatgaagttaytacaattacagtcctcattttacagatgggggaactgaggcacagagcagtggtataggtgctcaagctggtaaatagcagagctgggatttcaactcgggcagtctggttccagagtcagagcagaagcatggcacctgctgtctctctacagacagcaaaggggttggggagaggatgaactaggaacagccagaaatgacagaaagagctactaaagcttctaccatttttgctgttcatgtgcaatgcttagcaactatgtgccaaaataattatttcagcaattaaacaggtcct

SEQ ID NO: 120584 - DNA, 601 bp, Human
ctgagactaagaaaagtagagatgagaaaagcagagaatcttctatgtagaagcatgtactgtgttgcaattttatttatcttggcaactttctgttgagaatgttcagaagcatgggggtgagaaggaagaaatatctctggatcagtgtgggccaaaagttaattatctggctagagggggaaaaagaggataacttcattttattgaggggtaaacataaagggcatgcatggattaaaatcaagcagatgaaattataaaattaaagttgggtgggggtcagaaataagagtcctcraagaagcatatgaggaaaaaaagttgttctttagaaagagcaggcggcctcattcacgaaagttagctggtccagccctatactcatacatctggcagcaataaatcacagaaattcagatttcctgagctacgtttttgttcagtagtgactggcctccctgtagaattgtatgcgcaagtggtctctgattaaagctgcccacgtgtcatatttggtaagtgtcgatatctgcttttgactgtgctttgccatactcagatccaatacaagtgaagacattcagcaatggttattccc

SEQ ID NO: 120585 - DNA, 601 bp, Human
aacggctacacacttgcttttgacaaccaagatttattcataactctgtgatttattgtgaatgctcgtatgcctgcccaaattattgtattttccagtacaactaaaaatttggaatttgggggactgctgaagtgggtgtatgtctacctttcattttacgtctgagactaagaaaagtagagatgagaaaagcagagaatcttctatgtagaagcatgtactgtgttgcaattttatttatcttggcaactttctgttgagaatgttcagaagcatgggggtgagaaggaagaaatakctctggatcagtgtgggccaaaagttaattatctggctagagggggaaaaagaggataacttcattttattgaggggtaaacataaagggcatgcatggattaaaatcaagcagatgaaattataaaattaaagttgggtgggggtcagaaataagagtcctcaaagaagcatatgaggaaaaaaagttgttctttagaaagagcaggcggcctcattcacgaaagttagctggtccagccctatactcatacatctggcagcaataaatcacagaaattcagatttcctgagctacgtt

SEQ ID NO: 120586 - DNA, 601 bp, Human
aaaagaaaaaaattgtcatttttttttttttgagacggagtcttggtccgtcaccaggctggagtgcagtggcattacctcgggtcactgcaacctctgcctcctgggttcaagtgattctcctgcctcagcctcccgagtagctgggactacaggcgtgcaccaccacaccgagctaatttttgtatttttagtagagacagggtttcaccatgttggctagcatggtctagatctcttgaccccgtgattcgcctgcctcggcctcccaaagtgctcggatttacaggcgtgagccacygtacctggccacaattgtcatttttatagtaaatattttttaaaagctccccgaagactttgacttccttttgttaagaaccagagattgattcgagttttctgatttgccaaaaacaaaaatgaagtttagaatgttaaatgacttgtccaaggtcccatggctgggactcaatctcttgtcctgattttaagtccagtgccctcttacttatatgtatcttcttcattgtgggacaaacaaaacaatgtcacacattctcgatttcctgacacagagtccctacatatccaccttttg

SEQ ID NO: 120587 - DNA, 601 bp, Human
ggcgcactaccaccacctagtggcagcagattaccatgcagctattgcaaatagaaaattagaataaaacaaacaggcctttggtgctgaaagactttgagagattatcaggtacagcagttgacttttaggtgatgcatcagaaacacccacagagcttttaaaagatacaccttagatatatcaaaccagaactatatatcaaaccagaaacttttggcgatgtcgtccaggcatacatagtagtttgaacaatgagaaattcccatttttataagtcaaaaaagaaaaaaattgtcatttttttttttttgagacggagtcttggtccgtcaccaggctggagtgcagtggcattacctcgggtcactgcaacctctgcctcctgggttcaagtgattctcctgcctcagcctcccgagtagctgggactacaggcgtgcaccaccacaccgagctaatttttgtatttttagtagagacagggtttcaccatgttggctagcatggtctagatctcttgaccccgtgattcgcctgcctcggcctcccaaagtgctcggatttacaggcgtgagccaccgtacctggccacaattgt

SEQ ID NO: 120588 - DNA, 601 bp, Human
atttggcaattttgttatttctaaaagataagctaacaaattacttggctgtcataaaagttcactttttatggatgttaaaatacatggagatgttcatttacaaacatggtgagcttgagccagagagccaccatgatacatttcaggtagtatacgtttagtgtgactgtggcgcactaccaccacctagtggcagcagattaccatgcagctattgcaaatagaaaattagaataaaacaaacaggcctttggtgctgaaagactttgagagattatcaggtacagcagttgacttwtaggtgatgcatcagaaacacccacagagcttttaaaagatacaccttagatatatcaaaccagaactatatatcaaaccagaaacttttggcgatgtcgtccaggcatacatagtagtttgaacaatgagaaattcccatttttataagtcaaaaaagaaaaaaattgtcatttttttttttttgagacggagtcttggtccgtcaccaggctggagtgcagtggcattacctcgggtcactgcaacctctgcctcctgggttcaagtgattctcctgcctcagcctcccgagtagctg

SEQ ID NO: 120589 - DNA, 601 bp, Human
taatttggcaattttgttatttctaaaagataagctaacaaattacttggctgtcataaaagttcactttttatggatgttaaaatacatggagatgttcatttacaaacatggtgagcttgagccagagagccaccatgatacatttcaggtagtatacgtttagtgtgactgtggcgcactaccaccacctagtggcagcagattaccatgcagctattgcaaatagaaaattagaataaaacaaacaggcctttggtgctgaaagactttgagagattatcaggtacagcagttgacwtttaggtgatgcatcagaaacacccacagagcttttaaaagatacaccttagatatatcaaaccagaactatatatcaaaccagaaacttttggcgatgtcgtccaggcatacatagtagtttgaacaatgagaaattcccatttttataagtcaaaaaagaaaaaaattgtcatttttttttttttgagacggagtcttggtccgtcaccaggctggagtgcagtggcattacctcgggtcactgcaacctctgcctcctgggttcaagtgattctcctgcctcagcctcccgagtagc

SEQ ID NO: 120590 - DNA, 601 bp, Human
aggattaagggtttggaaaattaaacagataagatactaagagttaaataacacataagaggaagaaggattagaaagaggaagaagaaaagtagaaagtgtggtaggtaccttcctacctcaaggtagaagtagtgtgtttctaagtacagagatagattttgtctgattggggagaaatcctgcaaaaggattaggaagtgagtgagctgagagatgaattccagggattggaggtcatacagagagcaggggaagcacaaaactagggcatggagttttgggtggaactgaggaggcrtaaaaaaaaagtgctgaagttgtgagctgggaaaggtatcaagtacataatttggcaattttgttatttctaaaagataagctaacaaattacttggctgtcataaaagttcactttttatggatgttaaaatacatggagatgttcatttacaaacatggtgagcttgagccagagagccaccatgatacatttcaggtagtatacgtttagtgtgactgtggcgcactaccaccacctagtggcagcagattaccatgcagctattgcaaatagaaaattagaataaaacaaacaggc

SEQ ID NO: 120591 - DNA, 601 bp, Human
gagcagtggcactgtggctcgaaccaatgtccagcttccacactatctgcttggaagaggattacccttatttggaagtctcagttttgaggatttggggaaagcaggcacgcaagcagacacaccttattctctacagcatcatttatacctcaactaagtcagctgaacaaatgcctgctgaaaagttctgggagtggcatagctaagaaccagaaaggcgatctttcttttggattaagtcaacagagtcatacccacaaggagaactatcaaatatcagatgcgagaggtgaagtgsggttataaggtgagagctgagaagggagaaacagggtgagtaaacctccatgactcagacgaatactgaactttgcatttcaggaagaatgagggtttgggttgcttctttttctttttaaaaacctcttcttttcagtattccttggggggcggggttctcagaggattaagggtttggaaaattaaacagataagatactaagagttaaataacacataagaggaagaaggattagaaagaggaagaagaaaagtagaaagtgtggtaggtaccttcctacctcaaggtagaagtagt

SEQ ID NO: 120592 - DNA, 601 bp, Human
gtagcaagagcaatctactctgaaattagtgttttccctcactttagcacctttagctgacccagcttcctaccgcccagacattttacaaaaatctctctctggagttgcctcctgatctggattaggagtcacataagaaaatcagtctcatgagtccatcatttttcctcatttctgaccagaagtattctgccccatttgcttcaccttacttattctaaatcactctagctcatttaaacaaacaaacaaacaaacaaacaaacaatgaaacttactgcaagggcacagaataacyatcattaaagatgtctgtgtaattatgccataagttgcaaggcaaactcatgaagcattccgtatgttctttgagcagtggcactgtggctcgaaccaatgtccagcttccacactatctgcttggaagaggattacccttatttggaagtctcagttttgaggatttggggaaagcaggcacgcaagcagacacaccttattctctacagcatcatttatacctcaactaagtcagctgaacaaatgcctgctgaaaagttctgggagtggcatagctaagaaccagaaaggcgatctt

SEQ ID NO: 120593 - DNA, 601 bp, Human
atcctaactgtccaacattactgaattaaaagagtcatattgtatactcatacaatgggattcaaccactacaaatggtatttcagaaatataattattgatataaaaggtgataaaaatataccattgaatgtttaaaaaaggaactaaagagctaaacatagtataatccaagttttgtggaaaaaaaggacacccatatatttactataaaagaagatttggaaaattatgccccaaattgttggcagtagttggtggggccaatcagattttatttttctttttgttcatctgtgctttttttttttttcccccctacaataggcagatgggaagttatggtgggcagcttgagaagaagtgcacctgccttcctttgtaatggctgggggcctttgtcaaccaagttgatgtatatgacctcagtttccagttctttggaaaatccaacctgggatgggacagggcaggaccctgacttctcactcctcttgctttcagccaaggtgcttgctaaccttgacatgggcaaggctgggggcctcatgtctcagactgtctctctgttgtactttaactctacccttgatcaagtccc

SEQ ID NO: 120594 - DNA, 601 bp, Human
tcatttatctttcagtggctttgcaagctagggatgtatgcagaaaaaaaataaggtaagtagagtcatttccatgaagcaaagccatgaagggtacaaaagagaattattaccttcaaagctttagttgtgaagatagatgaccccaatgagggcgacactagtggggagaggtaaaatcctaaagaattaacagagtggtaggcaaactgataagggtgctctcccactgaacgatttttctggaggtcaatttggcagttgtatcaaaaatttttaaaaagcctacccactgagctasgcttttaaggaatacacgttaaagaaatatttagaatgctacaaagattttcctacaagggtgttcttcacagtactatctataatatagagaatgtagaaagatcctaactgtccaacattactgaattaaaagagtcatattgtatactcatacaatgggattcaaccactacaaatggtatttcagaaatataattattgatataaaaggtgataaaaatataccattgaatgtttaaaaaaggaactaaagagctaaacatagtataatccaagttttgtggaaaaaaaggacacc

SEQ ID NO: 120595 - DNA, 601 bp, Human
gcactttcacaaccccgtgcaactgtacaactcaagctgtgagagctcaccatctcgagacatccctacggcaaggcatttctgtaatcgacagtgttggcagcggtttctactggttcgatcaatcaaacagttcttctgacgaggacaggagtaggtggcattgctttgctgacttctcctgaaaaagccctgtgatatggttataaaatataaaacaggttagtgtcagaatgagtggtatgatactaaaggcaggatgctaagcactgagtggcattaatatttaatggagaattamacttgtagcagaatcatccaggagaccattaatgaaattaaagtcacttctttttccttgagtaaaattgatccccagagcctaatcctccatcccttatacctgcaaaactttctttaacttcaacagacagttgcccatgtaaaaaggcacaggaccaggtccttgttcttggcttctgatgatcaaaagcaatgtgcctgatggaatgatacaaaaggacttacctttagcctttatctctaagagattgtttgtaaaataaatacaaaacacttccctggaatatccaagttaagg

SEQ ID NO: 120596 - DNA, 601 bp, Human
ccacttcggtatgagtgcattttttagccaaagtgccatgttcaagggcacgctttgcctaaggcctatggatttatttcaggattgaatatttgacaagcaaacaggacagagtcactagtatttatggtaaggtggaggcaaacctaaagtgagtcaggtcatttttcatggtatcatgtcagctttcaatcaaatccttattcatatctgaaaattgtactttcattacagttctgcttaaggctcagccaaccaagatttcatgacaaaaatggaaggtttttgttctagttcaagaaaaaaaaaaaaaaatcaaacctacctctgctcagcttggcttctagttcagaggtttctctgttaatcaaaagagctgcaatacaccttttaatgctgttcagtggttaaagaccaggcttaaaatgtccctgctcttgaggatttaaatttagacccataaagagatgcttgtgtaaaaaccgtaaagaacattcaatttgttctatttggagaaagattttactggaaatataaattttcacttaaaagatgttttatggggtgcagaggtagagaaaccgtctaaagaacacagcca

SEQ ID NO: 120597 - DNA, 601 bp, Human
agaaacaagaaaatacataaataaggtagtgaactacctcttttggaaagaactctcactatataaggtcgtttctagaatgtaaaccaatttttgccgataaaaaaatgatgaagatgaagagtcttcgcagggaagtagggggggatgctgtggagtgaaggatgagaagaggctcatatcatttccttccaggttatgtttcatttctagttaataagatacttagcatcttgtggtttcactttgtcttaagaaactgtggccacttatccctacctatttaaaacagccaataaaragtgagacaacaaatcatgcagtgtacctgacataccagtagagggcagtggttgcattcacaccatctgctcaccaacagcctttcattccaattcatagtcgatttggcaagtgtaagattttagacactttgctatttttaaatctccatttcagcaaaggcgagtatggtcaggctgaataaaattcgagaatttaagcgtggtctctcagataaagtctggaatagtgaaataccttgggctaggagttaggagacctggcttctgtctgagctcagcagataatctatagtcta

SEQ ID NO: 120598 - DNA, 601 bp, Human
ctagaggccaaagaagttttctctaggagcttgtaatctggtgaacacgtatgaacacactggaaggacaattcaagtctagataataaggtataaagttgaattacagaagaagagaaagaaaaaagtaattgaagctgtcagaaaaggaagagattggctgggtgtggtggctcacgcctgtaatcccagcactttgggaggctgagctgggcagaccacttgaggtcaggagttcaagaccagcctggccaacatggtgaaaccctgtctctattaaaaatacaaaaaaaaattggcrtggtgttggctgtctgtgatcccagctacttgagaggctgaggcaggtggatcacctgaggtcaagagttcgagaccagcctggccaacatcatgaaaccctgtctctactgaaaatacaaaaattagctgggcgtggtggcgggtgcttgtaatcccagctacttgggaggctgaagcaggagaatcgcttgaacctgaaagctggaggttgcagtgagccgagatcacaccactgcactccagcctgggcaatagagcgagactccctcttaaaaaaaaaaaaagaaaattatatctg

SEQ ID NO: 120599 - DNA, 601 bp, Human
ttccagaaacatgaggcttccttgtcaacttccagaaacattaggctgagattattttacataaacttccagaccttaaaatcttgattgtgatattgagacaattctcaattcatttagacttttggaagctgcttaatctattctcctgttgacaaatggaaggaggtatgtgtatacctagaaagcacaatagaaattatttgctattgctgaaattttgcatctgagttaaatggcaaagcctcaagtacattagtagcttcagaaaaaagatatttaaacagaaacctgatgacaytcattctttagtctgtgtgaactcttgaccaactttcctataccaacacccttcccaatattgcctcaatcctaggaggaaaaattcctcagatcataccttgttttgatagttctcaatttcttcctgtaaaaaggtctgccacgttatctgctggagctcttctctcaagtattggcaggtttccagatgcgatttagatatattctgtgcaaggtgttctaaggagaaaacgggagatcacaaacacgaaaagcgaagttctttgaataattggtgatttaatatttgctttaagaa

SEQ ID NO: 120600 - DNA, 601 bp, Human
aggtctggtcttgatgtttcactctccagacatgccagtggatgttagttttcctcaaatgtaaaatggattcacttagataatcttgttgatctgggtgttttacagaaaaaggcaagtagggtactatttgtcagcctcatattgctaggttcagactggagttatgatcacagcttctaaattttttttgtatatactccctaatacaacttccagaaacatgaggcttccttgtcaacttccagaaacattaggctgagattattttacataaacttccagaccttaaaatcttgawtgtgatattgagacaattctcaattcatttagacttttggaagctgcttaatctattctcctgttgacaaatggaaggaggtatgtgtatacctagaaagcacaatagaaattatttgctattgctgaaattttgcatctgagttaaatggcaaagcctcaagtacattagtagcttcagaaaaaagatatttaaacagaaacctgatgacattcattctttagtctgtgtgaactcttgaccaactttcctataccaacacccttcccaatattgcctcaatcctaggaggaaaaattc

SEQ ID NO: 120601 - DNA, 601 bp, Human
gggggatcacttgaggtctggagttcaagaccagcctggctaacatggtgaaaccctgttcctaccaaaaatacaaaaattagccaggcgtggtggtacacaccggtactcccagctacttgggaagctgaggcagaagaattacttgaacccgggaggtggaggttgcagtgagccgagattgcgccagtgcaagtgtcagcttggcgacagagtgagactgtctcaaaacaaaacaaaacaaaaaactggtggatatgggagccaggattcaaatccaagcatctctgactctaaaatyctatttcatatactttgttgcttcttactgttttcttgcttctcctttgtagctttggctgctggcattacctgctacctcaaaggcaaacaaagcaatgtgttgctattccccaacatgtcctgttaaattccttttatattcgcactctccatttcagttacagaatggtctggatctttttcgttgctaacttgtttccccaatcttagtttcagactgttcccaccgatatgatggggtggaagaaacactgaattaggagccaggagtcaaggtctggtcttgatgtttcactct

SEQ ID NO: 120602 - DNA, 601 bp, Human
atcaactgaatttattgtgcacctactatgagctaggcgctttatgacatccttgttttaattcactttcataagaatattttttctggctgggcacggtggttcacgcctgtaaacccagcactttgggaggccgaggcagggggatcacttgaggtctggagttcaagaccagcctggctaacatggtgaaaccctgttcctaccaaaaatacaaaaattagccaggcgtggtggtacacaccggtactcccagctacttgggaagctgaggcagaagaattacttgaacccgggaggyggaggttgcagtgagccgagattgcgccagtgcaagtgtcagcttggcgacagagtgagactgtctcaaaacaaaacaaaacaaaaaactggtggatatgggagccaggattcaaatccaagcatctctgactctaaaatcctatttcatatactttgttgcttcttactgttttcttgcttctcctttgtagctttggctgctggcattacctgctacctcaaaggcaaacaaagcaatgtgttgctattccccaacatgtcctgttaaattccttttatattcgcactctccatttca

SEQ ID NO: 120603 - DNA, 601 bp, Human
ttttgtccaagcagagctttcactcaacccgcatcttttcctatagccctgatttgaagaaaaggcaccttgatatccccttacctaaggatttgaagacgtcggggctggcatacttcccatcaaagtacacggtgttgttctgagagtcaaaggcacggcacattctgataaacaccacctctagagaacctaagcagaggcagaaatggtttgggtcatttgggtcatctgatgttagtgagtttgtttctaagctgctcatgtagagactccttctgcaacagcatggtgggtgtcstgtgcagtttagctagcgggttctcagtcacatcagctgtctatccaaaagggcagagttttctatgtaattaaaagactgttgtgctgaagctaagccctgtttaactgaagtgagggttgatttataaattacttctttagcactcttctacctcgcaatgcagagtctcagagttgctaggaaagcatttattcatatgtactaaaaccaagaatcaaaaacaagtatatctttctgagttctactttcttcttcctaacatcataaactcggaggacttggagtgtagaaacaaaa

SEQ ID NO: 120604 - DNA, 601 bp, Human
atggtttcacttaactgtaacttttatttctttgatatctgcatttcagtctcattaatggttactgtttgagggggatggaagggcaaagcttttgccctttgcttaattttatgtatcagctcacatcctaaaggtcatctgaataatatatcaccagcaaatctggtttcttaaaatctggaagggaactggaaggacacgtcatataaatccctttgattaccaactagataaaatgaaactctacatctttacatgtaatgtagacaaaaaacttttgagctatatgacttttctrcagtgactaactagaaagtaaaataggtataaaaccccttaatttttgtttctaaataaagttttcattttgtccaagcagagctttcactcaacccgcatcttttcctatagccctgatttgaagaaaaggcaccttgatatccccttacctaaggatttgaagacgtcggggctggcatacttcccatcaaagtacacggtgttgttctgagagtcaaaggcacggcacattctgataaacaccacctctagagaacctaagcagaggcagaaatggtttgggtcatttgggtcatct

SEQ ID NO: 120605 - DNA, 601 bp, Human
atgagtcaccgcacctggccccaaattatttattataaattatatatcatggtttcacttaactgtaacttttatttctttgatatctgcatttcagtctcattaatggttactgtttgagggggatggaagggcaaagcttttgccctttgcttaattttatgtatcagctcacatcctaaaggtcatctgaataatatatcaccagcaaatctggtttcttaaaatctggaagggaactggaaggacacgtcatataaatccctttgattaccaactagataaaatgaaactctacatytttacatgtaatgtagacaaaaaacttttgagctatatgacttttctacagtgactaactagaaagtaaaataggtataaaaccccttaatttttgtttctaaataaagttttcattttgtccaagcagagctttcactcaacccgcatcttttcctatagccctgatttgaagaaaaggcaccttgatatccccttacctaaggatttgaagacgtcggggctggcatacttcccatcaaagtacacggtgttgttctgagagtcaaaggcacggcacattctgataaacaccacctct

SEQ ID NO: 120606 - DNA, 601 bp, Human
cctgcctcagcctcctgagtagctgggactacaggcgtgtgccaccatgcccagctaatttttgtatttttagtagagatgggctttgccatgttggccagactggtctcaaactcctgacctcaggtgatccgcctgccttggcctcccaaagtgctgctattacaggcatgagtcaccgcacctggccccaaattatttattataaattatatatcatggtttcacttaactgtaacttttatttctttgatatctgcatttcagtctcattaatggttactgtttgagggggatggawgggcaaagcttttgccctttgcttaattttatgtatcagctcacatcctaaaggtcatctgaataatatatcaccagcaaatctggtttcttaaaatctggaagggaactggaaggacacgtcatataaatccctttgattaccaactagataaaatgaaactctacatctttacatgtaatgtagacaaaaaacttttgagctatatgacttttctacagtgactaactagaaagtaaaataggtataaaaccccttaatttttgtttctaaataaagttttcattttgtccaagcaga

SEQ ID NO: 120607 - DNA, 601 bp, Human
ggttgttaatttaggataaagtctttatgtctaagtcttccaaatagaaggtagtaacttagcaaaagtgattatccccaaacatgcactactggttgaaaacacagattaaattcagataatctagtggatgacatctaaatggattttaacaaaaaaataggatgtcttaaaaatcttgttatcctggagactggtgttaagacaggcaaccctattccaccacagcatttctcttggtatcaggaggttaattctggactggattttgttcaattctcatttctttacattttgtctraaaggcatgaggttttctcaaaagaatatatgtttgtgttggatgggtggaaaagagagggtgttatttgaagacttaaaatccaatttaataagggtggagacctctcttagtagctcccaaatattttatagctattaaacgtatgggccttgtaaaaattctttatcttagacaattcgaaaaccatttttatttttatttggttgtcttacctgctgacatcagtacaaatgcagaaaataatgcaatttcatcttcagtcaggtgcatagaacataaactctttccaaattcaaa

SEQ ID NO: 120608 - DNA, 601 bp, Human
ttgagcccagaagttcagggttgcatagagctatgattgtgccacttcactccagcctgggagacggagtgagaccctgtctctaaaaaattaataaattcaaagattatttttacagtttatgtcagtgcagaatattaactctgctttatgcctaactttgatggaagagaatttctagaatgtaactttttttcctacattgccttattgctgcaggacactttgtaatcaacgatagtaagtataatttagactgaataatgagctgtggctcaacagaatttttttgaaatggaamtttatttctttttagtagcctgttgccttctgatacttttgggaattggtcatatgacttacatgaccatattggcagcatgatttgtgccaggggatagttcaggccatgccaactagaagcctttggcactcacctttgttagtattccatcttctcggtgattcttctgtaggacgtgttgaagagctagctgaattttctgttgcagtttttcaatttttaccttttcttgcagccatgagcgatctaagcataaaaaaatgatattctttagcattcctctgacatggtgtcagg

SEQ ID NO: 120609 - DNA, 601 bp, Human
tggtgaaacacacttaaagcaacttaaacatccagtagcagaggattggtaaaaataaatgatggctgggcgcggtggctcatgcctgtaattctagcactttgggaggccgaggcggttggattgcctgagctcaggagttcaagaccagcctgggaaacacggtgaaaccctgtctctacctaaaaaaaaaaaattagctaggcatggcagcgtgcgcctgtaatcccagctactcgggaggctgaggcaggagaattgctagaacccgggaggtggaagtttcagtgagccgtgatcrcgccactgcactccagcttgggtgacagagcaagactctgtctcttaaaaaaaataaataaataaatgatgatatagtcatgtcatagaatgccaagtatacattaaatatgattttcaagatgaataattcaataactagaaaagatgttcataagcaaaagttggcacagcttgtcagcagcagactcatacagaacccaaggctcttgacttcttctactccaagatgccttctgctctacttcctggaatcctgccttctaccactgtgcaaaaagatgtctagtgatggagaagc

SEQ ID NO: 120610 - DNA, 601 bp, Human
tttttattgacaagtaatgtttgaagcaaactcttctcatacgccaacaataccattaaatactcaattgcagaagagactggtatggtgaggcaaacaacccttaaaccaaaatagcagtaaatgactagaacccttagaatctcaacctctactgcacaattttattttcaaaaagaattgtttatcataaaactttcaaagcaagccttataaagcacaatagctaaatcaaaaccatattgtaaggtttggagatgctgtttaatgccaattaatcagcaaatcctgtctacccggrctctactcatcccaacttccatccctgtcccactcaccctcaccctctactaaacacgtgtttccaaagctcaccagtggaaagactggtgatattactttttgtttaaacctccaagtcttcccaactgtgagtaaactgaaaatcctgaggctgacctacaccatcttctctacttctgatctcaactcccatacactcttccagatatttttcggtctcaggaccacccagcacttgcctcagactttccaagtgttcactctaaagctcctctttgccagctttctcacatccttc

SEQ ID NO: 120611 - DNA, 601 bp, Human
agatataaatccatacctgctaattcactgacagcatagggctgtctgttgtttttgcgcaagttggtgtgaacaaagttcacaatatctggtcgaataggagccttgaatacagcaggcaaagtgacatttttgccagatgactcccccttttcggagtacaccgatatcagtgggcgagcacacgcctaaagaaaaagacaaggattatttttattgacaagtaatgtttgaagcaaactcttctcatacgccaacaataccattaaatactcaattgcagaagagactggtatggtgrggcaaacaacccttaaaccaaaatagcagtaaatgactagaacccttagaatctcaacctctactgcacaattttattttcaaaaagaattgtttatcataaaactttcaaagcaagccttataaagcacaatagctaaatcaaaaccatattgtaaggtttggagatgctgtttaatgccaattaatcagcaaatcctgtctacccgggctctactcatcccaacttccatccctgtcccactcaccctcaccctctactaaacacgtgtttccaaagctcaccagtggaaagactggt

SEQ ID NO: 120612 - DNA, 601 bp, Human
tcaagacaaaaaaaagtaatatttttacaccgtattatcatcaataaaccagacccaggccgctaaattccatcagagatgaccagtcttaggtagtgaaacaaaggatacgtttccaaaagcaccctggccagagcggtgagtcccaccacctcgaactctgggaattcgagccacagctctgccagtaccccaagactcagcactagtctgatgacctaaaattgagaagagataaaagttgtagctgcttcatcatacataccaacccatgactattatgcatggtagcaaacagcakcagaacatccgagaaaatcatgtggttcagaaacacggaccaatgaagtggaatttcatcactactgtaaagcagtccctaaaatatctgcagaagatataaatccatacctgctaattcactgacagcatagggctgtctgttgtttttgcgcaagttggtgtgaacaaagttcacaatatctggtcgaataggagccttgaatacagcaggcaaagtgacatttttgccagatgactcccccttttcggagtacaccgatatcagtgggcgagcacacgcctaaagaaaaagacaagg

SEQ ID NO: 120613 - DNA, 601 bp, Human
tcatcattttgacagttaaataaaaatgcgatgggtacgcaacaggcaagtttaagttggaagttttctaaggatatactaaactactacttgaatagttccccagttacgctagtattcccctgattgatttgtcagatttaagtagtcagacctagtatttagtaaaggattaaaatttaatcagacacttcagaatgaaaagaatgtgcaattttaacaaaggttcacgtgaaagaaaaagtggggcattttgtatcactgatacgaaatatttttgattaaaaaatttttaaaccgrtatgtaacatgtatttctggagtacatttgataactgaatgcactcatttgtcaagatcaaatcagtgtaactggaatatccatgaactaaaatattttatgctaaaaacattcaaattattctcttctagccatcttgaaatgggttactgtgaataaaaatcaccctaatgatcaaatagtaggtgtcttatttcttctatcaaactctcttatataaagtattacaaacctttagacatgaccagtgctggtagggctgaggcagccagggcagaacagatggcgtatcgtttttgg

SEQ ID NO: 120614 - DNA, 601 bp, Human
aagaatcaaatccctgtaagaacttaatgtatcaggaagagaaaaacaaaaacaaaacaaaccagccgggcacggtggctcacgcctgtaatcccagcactttgggaggccgaggcaggtgaatcacctgaggtcaggagtttgagaccagcctaacaatatagtgacaccccgtctctactgaaaatacaaaaattagccggacatggtggcgtgcgcctgtagtgccagctacttgggaggctgagacagaagaactgcttgaacttggtaggtggaggttgcagtgagctgagatcamgccattgcactccagcctgggtgacagagcgagattccgactcaaaaacaaacaaacaaacaaaaactccactcacattcctggcctggcgaagaatggtgttccggcgcatggtctttgcatatgggtttagcttcaacatgattctcaagtttttcagtgggttcttctttaggactctgcgatggatcttcttgctataaaaaagcagatactgtatcaacattttacttaacattatacacatacaaatttttgaaacaaccaatagtatagggttggggcgagaattacactcta

SEQ ID NO: 120615 - DNA, 601 bp, Human
agtgcactccgggccgcagttactcttcagggatgtgctggtgagtggtaatctcagtgtccggatgccagcaagggggactcagggacttgagtagtcagcaccttgaccactggtgacctgagccagtggcaatggctactgctggcttcctgtggaggcagttttattgcttcaggcacagcattgataaattgcaaccactaaaacctggcaaatgtctaggaccctggggagatagatcaatctgactgaacccctgccctcagagagctcatggcccgggctgggacacacatayagacacaaccacgcaaatgcaaactgctgaatctagaagagaggttttttccccccaagtgtttcggggaatgtccttggacagattccagccttgtttttctactgagttctctgaacttggtgaccagctgagaaagggaaaaaggacaactttaacttaccatgtttgagcacactgtttcattaatttattttgagacagggcctcactctgtcgctcaggctgcagtgctgtggcacgatctcggctcactgcagcctctgcctcctgggctcaagcgattctcctacctcagcc

SEQ ID NO: 120616 - DNA, 601 bp, Human
cttctgggccaggagtggtggcttaggcctgtaatgccaacactttgggaggccgaggtgggtagatcgcttaaactcaggagttcgagaccagcctgggcaacatggcaaaaccccatctctacaaaaaatgcaaaaattagtgggggcttggtgacactcacctgtggtcccagctattagggaggctgaggtgggagaatctcttgaacctagaggtcgaggctatagggagctgtgattgcaccactgcactctagcttgggtcacagagcgagaccctatctcaaaaaagaagaaaacacacacacacacacacacacacacacacacacacacacacagatttctgtctaaactgagtctgtgattttttcctttctcctgagttaccaaatactattggctgtttatgtcttttgtttggtgcttatactcttaagtgttttatattactagtctttcaggtttgtctttatctctgtaaccagtttataatcttcctaaagtcaaggatcaagttttattgtcctgtagcctacagctttgtgatctttatgctcgtggcatgttgtagatgctcaatgatgttttggatctg

SEQ ID NO: 120617 - DNA, 601 bp, Human
tctgggccaggagtggtggcttaggcctgtaatgccaacactttgggaggccgaggtgggtagatcgcttaaactcaggagttcgagaccagcctgggcaacatggcaaaaccccatctctacaaaaaatgcaaaaattagtgggggcttggtgacactcacctgtggtcccagctattagggaggctgaggtgggagaatctcttgaacctagaggtcgaggctatagggagctgtgattgcaccactgcactctagcttgggtcacagagcgagaccctatctcaaaaaagaagaaaacacacacacacacacacacacacacacacacacacacacacagatttctgtctaaactgagtctgtgattttttcctttctcctgagttaccaaatactattggctgtttatgtcttttgtttggtgcttatactcttaagtgttttatattactagtctttcaggtttgtctttatctctgtaaccagtttataatcttcctaaagtcaaggatcaagttttattgtcctgtagcctacagctttgtgatctttatgctcgtggcatgttgtagatgctcaatgatgttttggatctgtc

SEQ ID NO: 120618 - DNA, 601 bp, Human
tgggccaggagtggtggcttaggcctgtaatgccaacactttgggaggccgaggtgggtagatcgcttaaactcaggagttcgagaccagcctgggcaacatggcaaaaccccatctctacaaaaaatgcaaaaattagtgggggcttggtgacactcacctgtggtcccagctattagggaggctgaggtgggagaatctcttgaacctagaggtcgaggctatagggagctgtgattgcaccactgcactctagcttgggtcacagagcgagaccctatctcaaaaaagaagaaaacacacacacacacacacacacacacacacacacacacacacagatttctgtctaaactgagtctgtgattttttcctttctcctgagttaccaaatactattggctgtttatgtcttttgtttggtgcttatactcttaagtgttttatattactagtctttcaggtttgtctttatctctgtaaccagtttataatcttcctaaagtcaaggatcaagttttattgtcctgtagcctacagctttgtgatctttatgctcgtggcatgttgtagatgctcaatgatgttttggatctgtcag

SEQ ID NO: 120619 - DNA, 601 bp, Human
agctagcatccagctgtagctgtttggctgcaatttcatgttttcaggctttccactggattgcctgtgtgctttattctgtactccctttacagtttcctgtcaataaatactttctaactatgagagtgtagaaataattttttaacactaaaatcttttatagatgcttcctcaaaaagttgatgtttcatttgtgaggactagactcagaaaaaaaaatctcttttggctgtaatgagcaaggactgcctaagatagtcctctttgatcagttttatatgcacagatttatttttgraaaaaaaaaaaagcactatagaggcaagactattatgcaaattgccactgcagcaaaagcttctaaagaattgcctttagaaggaagttgcagccactctgctaagtgccctgcttggaaaggctgtgggctccctgctgagaaatactgcgagcggctttgtcagccggctgcctggtgccagttctgctgcagcctgggagggacactgtggcagagctcctggagagaaatgaggtttgcaggccattggagttggactggacatgatggagggtcactttccccagagcgtaggtg

SEQ ID NO: 120620 - DNA, 601 bp, Human
aagtgtgtcaaaagcctgttaagtgtaaatatagataaacctctactactccaggtttacgttctgtgatatcatgctctttcttttgccccatcaatggcagcagctctgtgcccatcttcatgtgggccagttttaaatgaaaaacaataaatacaaaacatacccacagacaaaataatgacagttcttagttgttttgtgtttggattatcatgtactttccactatagacttgaaatcctaggctggcttttttcatgattattttgtggtgacttttttttctgaaccagaaatycgaaccaataaatggaatctatgtttaagaaatagttgaggccgggcgtggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggc

SEQ ID NO: 120621 - DNA, 601 bp, Human
ctgcagaactcaccttttgggctgatggtcctaaaccttgttttcttattaaaaggacctcttttaggtccttattctccattacatctagagctcacagttctacaggctgtacaagcatggcactagcatctgcttgcattctgctgaggaagcttttacttatggcagaaagtgaaggggcagcaggcgtgtcacatggcgagagagagtggaggaggtgccaggctccttcaaccaaccagtttctcacatgaaccaacagagtgagaacccactaccatagagagggcactgagtyattcatgggggatccacccccacgacaaaaacacctccttccaggccccgcctgcaacattggggatcactttggaggggacaaatattcaaaccatatcattgtggaaataaatttgtaagataaattcttagagttggaactactgagacaaagaatacccatatttaaatttcaatatctattactgtgtttgctcaccaaaaggtagaaccaatctacactcacaccaacaaggtatgagaaggcccatttccctccaaccccatcaactctggatattagcaaaccttttagtca

SEQ ID NO: 120622 - DNA, 601 bp, Human
agcctcttttccacatggcagccagagtgattcttttagaagtcaggtgacaccaccacgctcacaaccctccagtgatttccatctcactccaaagtaaaagaccaagtccttaaaatgccctccaaggctctgcattttcgcatctggcctcaacctgtcccaccattgtttctctgaacccgtgtgtttctccccaaacctctcattctgttctagccactctggcttcctttcggtctgtcaaacatgccaggcattcctctgacccagggcctttgtattagctgctgcctctgcstggaacagtctttccccagatatcagcaaggcccactccctcacctccttcagtctctttccactagagtgtatgttccatgaaggcaggattttgtttgttttttcttttttcactgttactgtcccagtgcccagaacagtgcccaccacatagtgggtacttttatttgctggaaggaggaagaaagcaaagaagtaaggaaggaatcaggaagagggaagcaagaagctaaattaaaactcatggatatgaagatgtggccatggaaagtacggcctctggtcctgcccacgtcat

SEQ ID NO: 120623 - DNA, 601 bp, Human
tgtgaaccaatgtatcagatctgtctgctcccctacccccaccccttttgttggtcatatccggtaacgcttttttggtcagatggcaaagaacctccatgtataagatagaaaaagctcaaattattttcttgcttcttagtaccactactttctagtgttgttctctaacatatttgtacctctgaaactttgtggcagtttagtaagtttttatgatttatggttccagctagtgtaatttttacagcttatccagcttgataggcagctagcctgaatcttggctagatgggctgtmtatatccaagtttttgttcagaaaagtattttaggctactgtcatagtaatttgcttagtatgtatttctgctttcttacccttcactaacttttcgtagctgtcaattcactgtctttagagagaagtgcatttttgctttacaggttaaggtgagtggtttgctcttgggctgccatcaaggggtcagagacagctcagcttttgccttttggctggagccaccagtcttctcatggatatggttacttttctaactcagtttcctcttggacaaaaacaaggagtctttaataaaac

SEQ ID NO: 120624 - DNA, 601 bp, Human
atttttacagcttatccagcttgataggcagctagcctgaatcttggctagatgggctgtatatatccaagtttttgttcagaaaagtattttaggctactgtcatagtaatttgcttagtatgtatttctgctttcttacccttcactaacttttcgtagctgtcaattcactgtctttagagagaagtgcatttttgctttacaggttaaggtgagtggtttgctcttgggctgccatcaaggggtcagagacagctcagcttttgccttttggctggagccaccagtcttctcatggrtatggttacttttctaactcagtttcctcttggacaaaaacaaggagtctttaataaaacgactaagcatagatattaaagagcaaatcagacagtctcccaaagagcagtttgtaaagaaaaccaatacctatataaagctaggtatcctattaacccacaacaactattcatcagtatgccatataagcctgattttatccccagcctttattagaatgcctctttcaacttatctgaaatcttcttttggagtcagaccccctaaggggagagttccaacattttatcactgggttg

SEQ ID NO: 120625 - DNA, 601 bp, Human
gctgacttctttcacagatctttttcttctgaaataatccctcaagagatttcttagaaatttagaattccaaaatattttggtttaagtagccttaaaggttcaagctctagctttgagaagttgaagaactctccttttgttcttgattgtgatttaaatgatttttatgtaatcggtgcccccccctttttttaaataaattataagaagggttttcactcgttttaccaaaatataagcacttgcccatcctatgtgaacaataccttattcaggtcttgggtatattgaaattcamatataagcagtctctttttaaccataatctctatagctagcttagttgcagaaatgagatttattttaaaaaaactactttattcaggctggaatttgtttttatgccaagttcagaacttcataaagaacaaatcagtttagcctacatttaaagagaatttgacctggttttaaagcaaaaatgtaaagtgctttcatgtgtggtgatatgtaacattacatcatttgtactttgttttttcctgtctcctgcatttttaagaaaactttcgccttaaccttgaaaatattagtttct

SEQ ID NO: 120626 - DNA, 601 bp, Human
ttttttttatgtcatcactgttatttatttttttttctccgagatggagtcttgctctgtcaccgaggctggagtgcagtggtgccatcttggctcactgcaacctctgtctcccgggtttaagcaattctcctgcctcagcctcctgagtagctgggattacaggcacccaccaccatgcctggctaatttttgtatttttagtagagacggggtttcatcatgttggccaggctggtctcaaactcctgaccccgtgatccacccgcctcggcctcccaaagtgctgggattacaggcrtgagccactgtgcccggcctatcatcatcattattaaattctgaataatttgggtttatataataccttagttgtgatttctgcaccatgtattccttacagcatatgcttattttctcaaattcagtgtttaattatttttgtgttgtaggaaaatatgattacataatcttacattacatgtccttagtttaaaagtttctgagattacttgggtccacttttttttatctgaatagaagtcatctatctcattgatgagataattttaaaaaattttttgtagagatagggtcttgc

SEQ ID NO: 120627 - DNA, 601 bp, Human
tcggcctcccaaagtgctgggattacaggcatgagccactgtgcccggcctatcatcatcattattaaattctgaataatttgggtttatataataccttagttgtgatttctgcaccatgtattccttacagcatatgcttattttctcaaattcagtgtttaattatttttgtgttgtaggaaaatatgattacataatcttacattacatgtccttagtttaaaagtttctgagattacttgggtccacttttttttatctgaatagaagtcatctatctcattgatgagataatttwaaaaaattttttgtagagatagggtcttgctttgttgcccaggttggcctcaaactcctggcctcaagtggtcctcctgcctcagcctcccaaggtgctggaattacaggcgtgagccaaggtgcctggccaggttggctgtcattttgatctgtcttggttcttatgattgaaatttaaggagaaccatttggacgtaaccttacagtaggttttgattggtagtcctcatgattaccagcatgttcctacaaatttgcattggtctttattttgtaggttcaatttggctctgaagtt

SEQ ID NO: 120628 - DNA, 601 bp, Human
tagaatattccacttctgggatcacggcttttcctctgacactattgcatctttttaattcctccataaagttttttttttttttttttttgagacagagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccgggatggtctygatctcctgacctcatgatccacccgcctcggcctcccaaagtgctgagattacaggcgtgagccaccgcgcccggcctaaagtatttttttaattagaatttgaaatgctttattagaaaaaaaatacacacaacctacatattctgaaaactaaatacctgatcattgctaattaaatattcccttaatgtagtttaaattttgttgttgttgttctcatttcctcctctcattttctagaaagattgaaaatagcgtgctgcttttttccttccatttttttgtgtttgttgtctgg

SEQ ID NO: 120629 - DNA, 601 bp, Human
acctttcattaagaaattcagccaatacatcttgcttttgtaagtagatttatatttgtttctgctaaatcctgtgtctagggatttattacacctggttctcttaatattgagaggcttgtgtgagtagaacacagtattaacaaaaataattttcatcattttgtctattctcactctttatatcattttttcccacattgccaggagagtatggcatacattttactgtagtgcctcccattatgagaccttgtattatatttagtacaagagtccttatatttaagtgaagtgtaartattccctttggtgtatttgaccacagtgtaccctgtcagacgttgagtactatgagggaaaaatactttttgacctgtggagcaccttataaattgggatatgattggctttatcctaatatacataacttggacattgcctctaaaatcatgcagttactcaagtagagttggaaggtaaccacagaggttttgttcaactctttcattttacaaataaggacattgaggcccacagagaatagaagattcagatatcagttggaagtcacatggctaattaaaggcaaggcctggat

SEQ ID NO: 120630 - DNA, 601 bp, Human
agggatttattatgtggctcttggaagcaaaggaaaagataagcacgagtaggcctcagtcttggtggcaccagggcactctggggaccactggaataggaggtttggaccaccaacattttgtcatttatatggctctgctcccagttcagttccatctctgtggagggttccgcttagcctatttataacaaaatgtctcatttggcttgctgtctgcatggcctgatagtcctgttttatttaagtggcaggttccctgaagctgctattaaaacttctactttaagaggaatagcasaattgctacagcctaaaaatcaggtgaaaggtcagtgtggacactaccccaagctaaccaaggtaataactctgaaagtttcagctgagaggatcccataaattttgggcctgttgctgaatacaaatttaaactccttctgccaacacatattaccttaaacatagccaatttgaatttcatctgctattggctgcccaaacttctatgaaggccatctggggctccttaaagtcctttatggttttaaccaaatggtgttatcattaaacttggccaacttgctgtcattttcacttt

SEQ ID NO: 120631 - DNA, 601 bp, Human
atccagaccctaagagagagttcttggatcttgtgcaagaaagaattcagagtgagtccacagtgcaaagtgaaagtaagtttattaagaaagtaaagtggtgaaagaatagctactcactccatagagtaggacgttcccgaaagtaggaggatgaatgtgcccaccctacgtatgatgtttgtttatgtataggataaaaaaggatcatggggagatgtgctctgctacaagggtttgtgataaaggattcattttcttaattactatattttgcaagaattgatattattattattatttttttttttgagatggagtcttgctctgttgcccaggctggagtgcagtggttcgatcttggctcactgcaaactcacctctcgggttcaagtgattctcctgcctcaacctcctgagtagctgggactacaggcacctgctaccacgcccagctaagttttgtatttttagtagagacgggttttcacgtattggccaggctggtctcaaactcctgaccttgtgatctgcctgcctcggcctgccaaagtgctgggattacaggcgtgagccaccgtgcctggcctgatattatttt

SEQ ID NO: 120632 - DNA, 601 bp, Human
ccagaccctaagagagagttcttggatcttgtgcaagaaagaattcagagtgagtccacagtgcaaagtgaaagtaagtttattaagaaagtaaagtggtgaaagaatagctactcactccatagagtaggacgttcccgaaagtaggaggatgaatgtgcccaccctacgtatgatgtttgtttatgtataggataaaaaaggatcatggggagatgtgctctgctacaagggtttgtgataaaggattcattttcttaattactatattttgcaagaattgatattattattattattattttttttgagatggagtcttgctctgttgcccaggctggagtgcagtggttcgatcttggctcactgcaaactcacctctcgggttcaagtgattctcctgcctcaacctcctgagtagctgggactacaggcacctgctaccacgcccagctaagttttgtatttttagtagagacgggttttcacgtattggccaggctggtctcaaactcctgaccttgtgatctgcctgcctcggcctgccaaagtgctgggattacaggcgtgagccaccgtgcctggcctgatattattttgt

SEQ ID NO: 120633 - DNA, 601 bp, Human
gtaaacttgcaaacaaaacaaagcaaaaaattgtacttgttatccccttgttgaatctggccctctgtttcaaattaattagatttttggtaactatgctaaactttgtcacatccttattaaaatgactgaagaattttgaagaacagctcagagggactctgaaactaatctgagtctagtactggagattccattagcaattgcaaagctgattgatcttttacccagttagcttattgattatcgctgcagttactgcatgtaacggattatgcaaggggtaacaggagaaaacacrttttataattgctgctgatgtattcagtttggacacaatatttcatactctatataattatttctgcatttttaaatgctgcaacacttctaagatagaaagtttgcttaatattgtttcaatatgaggaggtgtacttttaaatttcttaactaataatgcattacagtttaccaagtgccttcactaattttattgctgcagtttaatttttgagcctcacagtaaccctatatatatatattttttttttttttttgagacggagtctcgctctgtcgcccaggccggactgcggac

SEQ ID NO: 120634 - DNA, 601 bp, Human
tactgaataatttgtgtttactaaggagtgtgaaagctttttcacttagaactttattttttgtgtgcagaattttacagtgcaatttgatccgtactaaagtgtttataaggctaaagcataaaaggtatgtttgtttgaaactaggctacctttttatcatgttaatcctgtcatctttggatgggtcatattttgtttgctatttccacagtctctgtgatttcgatttccattatctgtgcattttatacacaaattgaataatgtttgattaactggcatgtaggtccaagcccartgtgaagcttcttcattttgctttgcaaaatccagggaaaaagagcaagaggcaatttgggaaattccactaaaatgctttatgtgtcgtctaaatatatatcattttcaaatatttcttaaatactaatataaagtcttaatcaacacttttactcttaaagataaatgccagggtgaaggctaacacactggactttcaatcctaaatattcactatagtcattttgatgtgccagtaggggaaaagtattctcaaggctgatatgtatataccagcaatttacaaaagtactgtgaa

SEQ ID NO: 120635 - DNA, 601 bp, Human
aatgtttgattaactggcatgtaggtccaagcccaatgtgaagcttcttcattttgctttgcaaaatccagggaaaaagagcaagaggcaatttgggaaattccactaaaatgctttatgtgtcgtctaaatatatatcattttcaaatatttcttaaatactaatataaagtcttaatcaacacttttactcttaaagataaatgccagggtgaaggctaacacactggactttcaatcctaaatattcactatagtcattttgatgtgccagtaggggaaaagtattctcaaggctgayatgtatataccagcaatttacaaaagtactgtgaattaaacaacccataagtgtctgttccagtattcatacattactgagtgatctctttctataatctctttgcagtattattccacagtaatggaacagcaagtaaatggacagttaatagagcctctgcagatatttccaagaggtaatgttgagcaaattctaatcaacaatgattatttcagtaaactgtttcatcaacagttatgtttccaaaggtttaaatgcacataacatgatgtttagctcttaattcgaaaaacaaaa

SEQ ID NO: 120636 - DNA, 601 bp, Human
gtactatccttgtatcagatatgattgttcaaccgtgtataaatgttccctcaaaatttgaataatggtgaacaagaacagtttaattatataaaccattaagtctttcacccgttatacattgccccacttggaatccatgttttctaactaatggaacagataaggaaattctctaagtaacccttctagaaataacttaattgaaataattaaaagttaaacttaccttcgttaactgatactgtacaaataatcatggtatgagttttccaattaaacattctagactttcattacytgtaactctctgaagtttgaatggctcaattaaccagtaggctcctatttgcactgataaagtctccaaaggcagctgtcttggccaacccacaagaagatctgggttcaagaataatactgctcttccagcatatgtgtgggcagcagaatcaggagtgcttagtatattactagtaacttattgaagtgctaagtaagtacagttgggctatttaaggccagtgatagtccaaaacaaggattgtgattaatccacttctgttgtacttgaagattaagcaccaaaacagaaaaaaag

SEQ ID NO: 120637 - DNA, 601 bp, Human
ttataggttaattagaactgtgtcctcagaacacaagactgatcaagattctttctttacttataggtgaatactcgggccggaccctctcaacacagcagcccagcagtctcagattcacttccaagcaataggtgcgagcgagcaagtaaagtgtgcccttgatgtgatttatctacagagttggggtggggtggggaagaagctagaaagaaatttgaccagttagataacctagctacgtattgaccaaagagaaaggacctcatatggaaagatgaatgtttagatttagactggrtgctgagaaggctctctggggagagtgacgtttctgttttgacctgaagaagcagagaagggcgtttcagacggagggaagagggtaggtgaaggccctgaggtggagaaggagctcagcatgtttgtgagtaggccagtttggcacagggaggggtgctgggttggggaagggatttggagagaggagatgagagagcaataggagtgataggagctaaggaggtagacaggacttatcatgcggggcctcgtaggccctgtaatgtttgaattttccttttggtgcactggctagcag

SEQ ID NO: 120638 - DNA, 601 bp, Human
aagtcaagaacccttggatgaagacatgctttataaaatctaggaaaatagggactcagtctccatagtttacatttgaccatagcaaaagtttaagatgtatttagaaagaagagtaattataacttgaagtggtaaaatgtgatcaaacttgaagtctgagattctctcaaatgtaacctattaaaggtaccaaatggaatatgtgtatttcatattaggtcttgagtcctttctctttttttccttttcatttcttcctttcttgctccttccttcctccctctctccctccctccccctctctccctccctctctctctctctctctctctctctctctctctctctctctctctcactctctctttgtttctttttgagacagggtctcattgctgtcacccccccattctggagtgcacaattacgggtcaccacagcttcgacctcctggcctcaagtgacccgagtagctaggattacaggcacatgccgccatgcctggctaagtttttaattttttttagagatggggccctactatgttgcccaggcttgttcttgaactcctgggctcaagcgatcctccttccttggc

SEQ ID NO: 120639 - DNA, 601 bp, Human
tggatgaagacatgctttataaaatctaggaaaatagggactcagtctccatagtttacatttgaccatagcaaaagtttaagatgtatttagaaagaagagtaattataacttgaagtggtaaaatgtgatcaaacttgaagtctgagattctctcaaatgtaacctattaaaggtaccaaatggaatatgtgtatttcatattaggtcttgagtcctttctctttttttccttttcatttcttcctttcttgctccttccttcctccctctctccctccctccctctctctccctccccctctctctctctctctctctctctctctctctctctctctctctcactctctctttgtttctttttgagacagggtctcattgctgtcacccccccattctggagtgcacaattacgggtcaccacagcttcgacctcctggcctcaagtgacccgagtagctaggattacaggcacatgccgccatgcctggctaagtttttaattttttttagagatggggccctactatgttgcccaggcttgttcttgaactcctgggctcaagcgatcctccttccttggcatcccaaagtgctg

SEQ ID NO: 120640 - DNA, 601 bp, Human
gatgaagacatgctttataaaatctaggaaaatagggactcagtctccatagtttacatttgaccatagcaaaagtttaagatgtatttagaaagaagagtaattataacttgaagtggtaaaatgtgatcaaacttgaagtctgagattctctcaaatgtaacctattaaaggtaccaaatggaatatgtgtatttcatattaggtcttgagtcctttctctttttttccttttcatttcttcctttcttgctccttccttcctccctctctccctccctccctctctctccctccctcyctctctctctctctctctctctctctctctctctctctctctcactctctctttgtttctttttgagacagggtctcattgctgtcacccccccattctggagtgcacaattacgggtcaccacagcttcgacctcctggcctcaagtgacccgagtagctaggattacaggcacatgccgccatgcctggctaagtttttaattttttttagagatggggccctactatgttgcccaggcttgttcttgaactcctgggctcaagcgatcctccttccttggcatcccaaagtgctggg

SEQ ID NO: 120641 - DNA, 601 bp, Human
ctgctttctgaaaccattattgcttcgatttgtgaagcaaaggtctagtgatgggactagtttctgtcagacctttacatataaaataaggattaattgagcatttttattttaatgatttataagcgataggtactgattcttcttaacacagacaataaacaaagaatattttctgtgttgatccataattgaattccatttcattttttccattaatttcattaatatattaaatcaagcactttaaaaaaagtttaacacttagtctttggaatggagacattgttttcctgttatsactttatgttggagtaattccatttttccagcttaaaaaaataaatcagaagatatttttggcaagttttattgagagctataaatcagtctcactgatgtgttttctggatttgtttttcctacttcagttatagtgtggcatcatctgtttaacattggcccttgatttgaaactcattagaaatagcccaaagtgtcaatttgaagaatttaaaaagtgcacagttactccaaagatatgtgagtttggcctttgcatctctaaagttattttttcttttttttttttgttttttag

SEQ ID NO: 120642 - DNA, 601 bp, Human
ccaaatttttttacatgaggagtatttgtacagcatataaaaattagaaaatacaaataagcaaaaagaaaaagaatctgatattttttaatattaaaacacagtcaggccgggcgtggtcgctcatgcttgtaatcctagcacttttgggaggctgaggcaggctgatcacctgaggtcaggagttcgagaccagcccggataacatggtgaaaccccatctctactaaaagtacaaaaattagccgggcatggtggcgtgtgcctgtaatcccagctgctcgggaggctgaggcaggasaatcatttgaacttgagatgtggagtttgcagtgagccaagttcacaccactatacttcagcctgggtgacagagtgagacttcatctccaaaaaaaaaaaactaaaactaaaactaaaaaactgtcaatcagttcacaggccaaaggtttgcataactttaaaacattgtagaaagacattataggaacacgttgctcactttttatagatactaagtgacatggttccagaacttgctcttcaaaaccatttttatctttatgagactcttgcaatcctcctggttatctgaaggatt

SEQ ID NO: 120643 - DNA, 601 bp, Human
atttctgcctaattattgctgtatactagtttgttatttgcaaagaaaagctatatctactctaggaaaatcataaacattatttagtttgttaaatgttaattatgggggtcatctgaggagttttctagggctgatttatttacagatcatgcattagattactgagtgtgtgtgtgtattgtcttcctaagtttgactttggttatgtgcagtgctctttggcattggttatatgcagtactggagactgttttcttatcagtatctctgacctgacccttttgagctatgttgtatyattccattttgacaccttttatcaaactttaatgaaatgacccaggcaaacaaattgtcattaaactttccatcacttcgtcccttggtatcgtcttttataaattggacagcaaacgttgtattgatcttctcgtttttgcagctgaacttgaaatgacccagactgcttgttgtttatggcccagagttgcttttccttgacatttccatccacagcatgacaccctttttgtttttctttctttcttgtggagatgaatgaacaagacatacgatatcgggacactcttggtcatgg

SEQ ID NO: 120644 - DNA, 601 bp, Human
tagtttgttatttgcaaagaaaagctatatctactctaggaaaatcataaacattatttagtttgttaaatgttaattatgggggtcatctgaggagttttctagggctgatttatttacagatcatgcattagattactgagtgtgtgtgtgtattgtcttcctaagtttgactttggttatgtgcagtgctctttggcattggttatatgcagtactggagactgttttcttatcagtatctctgacctgacccttttgagctatgttgtatcattccattttgacaccttttatcaarctttaatgaaatgacccaggcaaacaaattgtcattaaactttccatcacttcgtcccttggtatcgtcttttataaattggacagcaaacgttgtattgatcttctcgtttttgcagctgaacttgaaatgacccagactgcttgttgtttatggcccagagttgcttttccttgacatttccatccacagcatgacaccctttttgtttttctttctttcttgtggagatgaatgaacaagacatacgatatcgggacactcttggtcatggcaacggaggcacagtctacaagtgag

SEQ ID NO: 120645 - DNA, 601 bp, Human
agcgttccttcccacgcaacctccactataaacggtatcttttcatcttagtcttctcttccttacgatctgacttagatttttcctgtgttctgaaggtacttaagttcaggtacccatagaaaggaaagaggaagaaggaacatgtatactctgatttgcttctattgagttccctggagggagcacttttcaaagcttgaacctttcttcttaatgcctttatgctgatagccaaatataataaaacaggaaagatttctggcaactctttgtattccttttatttgcttcaaatggrattaaaaaatgtttatttagactcctaacctacttatctgtgttatttcaccaaacctttagttttatattaattgaaggtctattgtgaatttattttcctagcttatttctagaagggaagaagcataagaccatgaaaccccagcagaatttttacgagacataatattctagatgttgacattttaatcctttattttaaaacataggtttgtttgtttgttggttggtttgtttattttgagatggagtctcgctctgttgcccaggctggagtgcagtggcacgatctcagctc

SEQ ID NO: 120646 - DNA, 601 bp, Human
tgaatttttattttgtgcaccaggcacatgtatcttatagatgaccaatatgaacaaacagctgtctcccttcctccctccttccttggaacgtgtaatctctgaataactgattagctcaatgtcagaaatgtttgtgctgatctctgaacctcagtcagttcaacacatgacttcctggaaattttatctttggttttcttttttttttttttttttcactgccatgattttgtgagttagtttatgagtgtatttaaatcatttctggaatctaaatattttggacttgctggtcttyataaggaagttagtttccctcctctcacatagacctctttctgctttctcctatctatcatattttaagagtatatgtgacaccgttaagttttaatcttctaaatggattggagaataacaccttcccttgactaacctcaaaggatttttaaaaacagaatgttgcctaatttttgagggagaatgttctaacacagtttatatatttttgtaactcaacaaaggtatctcataaagaacattggtggaattgggttttaaagtccaaatactttccttctgttgtccagaacatagc

SEQ ID NO: 120647 - DNA, 601 bp, Human
tttctgcttgttagttaaagtaattttgcagaagactttgtactgcagtattgaagtgttcatttagctgatagttaggagttatttacagaggcctctactgttgttctgagatgggacaattccccaatcatcttttacttttaatttttcaggcttcagtataccaatcaataggtgattgaaactgattaaaacttatccaaccagctgcctatggcagtttaattagaagctggatgattcttaaattaaagttgtcttattttcattgcaaagccatcttccagaagagtaaggsaagaacagtgcagaaaacttaaaagactggctttgctaaggtatcttgcaaatgttaaatcactcaatagctattcctaagacaattcaaaaatgtatcagagagtttgcttttatggagattagaagtaataacatgcttacttgccagccaaggaatgtttgtttcattcggtcagagagattacctattgtataatgatacatgtgaaagaccagctgtttgggatatatctattatctcataagcaagatgaatgcttgagcttagttttaaacactgtaatgcaggatgaaacta

SEQ ID NO: 120648 - DNA, 601 bp, Human
gtatcttgcaaatgttaaatcactcaatagctattcctaagacaattcaaaaatgtatcagagagtttgcttttatggagattagaagtaataacatgcttacttgccagccaaggaatgtttgtttcattcggtcagagagattacctattgtataatgatacatgtgaaagaccagctgtttgggatatatctattatctcataagcaagatgaatgcttgagcttagttttaaacactgtaatgcaggatgaaactagccatgatgatatcctctgcatctgccccctggaaaccatyagctttgaatttatatttttattctgttttgaggtcttgattaaaataaatctccattgaatgaaaaacaaatatttttatataagttcatgttgacttgtcaacagtattgtgggcaggattatagaagagagatttttgctcctcttcagctccctagggaagcttctccatactcattttatctagtgtggacaatttcttgagtttttaatggaaacgggttaatatttttgtcataggggacatattacatctgatattacggggaagaagggaagaaatggctcacttttcaga

SEQ ID NO: 120649 - DNA, 601 bp, Human
ctagcctgggtgacagagcgagactctgtctcagaacagaaacaaaaacaaaaaaccactactgataaagtatatacctgtgaatttaaataactgttgaagagaaatagtaatttataacacgaacatataaggcaatagagtagttgatgccaatagataaatgaaaccacagggtaggaaatctagtaggtagggaagtaagtagaaataaaagaatggaatccaattgaattcaggaaggaataacatgaaagaagaaatggtgaccatttaagtaaatctgactgtataagacaaygatagtaataattcaaaatgaagttaaaaagactggagaaaataatatgttaagatgagaagggcttgattgaagttaaaacattctaagatttttatattgtttaggagaaggatatagataacaattaactttatgttttgttaagtcaggtatgattgttaaaaattatacgggtaactaaaacagtgaatagaatgtgtaacttcaaaacaaatagatggaataaagggagaataattcagtataatagaggaagagaagtcgataggtgtaaagtaaatgaattaggtggtagaa

SEQ ID NO: 120650 - DNA, 601 bp, Human
gaaataaatccaaatatatcaataattacaaaaaatataagtagagtaatattagcagctaataggttaggttgcattttttaaaatacagttatgtgctattttagactgtattgggagaaatttctaaaataccaagacacagcaaaattgaaaggaaaagggtaggggaagatacctggcaaaaactaatcaaaagaatgctgctactgtggttatattaacataagacaaaatagactttaaggcaaaaagtattactagagaaatgttatgaaaatacaaatatttacaactgaaycacaaataccatgtattaatatgaaaactcctgagatgcaccaaagtaattcttaaaggataggtttatatacacaccttagtaaagaataactgggtatgatatgcttagaatctaactcaagaaaatcaagaaggtgggacagggaataaacccaaagaaagtggaaggaaagaaatactaatgaacaaaagtttgaaaaaaaaaaaaaaaagaacaaaagttaattaagtgaaaattcaagaaacaattcaacaaaaccaaaagctggttctttggaaaaacttaataaaatatagc

SEQ ID NO: 120651 - DNA, 601 bp, Human
actctgtcttgaattgcgcttctgactgaaccctttgctaattaagtcctaaccccacagaaccccatttccaattttgggctcttagctaacaaactggtcaggcttgccttgcccccaaccttccccacaaattgttcagaccctctacatattggcccccacctacctttataaacatgcactctgctttaccaatctgttacttcccgtcatgccctttatctccagtctcctggcctttagtaatgaaagttcttattttttgagtgactactatatgccaagtattatgctagatttttttttttttttttgattgagacagggtcttgctctgtcatccaggctggagtgcagtggcgtgatctaggctcactacagcctccacctcacaggtccaagagatcctcctacttcagccccttgagtggttggaccagaggtgtgcatcaccatgccttgctaattttctttattttttgtagagacagggtttcactatgtttcccaagctggtcatgaactcctgggcttaagcgatcctcctgtctcagccacccgaagtcctgggattataggcatgagccaccacgcccag

SEQ ID NO: 120652 - DNA, 601 bp, Human
tccaatatgcctttttagctatccacagtgagaaattgatctctttctctaacagttgcatagtatatatttctgcatcttttttctcatctagaaaactaagaatcagagcaattacattagaattgcttataccttttagtaagttgaaaccaaaactaaggctcagatcctctgactgctaatgaaatccagagttcttcttccatatcacatctagtacagcacctagaatgtgttacgtggcattatcaagtttagttttaataagttaaatagcttgtgagggggtacaacagakcttcctttgagatattttctttgacagttcagccatttagggtccatagaattgtagaactggaagagaccttggagatcacctgttacagcccccacattttacagaggcactgagctcactgaatgcagctgtgtcataccaccttggtgctcaccgagcgcggcccagtcgtaccaccttggttctcactgagtgtggctctgttgtacaccttggcattggtttaacctttctgtacctcctgagctcccttttcactaagagaaaacttccactaaaacttgagcactattttcc

SEQ ID NO: 120653 - DNA, 601 bp, Human
ccaatatgcctttttagctatccacagtgagaaattgatctctttctctaacagttgcatagtatatatttctgcatcttttttctcatctagaaaactaagaatcagagcaattacattagaattgcttataccttttagtaagttgaaaccaaaactaaggctcagatcctctgactgctaatgaaatccagagttcttcttccatatcacatctagtacagcacctagaatgtgttacgtggcattatcaagtttagttttaataagttaaatagcttgtgagggggtacaacagagyttcctttgagatattttctttgacagttcagccatttagggtccatagaattgtagaactggaagagaccttggagatcacctgttacagcccccacattttacagaggcactgagctcactgaatgcagctgtgtcataccaccttggtgctcaccgagcgcggcccagtcgtaccaccttggttctcactgagtgtggctctgttgtacaccttggcattggtttaacctttctgtacctcctgagctcccttttcactaagagaaaacttccactaaaacttgagcactattttccc

SEQ ID NO: 120654 - DNA, 601 bp, Human
ctcagatcctctgactgctaatgaaatccagagttcttcttccatatcacatctagtacagcacctagaatgtgttacgtggcattatcaagtttagttttaataagttaaatagcttgtgagggggtacaacagagcttcctttgagatattttctttgacagttcagccatttagggtccatagaattgtagaactggaagagaccttggagatcacctgttacagcccccacattttacagaggcactgagctcactgaatgcagctgtgtcataccaccttggtgctcaccgagcgyggcccagtcgtaccaccttggttctcactgagtgtggctctgttgtacaccttggcattggtttaacctttctgtacctcctgagctcccttttcactaagagaaaacttccactaaaacttgagcactattttcccatccattgagttacttttttgttccttttatgtcagaagtcttagattgttgctgatgatatatttaaagatagccaactctaggttatttactccaggagaggggaacactgttataaatcgtctagaaatctatgattatttggccttgcaaagtacatta

SEQ ID NO: 120655 - DNA, 601 bp, Human
agtacgagaccagcctgggaaacgtggcaaaaccctgtctctacaaaaaataaaaaataaaaaataaattagctgggcatggtggtgtgtgcctgtagtcccagctacttgggaggctaaggtgggaggatcgctgagctgaggaagttgagacttcagtgagccatgattgcaccactgcattctagtctgggtgacagagtaagacctcatctcaaaaaaaaaaaaaaaaaaaaaaaaaaaaaaaaaaaaaaaaagaatgtataatccactgtatagggtattgtataatgtcaattaratcaagttggctgatagtgttattcagatatttgttattagatatttgatttttatctagtactatcaattactgaaagaggggtgttgaaatactcaacaataattgtggcctacagttctgttattttttacttaatgttttttgaagatatattcttaggtgcatttatgtttgttatgtcctcttgataaatcggcctcattgacattatgaagtaaccttctttgtctgtgatcatattctttgctctgaaatttatagtctgatattaaattctaggcttcattttgacaagtg

SEQ ID NO: 120656 - DNA, 601 bp, Human
caaaaccctgtctctacaaaaaataaaaaataaaaaataaattagctgggcatggtggtgtgtgcctgtagtcccagctacttgggaggctaaggtgggaggatcgctgagctgaggaagttgagacttcagtgagccatgattgcaccactgcattctagtctgggtgacagagtaagacctcatctcaaaaaaaaaaaaaaaaaaaaaaaaaaaaaaaaaaaaaaaaagaatgtataatccactgtatagggtattgtataatgtcaattagatcaagttggctgatagtgttattcaratatttgttattagatatttgatttttatctagtactatcaattactgaaagaggggtgttgaaatactcaacaataattgtggcctacagttctgttattttttacttaatgttttttgaagatatattcttaggtgcatttatgtttgttatgtcctcttgataaatcggcctcattgacattatgaagtaaccttctttgtctgtgatcatattctttgctctgaaatttatagtctgatattaaattctaggcttcattttgacaagtgttagcatgatatttttttttttacttt

SEQ ID NO: 120657 - DNA, 601 bp, Human
gcagaagttggaaggacttgacttgctgagtcttcccgccttcatctttcttccatgctggatgcttcctgaccttgaacatcagactccaagttcttcagcttttggactcttggacctacaccagtgatttgccgggggctttcaggccttcagctacagactgaaggctgcactgttggcttccctacttttgaggttttcagacttggactggcttccttgctcctcagcttgcagatggcctattgtgggacttcaccttgtcatcctgtgagtcaatactccttaataaattccscttcatatatacatctatcctattagttctgttcctctagagaaccctgactaatacagagatggtatttagttacttttgaataatttgattctttcaaggcttgcttttaagttttattagacagtaccagcccagtggttagtctagaactaattttccccgtgcagcagaggtagtactcttctgagtactctacctggtgccttgcaaattgcaaggtttttccacactgactggtgggaatacaaacttttcttgcccagtattaatctggagatcgtttcttctgagcctttc

SEQ ID NO: 120658 - DNA, 601 bp, Human
aacccaaagtacaaaaaccctggaaggcaacctaggaaataccattctggacataggagtgggataaagatttcatgatgaagacaccaaaagcgattgcaacaaaggcaaaaattgacaaatgggatctaattaaactaaagagctgcacagcaaaggaaattatcaacagggtgaacagacagcctacagaatgggagaaaaattttgcgaactatgcatctgacagagttctaatatccctttcttttccttacaccactctaatccagatgcttggcttctttcttgtcagacatgkataccagcttttgaattgttctcagtaaatagaagctaccatttattgatgatttatacaatgctaagcattttgcatgcattttttaaattaatgctcacaacattttgtaactcttactgattcctgttttacaaaagctgaggcacagagaagttaaataacttgcccaaggtcccacaactgataagtagtggagccaggatttaaacataggtagtcttgttctaagtgccggtgacccccctgccggcgctgctcactgctctcagatttggcttgccaagggtcatcctggtc

SEQ ID NO: 120659 - DNA, 601 bp, Human
ctgctgcttttaaactagcatttaaatggaccatttgattaatcatttgtatactgactataatcctcccaaatttcctttctgagttgtacatactgtaaaagacaattatgtcgccatagattaaataagtgaattaaaacagaatagcagcttaatttgacctgtgattttgctctctttccctttagtgaagtgtgtgccactccagcaaataaacgaagtcatccatgacagcttgtgatgaattgccgtatttatactgtatattttaatagcctcacactaatttaaattgagyacagagtaaattataattcagtcacttgactgcttatatttaacttgacaactcatccttatttgtcctggaggtgtagtggagagcagtggaaatgcaccaaggtatttcagtttctcacttaaccctttctccatggaatgcttcatattcaaattctttccagtttgaaacatttagcacttcctaaggagaaaaaaataatgaagaatcagggagtccgtactttccttggactccaaaaagaaaattagtctttgccatgctttttgccgttgccttcaaataaggaattggatt

SEQ ID NO: 120660 - DNA, 601 bp, Human
attaaataagtgaattaaaacagaatagcagcttaatttgacctgtgattttgctctctttccctttagtgaagtgtgtgccactccagcaaataaacgaagtcatccatgacagcttgtgatgaattgccgtatttatactgtatattttaatagcctcacactaatttaaattgagcacagagtaaattataattcagtcacttgactgcttatatttaacttgacaactcatccttatttgtcctggaggtgtagtggagagcagtggaaatgcaccaaggtatttcagtttctcacwtaaccctttctccatggaatgcttcatattcaaattctttccagtttgaaacatttagcacttcctaaggagaaaaaaataatgaagaatcagggagtccgtactttccttggactccaaaaagaaaattagtctttgccatgctttttgccgttgccttcaaataaggaattggatttgtttatttttagcagttttaaagctcactcacaagaatacacaggggaaggagaattaaccttccacccagagtgccaagtctcccagaaaatagagagcatttgagtagagttattttaa

SEQ ID NO: 120661 - DNA, 601 bp, Human
tagcctcacactaatttaaattgagcacagagtaaattataattcagtcacttgactgcttatatttaacttgacaactcatccttatttgtcctggaggtgtagtggagagcagtggaaatgcaccaaggtatttcagtttctcacttaaccctttctccatggaatgcttcatattcaaattctttccagtttgaaacatttagcacttcctaaggagaaaaaaataatgaagaatcagggagtccgtactttccttggactccaaaaagaaaattagtctttgccatgctttttgccrttgccttcaaataaggaattggatttgtttatttttagcagttttaaagctcactcacaagaatacacaggggaaggagaattaaccttccacccagagtgccaagtctcccagaaaatagagagcatttgagtagagttattttaaggtgggttctactttccctctcaagttctcagaaattactttatttgttttttccatcattttggaatctcctctattctagactaaagcaaataccaacaatgatcaaaacgaattagagtacagcggattagctccacaaatacagtattc

SEQ ID NO: 120662 - DNA, 601 bp, Human
catgctttttgccgttgccttcaaataaggaattggatttgtttatttttagcagttttaaagctcactcacaagaatacacaggggaaggagaattaaccttccacccagagtgccaagtctcccagaaaatagagagcatttgagtagagttattttaaggtgggttctactttccctctcaagttctcagaaattactttatttgttttttccatcattttggaatctcctctattctagactaaagcaaataccaacaatgatcaaaacgaattagagtacagcggattagctccayaaatacagtattccttactacattttaggtcagtgtggcatttttatttgtttggtggtgtacatttttagttttaaattcagtttaaaatcaagcaatctatttcttctgtctagaaacagtttcttataaagaggattatagttgtaaagacttgagttaaatcctacatcacttactaggcactactgtgagttagaccctgtgtggagtgctgggggggatagaaaaatgtacaagactcagcccttgcccttgagaggcgcatagccactctaatcttgaggcttctgtttttag

SEQ ID NO: 120663 - DNA, 601 bp, Human
ctattctagactaaagcaaataccaacaatgatcaaaacgaattagagtacagcggattagctccacaaatacagtattccttactacattttaggtcagtgtggcatttttatttgtttggtggtgtacatttttagttttaaattcagtttaaaatcaagcaatctatttcttctgtctagaaacagtttcttataaagaggattatagttgtaaagacttgagttaaatcctacatcacttactaggcactactgtgagttagaccctgtgtggagtgctgggggggatagaaaaatktacaagactcagcccttgcccttgagaggcgcatagccactctaatcttgaggcttctgtttttaggagatgagggatgcatgctcaaggcagaatgtacatattgagggccagagctagagatgaattttgatggaggactttgaggtgagcttcatggagacaatggtggcattcaagctgggtctaaaagatagaacaggttttttcaatcagtgcctggagaagagagaggaagcacaccccaagtacaggaaacagcaggagcaaaggctgtaagtagggaaagcacaggatatg

SEQ ID NO: 120664 - DNA, 601 bp, Human
atttttttcaagtgccctaggtattacgatatgaggccagggttgagaaccattgatttaaggttaataataacttcattccttttatcagacttttttagagtgagagattcctggtatttgtcatcatagtaggaatagctgtagtattttatgctataggattgaactgatgctagatgaattaattttgttggtaagttttacacaaaaacaaaaatgtaagtgaatattgttggcaagtgactattgatcaggagaagtgtttaaatgtttcttggcagttttgtattacacttayagtctagtttactgagatcttataaataaccccaaagcaaactcttttattttttttgagacagagtctcgctctgttgcccagactggtgtgcagtggcgtgatctcagctcactggaagctccgcctcctgggttcacgccattcttctgccttagcctcccaagtagctgggactacaggtgcccgccaccacacctggctaattttttgtatttttagtagagatggggtttcaccgtgttagccaggatggtctcgatctcctgacctcgtgatctgcccgcctcagcctcctcc

SEQ ID NO: 120665 - DNA, 601 bp, Human
aaggttaataataacttcattccttttatcagacttttttagagtgagagattcctggtatttgtcatcatagtaggaatagctgtagtattttatgctataggattgaactgatgctagatgaattaattttgttggtaagttttacacaaaaacaaaaatgtaagtgaatattgttggcaagtgactattgatcaggagaagtgtttaaatgtttcttggcagttttgtattacacttacagtctagtttactgagatcttataaataaccccaaagcaaactcttttattttttttgcgacagagtctcgctctgttgcccagactggtgtgcagtggcgtgatctcagctcactggaagctccgcctcctgggttcacgccattcttctgccttagcctcccaagtagctgggactacaggtgcccgccaccacacctggctaattttttgtatttttagtagagatggggtttcaccgtgttagccaggatggtctcgatctcctgacctcgtgatctgcccgcctcagcctcctcccaaagtgctgggattacaggcatgagccaccgcgcccagctgcaaactcttgatagaaa

SEQ ID NO: 120666 - DNA, 601 bp, Human
gttaataataacttcattccttttatcagacttttttagagtgagagattcctggtatttgtcatcatagtaggaatagctgtagtattttatgctataggattgaactgatgctagatgaattaattttgttggtaagttttacacaaaaacaaaaatgtaagtgaatattgttggcaagtgactattgatcaggagaagtgtttaaatgtttcttggcagttttgtattacacttacagtctagtttactgagatcttataaataaccccaaagcaaactcttttattttttttgagatagagtctcgctctgttgcccagactggtgtgcagtggcgtgatctcagctcactggaagctccgcctcctgggttcacgccattcttctgccttagcctcccaagtagctgggactacaggtgcccgccaccacacctggctaattttttgtatttttagtagagatggggtttcaccgtgttagccaggatggtctcgatctcctgacctcgtgatctgcccgcctcagcctcctcccaaagtgctgggattacaggcatgagccaccgcgcccagctgcaaactcttgatagaaacca

SEQ ID NO: 120667 - DNA, 601 bp, Human
tcttggcagttttgtattacacttacagtctagtttactgagatcttataaataaccccaaagcaaactcttttattttttttgagacagagtctcgctctgttgcccagactggtgtgcagtggcgtgatctcagctcactggaagctccgcctcctgggttcacgccattcttctgccttagcctcccaagtagctgggactacaggtgcccgccaccacacctggctaattttttgtatttttagtagagatggggtttcaccgtgttagccaggatggtctcgatctcctgacctcrtgatctgcccgcctcagcctcctcccaaagtgctgggattacaggcatgagccaccgcgcccagctgcaaactcttgatagaaaccacctatgccttttttttccccaccttccgcttccccaaatcaacgcctggccaatgtcaggactataaaatgtactttagaattgtccttttctttccttgctctattagcagtttataatgcataacttatgcttttttcttcagtatgattgtatatatattcttcagttgtaatacaaaatgtaattcaaagttgaatgctacataactac

SEQ ID NO: 120668 - DNA, 601 bp, Human
ataaataaccccaaagcaaactcttttattttttttgagacagagtctcgctctgttgcccagactggtgtgcagtggcgtgatctcagctcactggaagctccgcctcctgggttcacgccattcttctgccttagcctcccaagtagctgggactacaggtgcccgccaccacacctggctaattttttgtatttttagtagagatggggtttcaccgtgttagccaggatggtctcgatctcctgacctcgtgatctgcccgcctcagcctcctcccaaagtgctgggattacaggcrtgagccaccgcgcccagctgcaaactcttgatagaaaccacctatgccttttttttccccaccttccgcttccccaaatcaacgcctggccaatgtcaggactataaaatgtactttagaattgtccttttctttccttgctctattagcagtttataatgcataacttatgcttttttcttcagtatgattgtatatatattcttcagttgtaatacaaaatgtaattcaaagttgaatgctacataactacactatcatagtaattctgaatgttaagtttttatctagaaatgtcta

SEQ ID NO: 120669 - DNA, 601 bp, Human
ccgatcatactacacacaggtaatttttttttttttttgtagagatgggttctcgctatggtgcttagactggccatatacccctggccttcaggtacccttccacctcagcctcccttccagagtgctgggattacaggtgtgtgccactgcacgtagccaacataattcttttatattggtttgagggtcattcctatgctcctcttttgaaaatagccaatgtggctaaaatagagtgcataaattaagagtgttataacttaactgacttttaaagccattactattgacctttgasacctggcttttttctttggtcccatcaatcacttctgtaccacctcccccagtatagaaggacaaaaggttagacagatgcagatacagcttgtattactgggaattatagtggtaagaagaaggaggtggggaagaataaaggaactaccatgtttttagttcttatatttcatagtgattataactaatataattagaagattaaaaaatattaatacctttctatatttaggtcatactactagatattacactggaacttcagaagcaaattatgtctgaattggaaattctttat

SEQ ID NO: 120670 - DNA, 601 bp, Human
tattcatttctattttggtagttctttcttgacctgaatattacggcaaaatacagatttctagggacatatcagtgaaatgatgtcatcattattattatttaccaattttaaatctaagcagtctttaaattttacatattcagttttccatagtctagtccattaaaacacaacttaagaaaatattgttagttccttgtggagattctcagtacattactaaagcaattagtttgtgccctgcaaaactttaatgagccaacattggtaccttgatactgtcataaggtgtacaacrtgctctaaattagttatagtagaatgtcaaaaattaaaaatcttacagccatataggtaagtatggtaactgtggagactgaccagaaaaagtggattcattgagccagtacatgttactgtgttgtaacttttatcattctttctttgaagtcttcaatttttcagttctactcaaacatttttgttgaaacagggcacggtggttcacgcatgtaatcccagcactttgggagactaaggtgggaagattgcttgagcccaggagtttgagaccagcataagcaatatagtgagatct

SEQ ID NO: 120671 - DNA, 601 bp, Human
atgagggatccactcctttgacccaaacacctctcacgaggccccatcttcaacattgggagtgagatttcaacatgagttttgaaggggacaaatattcaaactgtatcagccattttaagtatataattcagcagcatgaagtacattaacatggttgtgcaactgtcaccaccatccatctgcagaactctttttgtcttgcaaaactgaaactctatacctattaaataagaactcctcattcacccccgctcccagcccctggcaaacagcattatactctgtctctatgtgactrctctaggtacctcatataattggaatcacacagtatttgtcttattgtgtctggcttatttcattttgcattatgtccttaagagtcatccatgttgtagcatgtgtcagaattttcttccttttaaaagctgaataatatttgtgattagtttttttattaccaactcaatctctttatatactggtttagtcagattttttattttttcttgagtcagttttggtagtttgtgtttttctcagaattaatctgtttcatctaggttatctaatttattgatacacagttctgaaaaat

SEQ ID NO: 120672 - DNA, 601 bp, Human
tcatttaaaatgaaaccgacttttggtttctttgattttctctatttttttttctattctctgttttgtttatttctgcttaaattttattattttctttttttctgctttctttgagtttagttttagcttgatgttctccttctgtttaaggtagcaagttaggatattgatttgagatctttcttcttatttaatgtaggttataaattttcctctaagcacggctttagttgcatcctagaagttttggtatgttgtgtttttattttcattaatctcaaagtattttccatttttytatgatagaaatctcttgtgatttctttttgacccatttttatttaggtatgtgctgtttaatttccacatatgcgtacttgagaagaatatattctactgtggttaagtgaagtatcctttacatgtcagttaattctgattggtttataatactgttcagtattttcttattaatcttctgtatagttttgtccatttttgaaagtgagatattgaagtctcaaaaactaatatttttgagttgtctatttctcctttcagttctttcagtttatgtttcatatattttggcactccg

SEQ ID NO: 120673 - DNA, 601 bp, Human
aatagtatacaaaaggccaggcatggtggctcacacctgtaatcccagcactttgggaggccgaggtgcgcggatcacctgaggtcaggagttcaagattagcctggccgagttggtgaaacctcgtctctcctaaaaaaaaatacaaaaattagctggactcagtggtgcatgcctgtaatcccagctactcgggaggctgaggctggagaatagcttgaatccaggaggcagaggttgcagtgagccgagattgtgccactgcactccagactgggtgacagagtgagactccatctcaaaaaaaaaaaaaaatagtatacaaaaactttgcttctgtatagctcaatttcttctcatcttttttatgctattattgtcatataagttacattcctatacattgtgtgtccaacacaaatttaaaattatgccattgtctcttaagtcatagaacaaaagagatacaaacaaaacatacatttatcctgtcttttatatttgcctatgcagttacctttaccagtgttccttatttcttcatgtggatctgagttactgtcttttaacttcaatctaaagttctttcagtctgaaagac

SEQ ID NO: 120674 - DNA, 601 bp, Human
gtaatttcatttgtagtaacatggcatgtttatctctacagggggatctttggatgtatataggaaaatgccagaacatgtccttggaagaattgcagtagcagtaagtatatggcttcagtgttaggaaatttgagtgatttaatccttctaatcaagctcattcttcttatattctcaatgttttttcttgttcttcaatcccagttggctcctaagaccttcttgattttctcctgttttgttcttcttttcatagaccagcccacccaacatcacaacatagtcacacgcttatgtkctccaacctgttctagtttcatgtgtttgcagggaccttggtattcttgttgactcgtaaaatttccaacttcttctgaaaaaaaatgctgttttttgttttgtttttacattttgtagttatgattagcatatgattagcaaatacttaaaaagtctgagttgttaaagcagtctatgagaaaatattaatttattaagaacaaagtagtattagtaaagattttttgcagtctttttatgttcttggtttttaattttttcatcaactacatctagaaatttattccctttgtgattt

SEQ ID NO: 120675 - DNA, 601 bp, Human
gttttttgttttgtttttacattttgtagttatgattagcatatgattagcaaatacttaaaaagtctgagttgttaaagcagtctatgagaaaatattaatttattaagaacaaagtagtattagtaaagattttttgcagtctttttatgttcttggtttttaattttttcatcaactacatctagaaatttattccctttgtgatttaaagcagttttcccatattcttgtattttctatatgcactaatatactgatgaaatatataaactaaactaacattactataatgttctcmtaagttccatatttcacatttataataatgtaggttaaacagtgtctaagagaagtcatggggtgttgtaatagtaaacaattgctaaactaaaggcacgatgataacttcagtggtttaatgcagaacaaagtgattgtaccatgtaccatttaattaaatggctgattttcacattcattatacatcaaactgacaactcaaattctttaatcgaacatggacacttatttagtcttagttcattgtaattcacagctttccttttttctttctaattattagtgtgaagtgccctgg

SEQ ID NO: 120676 - DNA, 601 bp, Human
tttttttttgtatgtttcctgagtaggctacaaatttggattatcatttgttgcagctgacaaacaccagattggcccatggctaatacctggcaccaggagggttgtactagtcaaaataagactagcaaattgatgggctgtgggctgtggtgtgtaaactaaatattcccatagtctgattgtgttcccagtatccttggtcatttctctgaaagtgtactgaagatggcatcaacatctttcccttgagttccctcatggaggccaagaaaacacaagggtgccattgccaagtcaraagcaacagaatcagaaacagagagtagggaaataggtgtatattgaatacttcctgtgccaatcactgttgcatgctttctatacaaatattatgtcatttagcctttacagccaccttgtaaagtgtggattattgaacatactctgtgcacatgcaagatgaggtttggaaaagttaaccagcttgcccagagttatcatctaattagtcagtaaaaatttgaacacagggctgtctgacaccagacctcttgctttctcagtgtgttttcctaacagaatgagaaaaaaaaaaaaa

SEQ ID NO: 120677 - DNA, 601 bp, Human
aacccagcctactgaataccaataatatcctttagattttcagttcacagatttctagctcctttttcaccagaatttacatgtttctaaaggaaaatgtagtgtattttgacaaagaataagaatattttctttttaaatctctaacaaaatgaataattttagcaaatattataaaatcagtatttgttttacttttttctacctaactatcagaatatattggattgccttcccctacatgttttctgaaaattcattttgtatggaaccaatttttagtggtgagctatctttaatrgatagtttttataacatgcagctaagcttctaagttgaaaattttaacccttcttcctcagaatggagatgatcacctccatgctaaataagatgacctcctcctattactcaaagagaaaattgttatcgttatggatgttaatttttataaacatttaaagaaatatttttgttatatttccttctgtgataaaattatcattattaatattttgatattttctttctgtattgtcttcctgtccagaatacatgtgttttattgtaatgccagttatttccaaactgtggaacaagt

SEQ ID NO: 120678 - DNA, 601 bp, Human
ctttcaaggaatttcagtgaatgagtgtgcacctacatctgtctcaatggaaagactaacgaattgcagtgcagatgaacagttatgtcccagtagttatggccactcaactacagaaataaatatcctgtggtaatacacctcattaaatatattcatatttagcttttgagtttcccagctattcatggaaacttttaccttctggacttaaaagcatgtgtttttactgaagcgtcaaagaagccaggtgtccctgaagacttttgtaaagcattgtaatgagaaatttaccttagaytgagtagttgttaacttaatattttagaggttttgtccatatttaataacttggattccataaaaataagattaaagatgcctttttatttaccaaaaagctatttaattttcttcttgattaaaaaattgtagctttttagatcagttcaatcaggcaattaaagatcagagcttttaagttcagctaaggcaattaaataggtaatatacttgtttatgcacttttgctatataagctcattgctgttccttcttaaaagcacatgtactcatttttgctttctctaaatgaatgatg

SEQ ID NO: 120679 - DNA, 601 bp, Human
gagtctctcccgtagtttatatccagtgaggactgtagagtagaatgaaatctgagcaataagcagcggcaaaccactcatcccatgaggcttgttagtctggtagaagttagtttatttgatagtatattatgttaactggaaattgttttggaaattgaagcacagcagttgctattcataatggatcatcaaatgttatattcagtcaggtgttactattgtttattttgctctttttaagatttggttgagatatatgtgcagggactttataaactattgaatgctaagaatgtgrcatgtttttattataaccatgaattaatcactttattcagttaataagaatacaccactccaaaaccaagccagggagagagtttattatactttatattactgagtcaaaaattatgaaaatcttttctctaaaataaaccaaacgtgtgataattccacatgaggacataatcattaaaaatgtttgaaatgcccaccaaattaactactgtggaaaagttgtctttattaaaaggcatatgtgagagcactataagcatagcatgtgctgactatgggtaaaaacaaagaaaatgaa

SEQ ID NO: 120680 - DNA, 601 bp, Human
tgttacatgtaacaacatgggtgaatatcagatacttcatgttaaatgaaggaggtgactcaaagggttaccagctgtgtgattccacttatatgacattctggaaaaggcagaatacatacatggaaaaagcaaaatacaattttccatcctatgggatggaacatcagcatcactggttgacaaacagtggaggaggagttgactgtaaaggcatgaaggaacattttggtatgttggaaatgttctgtagcttgatttttgtggtagttacatggttatatgtgttttttagcaaacraagacctgtgcacctgaaaagggtgagtgaattttactgtgtataaattatgcctcagtaaaccaaattttaaaattaaaaagtaaaccagatttacagagaaaagctcttcttacatcttagcagtgcagtagacactctagaaagaagttttccctgccaaaaggacaaaccattctttcaaagggtcttggtgattctgttattgtttctgtatcttcatggttcctgacaaatcctacctaggtttgatctagtaactcagtagcttaaaaaacagccagccaacccccccacccc

SEQ ID NO: 120681 - DNA, 601 bp, Human
caaacaaagacctgtgcacctgaaaagggtgagtgaattttactgtgtataaattatgcctcagtaaaccaaattttaaaattaaaaagtaaaccagatttacagagaaaagctcttcttacatcttagcagtgcagtagacactctagaaagaagttttccctgccaaaaggacaaaccattctttcaaagggtcttggtgattctgttattgtttctgtatcttcatggttcctgacaaatcctacctaggtttgatctagtaactcagtagcttaaaaaacagccagccaaccccccsaccccaagaaaaaaaaccaacccttgtgatttaaaggatatctacaatgccagaaagagagagacagggtcagggaaggaaggatagtgggaagagaaacagaaacttagaagttgctgttatcattggcacaatttgaaacatctggaaattggacagttctttctgtagttaagccgatttttttccccagagatattaccaagaactgcgtatctgcagagctgacttaacctgttggacaattttaaaagctcagtttctaagaaggaataaggctttatctgacattcccaattc

SEQ ID NO: 120682 - DNA, 601 bp, Human
ggaaggatagtgggaagagaaacagaaacttagaagttgctgttatcattggcacaatttgaaacatctggaaattggacagttctttctgtagttaagccgatttttttccccagagatattaccaagaactgcgtatctgcagagctgacttaacctgttggacaattttaaaagctcagtttctaagaaggaataaggctttatctgacattcccaattcagtcctactgactgactgcctcactgggtgaccccagaaaggcagatcactcctgttctctttgcctctgttccctcrtgtatactatgaaagagtagctggatgatcactcagatttcttcaagagctaaggttctgggttctgtgatttcctgactgaaggaagtgtgacctgttgataaggtggggaacaaagaaaatcagagagacataaaagaaaagaaagagaaaagggaggggagaatttccaagagtagattttgtgatgaaaataataacaataatgactattaagcatgtactctgtaccaggcactgttctaggtgcttaatgtatataaattatttaaggtattccttcaaagtgggaaattctag

SEQ ID NO: 120683 - DNA, 601 bp, Human
ttctggattgggtacaatcataatgataacaatattaatcattttcctaatatcatttattgagtaccttgtatgtgctacagtgttagctctcttgtatgtataattttatttaattgttataataaccttgtgaggaggtatcattgtatctccattcttaggtgaagcaatcaaggctcaagcagcctaaaaaacttgcttagttataggaaaagtcataggaaaaagtcataggaaagtggttggtggcctaatggaaaagctctagtatgagggtcagacccaggtttaagttctkgttcttcctcttaattcatcttagctatgtgaccttgggtcagcttcttaacttctttgaggtcatagcattgtacctggcatataacagctattattatgtcaaataattatttctcaagaaaagaagcaagaggttaaatgagagggaatagttagaacgttcctcacactttcctgttaacatctccttttcttagaaaattagcctgtgagtataaagaacttaaaacatctgggctattttctttgtgaacttcccaagatcacccaactattcactgccaaagctgggataatc

SEQ ID NO: 120684 - DNA, 601 bp, Human
aatactacttttcatacacaagtctttatgtggttctgtattttcatttctcttgagtaaatacctaggagtggaattggtatatttctttagatatttgtaaatcatagtttatcaggccatctagcacatatcagatttgagaagaaataattattttaccattggtatatattatatgattagtataatgaaccaatgtttcatactttgttaaagagtgaccacatagtgactacaaaggtcatatgatagctttatgtttaagttttaaagacactttgaggctgatttttatttrcctaaaaccacctactattatccttagcatgacagaaggctcttttagtaaactcttccattctttctgctcactgatacttttctaataatcttctaagcatttcaagttattggatggaactgcatcataaccacctattatctacttgggctgtcactgctgcaactcaaagatttattgcatcatcgttaaaaagcccagcttactgtgaaatctcactgaaggagtgagacagtattgtgacaggagacacatgttgtgattggataatgttaactcgtctgtgatcccagctga

SEQ ID NO: 120685 - DNA, 601 bp, Human
gctttatagtatatttggtacattcaagtttacaaaatgtttttcccattcatctgattcattcaacatttcactgacctctagctctgtgccagcagtgctaagcacacaggcccacttcattctcttaacagccttgtcaatgtaggaagatcagatatcaagatatcagatatcaggatatcatatacaggatatgatgtacaagatcagggatgatatctgatcttccaacactggcaaggttgtcagtgagaattcaggattgttatgagaattaagtgaaattgtgtgctcaacrctgagcatgtgagtgttgtgagtacacacacccacacgtacatgtatgctcagagagatttaaatgattcgtccagtctcacagtcagtatgcagcggcaccttccagggcatcactctgcttcctttaagggaatctgacccacaggaatctattttgatgcctataaaagcctactgcataaaatgactaaatcttttaaaatgaaaaaaggagtattggatattaaaaatgagccactttgcattgtgcctttatcttactatttccaaaatgatagtcatctcttggccaagatag

SEQ ID NO: 120686 - DNA, 515 bp, Human
ttatttctctttagtggtatgaaaaggacccataattccaggcttcaacacacctcatttgtattttctttgagaaaatgtctcagttaaaatcaatgccctagtattcatttgagctcccttgccttcaataaaactaattgataaaccctaataattaatgccctgattaaaccaaaatgacttacatctgccctgatgattgccatttataatcaatcactttaatgactcatcttttctgtgctttgcttacagaagaaaggctgtgatgtttttaagtgaactgaatgaaaagctstatgccttcaattgctgtttgttttccataacttgatattgcattaaaataagcataaatataactacctccttaaaagtaatctttctgcctaatctgttgtgctgttgtctatggcttcgagtgaagctgaaaacaaacaagaaaaaaaaatcaaatcatttcagtgtttctagagctatttttttttttttaagatagagtcttgttctat

SEQ ID NO: 120687 - DNA, 601 bp, Human
aaaaccccatctctactaaaaataacaaaaactagctgggcatggtggcagtctcctgtaatctcagagactcgggaggctgaggaaggagaatcgcttgaacccgggaggcggaggttgcagtgcgctgagattgggccattgcactccagcctgggcaacaagagcaaaaactctgtctcaaaaaaaaaaagttgtagaacttgcatgttttaaatgaaaccttgaagtaataagttcagtggctatatactaggattgttgatactttggatataaggtagaatattttatgcaagarataacaaaatttaaattaggggagctgtccttaacccaagatttaaagggattctatttgcttcaaattctgccacatgaattcagatttaacctagtttaataaagtcctaagattatttatatctacattaccttaaaaaaggattcaaggtggtttatgatataaggtcaatacaatgaacaaaagacaaaagcaaacattttaaaagaaagggaggcggggtgtggtggctcatgcctgtagtcccagcactttgggaggctgaggcaggtagatcacttgaggtcaggagttcga

SEQ ID NO: 120688 - DNA, 601 bp, Human
ccctccaccaaaaataattaggaaactggacaaaatagtgaaacagttatcttcaaactttagacaacaggcaatgtgagacagtgatccctgagagaacagaaacaaatgaagtaagtcctactatcacccaagctgtctgcacagaaacccaaacaaagctcaaaggtcttactgagctgaaaagacagaatttggagttcaaggagaccaaaatggctagaattcacagagcagagtcctagaaaggcaggaacatgcagagaaagagctctagaaattgcataggagttcccttgcrtctggcctaacatcagcctctgcatttatagagtgaaatcctacaaagctagacaaccaactactgtttagaaaagaaaatttctggggaactataagccaaacaattcccaaaacttatacaaagttgggaatattttaaattccaataatccagtgtagagaggcctcattaaacacattggagaattcaagaaagagattagaaggattatgctttagcagtggggctaaactagccctgtagtagtggttactctcaactctcctaaaataaaaggtctaaaatcagcctcaaaat

SEQ ID NO: 120689 - DNA, 601 bp, Human
gagagaaatggaagacaaacaagttgaacatttatttttcaattatgaaaaatatctgaaataaaaatttcattgatggaattaactgaattagacactacagaagaaattgtgatattgaggttaaagatctggaaattatccaaaattactcatttctactactagaaaaaatatttttttaaatgagcacaaccttaatgatctttgagacactatcaagaagtctaagatatatgtgttaagtggagtctcaaaagaagaggaaagagaaaaggaaacaaaaaataatttgaagaartaatggctgaaaactttccaaatttggtgaagcctgtaagtccacagatctaagaactcaatgaaccctaaccaggatgaacacagagccacaccaaagcacatcaaaataaaaattttgataaccagtgagtaaaaagaaaatcttaaaaatattcacagaaaacagagcacattaagtagagaaacaaagataagattgacagccgacttcatgtcacaagctatgcaagccagaagataatggaaagacgtctttaaaatgttgaaagaaagaaattattccagaattctgtgccca

SEQ ID NO: 120690 - DNA, 601 bp, Human
tatgatgatggtataagaattatgttgaaaaattagagaaaactagacgccaagagaccagggacttgctggtaaaggggacatttgtcttagcaatttttttttttttttgagacaagtctcgctctgatacccaggctacagtgcagtggcaccatctcagctcactgcaacctctgtttcccaggttgaagcaattctcctccctcagcctcccgagtagctgagattacaggtgtccgccaccacgcccggctaatttttgtatttttagtagagatgaggttttgccatgttggcyaggctggtcttgaactcctgacccccagtgatctgcctgcctcagcctcccaaagtgttgggattacatgcgtgagccactgctcccggccatgtattagtaaatttaatgtatcatataaaaagccattaatcagtgagcaagatactgtgcttgcaagggatacatttaaagatgttttaagtatgctcctaccctgtgaacttatttatttcttggggcgatgataccgataaaaagagcttacacctgcctgtgcataccaacttgaattcatagagcctcccaatagaggttata

SEQ ID NO: 120691 - DNA, 601 bp, Human
cctccctcagcctcccgagtagctgagattacaggtgtccgccaccacgcccggctaatttttgtatttttagtagagatgaggttttgccatgttggccaggctggtcttgaactcctgacccccagtgatctgcctgcctcagcctcccaaagtgttgggattacatgcgtgagccactgctcccggccatgtattagtaaatttaatgtatcatataaaaagccattaatcagtgagcaagatactgtgcttgcaagggatacatttaaagatgttttaagtatgctcctaccctgtkaacttatttatttcttggggcgatgataccgataaaaagagcttacacctgcctgtgcataccaacttgaattcatagagcctcccaatagaggttatagtgtgtggtatctgaagggcttgctacagagacaggctctacagttcacccctcatcactgaaacagaatcatcaaccacaatgtgtacttgtggtttccattctttattcactcatccattcaacaaatgtttatcgagcacttgaaatatatctggcactctttcaggggctgggagtacagtagtcaagaaaagagac

SEQ ID NO: 120692 - DNA, 601 bp, Human
ttcagtgtcagtgtagttgagattatatgctgttttaaatataaccagttgtctctgctggactacacttttgccataaaagacgcattgaagcagatgctgctctataccatcaaaagtggtatgctcttgtcctccttgggtggcttttttgggctccctgaattcctgaaaaggctcattgttgtcactgacgatgcttcacagaaatcctttgtgtcattacttagcgactgactgctttggtgaaatctatgtcaattcttttgttaactataacagcagccaaaaataatgtaarggaagagaaggataaatgaaacaaagactaataagcacatgcatgtacacatatatacacatcttttagataaatttctaagtattatctgaagtagcatttgccttgtaaaacatgtgaaatagcagtactacattaatttcctcatcggtttcattcaaatatgacctgttacccgtagcatatgaatgctttttccttgttgcctccctttggcattactattacttagataggaggactagcttgataattacacatatagagcaaaactcatcctttttgtgcaaattctttgca

SEQ ID NO: 120693 - DNA, 601 bp, Human
ggggagcccaactggcccacaataaaaattaatattgggagcaacaatggtggagggccattacaatgtgcagcacaaattttaattaatttccattttggacctcccctgagaaacccagtgatagtgacccatgagcatgctgtgatgttgatttgaattgcagccacctttactcccagccaaacacgaagaccaaagcgaaggtcatcgttgtattatgagttgtcaaagtctgttatccctccagcgtatttagtgttcatttcattctagtaatgcatggggcttcattcacatmttgagccatctgactaaaaattgagtgtgttcaaattctgctttaaattgactttttatatcaggcgggtttgggatactaaagcgataagcatcctgcttaagtgaattgtttaaggttatctgctataaactgtaatgctgtgcttgtttaaactggaaatcacattcaaaagaaaagagagatttaatcatttttattgcctttgtagataaatttgttcccttttacataatttttagttgatttatatgaatgatgattgtaggttaaatgaggaataattgcccattttatttc

SEQ ID NO: 120694 - DNA, 601 bp, Human
gacgagttagtgggtgcagtgcaccagcatggcacatgtatacatatgcaactaacctgtacattgtgcacatgtaccctaaaacttaaagtataatgataataaatttaaaaaaaaaagatttagggatggaaccttattctaaacctaattctaaacctaaaccttcttctcagaacaatacaaaacattttgttttcattcagataccagaatagctcatttttgtcttgcatggtttttaaagaaagtttatactttcttgtataataataggaaaaataataaattaacctctgargtcttcatatctgtttttataaaatgtaattaccttccttcctctaccaagttaggtgagattggtgagccacctttatagccttgctgaatgctaaggtttaagtctttgaaagaatatgaaacactgtaattttttaaaagttggggggacatgactataaatgaaacaattgctcaactacccagcatgttcttagtagctttaaattcctctgataattaaattgcattatatttgaatgtacaaatccagattacagttgtctttcccaggtgtacattaaagaaattagttttt

SEQ ID NO: 120695 - DNA, 601 bp, Human
accttccttcctctaccaagttaggtgagattggtgagccacctttatagccttgctgaatgctaaggtttaagtctttgaaagaatatgaaacactgtaattttttaaaagttggggggacatgactataaatgaaacaattgctcaactacccagcatgttcttagtagctttaaattcctctgataattaaattgcattatatttgaatgtacaaatccagattacagttgtctttcccaggtgtacattaaagaaattagttttttatttttgtttatggatgaatgtgatgcatcyatctgttaattgaaaatgtgaggattaaaattatgaaatgttagcttggattgacaaaactaaaattgctttgcttcttaggtgagtgaattctagtcgtcagctttgtagttcaagctataaaaagcataagatacctagaaaaggagcaatgatagcttgagagtgagtgctttgctcaggtcagtaggaggctcttattggccaagtgctcacctacatggtgtaaggttgggggtggggggaggtggaaataacctatattattatagtacaggtatgaatccctgacttttatct

SEQ ID NO: 120696 - DNA, 601 bp, Human
gtgtaaggttgggggtggggggaggtggaaataacctatattattatagtacaggtatgaatccctgacttttatctgctgacagtctcttgagagaaaagagctgagctttttttttttttttttaaccacaactagttctcattttagctgttatattttacaattttgagttctacatgagccctatgccaaatatccatgaactacagttctcaggccaaattcaatttactggaacaatgtactgatcactcttccaagctcttactgcctatttttgtaaataaagttttattgraacatgaccacacccatttgcttatatattatgcatggcccctttagcactacagtggcagagttgagtagttgtgacatttgcagcagaaagtatatggctcataacatgaaaaatatttactagctgaccctttaccgaaaaagtttgccagcccctgatctatgccagtgaaagttgtatctgaaactgagcaccttcaataatcaaccagcatttactgagcatcttctatgctgttaggtacagtggaaccactctataatgtagataagacttgggtgaaacagggaacacgac

SEQ ID NO: 120697 - DNA, 601 bp, Human
gcctacacagggatcttgccaatgtaaaaaaaaaaaaaaaaaaatcctcatcacttgtgatacatattttgactatacactagcctgaagttttcttgcctactttgttaattttctaggtagcctgagtctgaacagaaattccttttttggaagagataagggatataccttggtatcttcctgcttttgacaaatatcgttgtaaacagacggttctggagttagttaactaaatgtggattcttgtcaaggctgagtcacagagggcatctggagggagtatagtgtgggtgccagraggactgccctttaagatcttccataaattctacttattagatcatcactactctttactgttcttattaagaacaggtcagggttttttgtttcattttgtttgcttgtcatttaacctcactacaaagatgttttagacaagagtcatgtttttcctattatttagcttttcacactgatgacagctgtcatgtgagagagtaacctcagttttagctttttaactgctaaatatccatcatagatattctgtcaacaacatggtacctggtagttggttttgttttgttttgttttt

SEQ ID NO: 120698 - DNA, 601 bp, Human
taggatagacacgtggagcttgctgttggcttttgctgaaaatttttgctcaaacactgcatcacagcagtaatcttgtttcattagcttattgcaagaataatttccccaacaagaggtcatcagaatctgacccttaaaagagttctcttatttgccatctagtatctgtgaacattatcactttttctattttttcttcttaaatttaatttaatttttctatgctttattatcagcttacagcttgcatttgttttgatagttcagtgggcaaatgtaataagtgtgtttaacctcytttttgatcctgcccaaatattttgtatgtgggttccacttttgtgtgtgtgcgtgttttttctgtattctgggtgaaatacttggtacctgttaatcagtagaatgaagaaatggagagaggaaggaaaaaaggacagggggcagggcagcatttagttatttctttaataattctagaggattttaggattttcatgtttgttagaagttcttgacagacatgaatagcaatgtatgaggaagttatataagaactctctaaggaacttatttgttcatgcagtaaacatgtattaca

SEQ ID NO: 120699 - DNA, 601 bp, Human
ggtgatgataaaatagtaccaatattacatggatgtttatgaatctgaaatgagatatgcatgaaaaacactaaaacaaggcctggtgtatagaaattctttaataaatgcacacataattgtgttgttgatgatagtaatgatggtgacaataatgttattcctgtagccggctagccagttccatatgaatacatcctggtatctattgaattggatattggggtgtaagttatgatctcagccttgccatgattagcctgtaacctttagcaatcattccacctttgtgagacctccrtttctcttattcatttgttcacgtgttcattccaaagccatctatgaagtactgtactgaatgctaaatcctagagggatagatagatcaggaagcatccactcagtatgaaattattccttttgaagttgagagtgtttatgtagcctcttttagaccgggtatttgctatacatcttgagtggaggaccaagagtcccaaatggacctttcagactgttccttggttcatatacaaagaaactctgatcaatggaatgaaatgttgaacagcagatgaatctgggtaaaggaaatagg

SEQ ID NO: 120700 - DNA, 601 bp, Human
cctctctggtaaagtaccacttgagcagatacttgaatgctgtgagagaaggaagccacctgataacaagctcaaaggcaccaagatagagtacactctcagcgtatttaaggaagagagagaccagtgtgacttgactggagttaacaaggggaaaagtgggaaaaaataaatttagagaggtagccaggggccagggcaaatatagccttgtaggccatgctaaggactttaggtattactcttagaagaaatgatctgacttaaattttcacagtatcactgagtgctctgtggagcrtgactatagacaggcaggtgtggaaacagggagatccgtttaagtaggtaggaggacaggtgctcaataaatatatttatgttgcatattgaaatatgtgtctgtctgccagtattttgctgggtgctaggggtacaaagattaataaaaagagactctttgtagtgtaaggaaggagattgccattgatatatttgggttctgttgatgatattcatttatcctggagataaactattgaatattctgtggaggactgaagaaaacagactcattgaattttcaggatcgaagaggatt

SEQ ID NO: 120701 - DNA, 601 bp, Human
attgccacatatgggatttgtgtgggctcactctgtattggggaagagaacccgtgtggaactgtagttctttctccttgaaactttgttagcaagaatcaatgtggaaatgcaaaaagaaaataaaaaagaagtgagacccactaacaaggttgtaaaattcctgaactaggacaaactaggagggtaatccttccctggaatatttgtttacctcttctagaaagctcatactgattcagttgcctaggagatttttaggattattaaccttgtagtctctgttcaagacttcagggcaaaaaaaaaaaaaaaaactacagggctaaactttaaaatgaaaatgagtttgttatataataagggctttaccaagtttgatagttttattaggggtggctaaaacattttagagcataatttctgaatttcacaggcagttcagtgcttatctcttctaaagaatggcttaaggagaaagtcccactctcattttttactaagtaattattccatttatattcttgtgtcatttgagttcacaacataaatctgtagttgggaagtaaacagtcatatctgcaaaagtgaattttaagtg

SEQ ID NO: 120702 - DNA, 601 bp, Human
actttattaaggttgatggtgaataatctgacagacttttctataggagtcagactgaaagcctgccccccacccttttttagaggcagagtcttgctaggttgcccaggcttgccttgaattcctgggttcaagcgatcctccctcctcagcctcctgagtagctaggactacaggtgcaccaccgcacccatctgaaagccccatctttagcatatgcatagcatacgcattttgctcttttcacttggatcttcattctttctgcctgtttgccacccctctaaccagtctcctgagyctgaggcatagaacagtctggctcaatgtgcttggttaattggtgcgtcatctagtcctcggagacccctcttcatcatgaccagtgttttattgaagtggtttgaatgatgtgctgaatgatgaaagcaaggaccatggcttagaaaaatgtctcaacataggtaaagaacatagtcagagaacaacacaaggtcattgtcactgtcatccaagtaacatcatcttctgaagttttttttttttttttttttttttgagatagagtctcgctctgtcacccaggctggagtgcagtggc

SEQ ID NO: 120703 - DNA, 601 bp, Human
gatcttctatacgtataagtaaacacataaaccatgtagagctgtgtaaatgtaaataaaagtatttaaaaggtggcatgggccatgtgtggtagctcacacctgtaatcccagcactttggaaggccgaggcgggttgatcacctgaggtcgggagtttgagaccagcctggccaacatggcaaaaccccgtctctactaaaaatacaaaaattagctgggcatggtggcaggcgcctgtaatcccagttacttgggaggctgaggcaggacaattgcttgaacccaggaggcagaggtygcagtgagccgagatcacgccactgcactccagcctgggtgacagagtgagactccgtctcaaaaaaaaaaaaaagtggcatggatcacccagcccagtacccttgacagaagcttctggagaaatttgatggcgagtttgtcattttgtcattttctttccaatatcatttttagattcaagggctgttatcctaatttttgaactgttaaagagcttagactggattaaccagaattcagttcacatattggcaccaacacttataatcagtgtgatcttagccagttcagtttgtca

SEQ ID NO: 120704 - DNA, 601 bp, Human
caggacaattgcttgaacccaggaggcagaggttgcagtgagccgagatcacgccactgcactccagcctgggtgacagagtgagactccgtctcaaaaaaaaaaaaaagtggcatggatcacccagcccagtacccttgacagaagcttctggagaaatttgatggcgagtttgtcattttgtcattttctttccaatatcatttttagattcaagggctgttatcctaatttttgaactgttaaagagcttagactggattaaccagaattcagttcacatattggcaccaacacttayaatcagtgtgatcttagccagttcagtttgtcactccaagtgtcagtttcttatgtataagttgaaggtaacattagaattcattcattccttaaatatttattgaacaccttttacatgtcaaacacgttattaagtgctgggatacattggcaaacaaaataggcatattccctttccttgttgagcctacaatgtattaagggaggcagaagataaacaataataaacacttatgttttttgaaaggaagattagaaatatattcaatattctaggctttttcatgaacacttttat

SEQ ID NO: 120705 - DNA, 601 bp, Human
ccaactagtgaaacattttacctgttgaccaaagtttttgctgaggaccatcaaaaggtgaaaggatctgaagggcccaaagacaaaggaaatttccatggaagattttataggaaagtggggaggatgtaattctggaatccttgtcatgggtcctcccctcccactgaaggatgctgaggaaaagaacatgtaacagtttctgtcactcattcccctgctcttactcccttttctgtaattctgtcttgatttttttccactgtcttttttttgggcggggagggggggggtctaaaaytgtgtgtaacttaatgcaaaaggagctgttaaaatgacctttggcagatgatggattgactagttcagtcctttgcaaggtctgtgaagggatccagctgtctcatattaccatgcctaaatgtgcattttccaaggttgtcagtgattgtagtgaatgtgaaactggcagacaaagtgaagtgtttcccactgaataaagcattgttgagtttgctttgtgttcagagctgtcgggaacaaccatgagattgacaaaacaagatggaacaggtgctagcagtcccagctaagcattttg

SEQ ID NO: 120706 - DNA, 601 bp, Human
cataagtagggactgaaggactgtttgtctcagatttttttctgtagaagacacagatataaggttagacaagatgcagtcatatattcatttggtcactcagcaaatatttttttgagtgcctagtatgtggcaggccctgtgctagtcactggggacactgctgagaacaaaactgacaaaatccctgctttaatggagcctacattttaaaaaagaatacttgatcattgtacctttttagacaaataagcgagttaagctgcacatggtgacgcacaccagtagtcccagctactcrggaggctgaggcaggaggatcccttgagcccaggagtttgaggctgcagtaagctatgatcatgccattgcactccagcaaccgagcaagactctgactctaaaaataaaaaagaaaataaataaacaaacaggatgatatgctaggagtaactgagtggtattggattacttttgagttgagatctgaaagataagaaggaaccagtcttctggtgacatgtctcaacactaaaattctgagtctatgataattttgggaaccatgtctgccaactttgagatatccagtggtaaaaac

SEQ ID NO: 120707 - DNA, 601 bp, Human
cagcactttgggaggctgaggtgggtggatcacttgaagtcaggagtttgagaccagcctggccaacatgatgaatccccgtctctactaaaaatacaaaaattagccaggcgtggtggtatgcacctgtaatccaagctacttgggaggctgaggcaggagaatcgcttgaacctgagaggtggaggttgcagtgagccgagatcatgctactgcactccagcttgggtgacagagcgagactccatctcaaaaaatattttttatgggtacatagtaagtgtacatgtgtatggggtayatgagatattttgatacaggcatacaatgtgtaataatcacatcagggtaaatggggtattcacctcaagcatttatcatttctttttgttacaaacattccaattatacttttagttatttttaaatgtacagtaaatttttgttgactgtaatcacctgttgtgccatgaattactagaattttattcattctaactttatttttgtacccattaatcatccccactcttctccttgccaactacccttcccagcctctggtaaccatcattctactgtctatctccatgagttcaat

SEQ ID NO: 120708 - DNA, 601 bp, Human
atacccagatattttcattagtattctgtgagtagagctgttgatggaaatcaacatggaacggttaaagtgtctgtaaagctacaaaagtgggtatttttaaattgagggttttttccccttttttatttatcaattagctgccttatacttactatggcctagttaaaattgtatattccatttaaacacagtatctaaccaaaaagttactcagctagggtttttggtttaatgtagtatagacagattaatatacacatacacaaacataaacacacgcatatatatacacacacayatgcttatatatacataagtatacacatacatacacacacatatgcttatacatacataagtatatacatatatatctatatatatacacacttacacacacacaaggaaaaaaagaaaatgatgtaagtgaaatagcgtatgggagaggaaggagaattatgtgttttgggacagcagggttagaaagaccaagaaacatttaaagattcaaaacaatagcatttagcctgaaatctactttttatcatctttacccagccatcagaatgaagaaagacagtgtccagctgtagcagta

SEQ ID NO: 120709 - DNA, 601 bp, Human
ttaaattaatttgtaactctttttttttttttttggtcctgcattactaaatcctccacatttaattgaaaccctacttcaagacgctttgtgtttctgtgttctttgttgtcagtttaacctccaaagcactttaacaccggtaaattgctgttatatcctttggattgtttttaaaccattcagtaagagaacagtgaaattgatacatggggaaaaaagtaaaatcttagagtagattttgaggtatttaatatttattatggttcttcaccagcatagtttcagatgatttaaactytttctctaggactgtgtaaattggtcttgggatgaaatctcacctagggaattttatgtaatccagtagttaagtctgattttttaaagtttccctgtgtctgagtgttccaaagtggctgctgcatttctataaaatgaagatttaactgcagcgcacaatctaaatgcaaaatccttagatggaaatttaattgtgtaaaatgtacacaaggtaattaagaacaaattttagaacatttcagactataaagttgtcattcagctagatcactggctatattgaaaatgcttattttca

SEQ ID NO: 120710 - DNA, 601 bp, Human
cttcaccagcatagtttcagatgatttaaactctttctctaggactgtgtaaattggtcttgggatgaaatctcacctagggaattttatgtaatccagtagttaagtctgattttttaaagtttccctgtgtctgagtgttccaaagtggctgctgcatttctataaaatgaagatttaactgcagcgcacaatctaaatgcaaaatccttagatggaaatttaattgtgtaaaatgtacacaaggtaattaagaacaaattttagaacatttcagactataaagttgtcattcagctasatcactggctatattgaaaatgcttattttcaatttgtagttatgccgagaaacatagaatatgtctaaattaagaataaaaaaatccagtgctcttcagtagaactgtaaatttaaaactactcccacaacatagttgatattctgagtaggagacttgattactaaaaacatgtcttgaatttgtgtcctgcacttgttttctggctacaatgtttgttttctctttatcatttatgattctatgacaataattatttttattatcaacaaaagccattctgttgctttgtcaataaa

SEQ ID NO: 120711 - DNA, 601 bp, Human
tgtagttatgccgagaaacatagaatatgtctaaattaagaataaaaaaatccagtgctcttcagtagaactgtaaatttaaaactactcccacaacatagttgatattctgagtaggagacttgattactaaaaacatgtcttgaatttgtgtcctgcacttgttttctggctacaatgtttgttttctctttatcatttatgattctatgacaataattatttttattatcaacaaaagccattctgttgctttgtcaataaataacttctttttgttaaaatacaaagatttttatcrtgttatatatttggcaattgttatgatctctctttcacgcacaggcacacatacaaatatatttgttatttaaattataaaatccaacatattcaaatgctgctaactgaagagcattttatagattgtggttggccaagtcaaaggtcaataagatgacactaaggaacgtcctatttttagagtgagatgttagttgtttactgctatttaagtgtatccccaactggtaacacttcagaccattctttttcagccttttacataataaacgtcccgcaagagagtcttcagcagttt

SEQ ID NO: 120712 - DNA, 601 bp, Human
tgctccttcttccccataagggtcccatgtttattttgacttttgacagcctcgtggagaactcgttcttttttatttatttatttatttattttttgagttagggtctcactcttgctcagtctggaatgcaatggcatggtcaaggctcactgcagtctctacctccccgggctcaggtgatcctcccacactagcctcccaagcagctgtgactacagacacgtgccaccacacgcctctcatttttgtagagaactcgttcttcatgcagccatatctactaagaaaccattttctkttttacctcctcccaatagaacttgataaaaagagttctagagcctggctatatgtttccttctacttttctataagacaaatagtgtggaacataaacactgtagctgcattagacctagagggatagaggcatacatagaaggcagcggtcctctcctggggccttaaaatgactgctttcagtgccagcctaatagtgcacttgccagttttcactggcatagattcccaagtctttcaacagcccagtggtgacactctgtaagagaggaagtgattgtcatcatgctgcaattgc

SEQ ID NO: 120713 - DNA, 601 bp, Human
gatcaaagaaccattctctgtcttctaactctaaagaggtcagacctgcaagatgtcttacaagcagtcctcccaggaacatagttaaaaggtaggactgaggttccacaagatgtcaggaaataacactgaaagcaaagccagacccatgaatgatgagttcaccagttcaagcactggcacctgttcccaagcagactggtacagagaggctcccagctgaccaaactgcactaaattttctctctgttgtcttgcatggcattgtcttacagagcaaacaaataacatcagccatccttttttaccttgtacagtcatgacagagagggccaagtagatgaatgcacattcccaagttggctggagcctggcctctctgtagaaccatgaccacttgcaaccggaagctttgtgttgaatcgggaagaattcacattttttgctgtatctcactccgttttaagccgtccatttaccattgcttaattctttaaattgcaagaaccaatggtcagtgttggcacctgccagctagtttagatcttgactatatgtgtggtgggcaagtttcctctgtctttaagccatgtgaacagaa

SEQ ID NO: 120714 - DNA, 601 bp, Human
tggcacctgttcccaagcagactggtacagagaggctcccagctgaccaaactgcactaaattttctctctgttgtcttgcatggcattgtcttacagagcaaacaaataacatcagccatccttttttaccttgtacagtcatgacagagagggccaagtagatgaatgcacattcccaagttggctggagcctggcctctctgtagaaccatgaccacttgcaaccggaagctttgtgttgaatcgggaagaattcacattttttgctgtatctcactccgttttaagccgtccatttrccattgcttaattctttaaattgcaagaaccaatggtcagtgttggcacctgccagctagtttagatcttgactatatgtgtggtgggcaagtttcctctgtctttaagccatgtgaacagaattattccatggtccctgatgacatgctgagcatatacccaagtgaatggcgcaatgcctgtggaaggtcttgagctagaatgttctaagtgctttgtagtagttattaagctattagcttttttaggtgtgagactctcctcttgctggttttctaactccaaatggaagtatatgc

SEQ ID NO: 120715 - DNA, 601 bp, Human
acaaatcaagttagattggaagctttcagacttagacctacagttctgacttcacaaccttgaaatggccatttttcccactagtgggtagaaaatggatgaaaaaactttaacaaatggatgaaaataatggcgcagttttcaatttcataataatgtccattccccacttcctactaccctccatttatacttgtaactgaaaattttgtgggttagtaacaattagatgttcccattttacaagactaaaagcaaagagtttttacatctctgtctagaagaaactgtcacacacacrtaaatgtgaataatgcccatatagctgagaatattactaagggaaaccacataaggataatgttttgttattaaaattaaaatattttatcaggggtgcaacatcgtccattgaaaatgtccattctaaatacagctcttaatgtaattacagcaataatttagtttgtacattcaaggttgtgaacttttttatatttgctggatgcagttctgaaatttagtacttgtctgtcttaaggagatctgccctgcatgcaaatctataactagacaaatattatttcctttcccagcttgc

SEQ ID NO: 120716 - DNA, 601 bp, Human
gttgatgttcactgtttttctggcatcttggtctgtacaggccaaagtgcctagaggcatgtctgatttaaaggtggtgttggtctctgctctttaagcatctattaacttgctattattatgcaaataagtgttgtattacacatactaatttatgcatggttagattatgcagatgcatcacaaacatggttattgaataataggatggggctcattctctctaccatctttataagcagttttaagcaaattctcctggtaccaatgtggacatttaaagaccctttactcaatgaartgtctctttcgtattcttttgctttcatagttaaagccatcagataagtggaagagaaatcgtccaagttgttaggttcaagagtgttagtctcacttttcaaattcgtagacttttttgtttaaatgtaatcttttccttatagagaaaatctaaaatgcagttgcttggcatgaatgctggcatttagtgagattttagtgtatatagccttgctgcttagctctaggtaacccatcaaattaaaattacattttcaggatttatagctcattagaatatttatcttggtaagcttct

SEQ ID NO: 120717 - DNA, 601 bp, Human
agagggtaaagtggggaggaggggccagcttcaagacttgtctttcccccagctcagtgtcagtgctgctgacagcatcattagcagcccctcttcctgctggtgacacagtgtgtacccagtgaggtcgcagagagggaggagtgttgggaagatactagggacagtcagtgccctgggagcaacataaaggttaaagggctgggtttttgttgagatagccattctgtatgagtttcattgttttgtgggttgggtctttgttatttgaaagcactgttttagtttcctttaggccttygggttgcataacttccttggcatgcagtttagggttctaaagaaaaaaaacatgaggagcacagtcttattactactgcctataacaggaaaaacaatggtgtcttggcttcacctggcacctttcccacatagggttccagtctcaggctgttacctgactcaggctgtgcattctacctgcagggacttatttccagcctctaggtgagccaactcaggctcagagaggcaaagtaccttgctttaggcaggaatgggtacagttaggtctaggacttgcagacaaataagccaactc

SEQ ID NO: 120718 - DNA, 601 bp, Human
ccttgggtaagagaaatgtgtgttcaacccctatatactacatatcaaagtatgagaggagctgtaggtggcatttgcttcagaacctcctgctattaaccaaggaaatacgttttgcaaatgctttttgattaccaataacatttgtttgatttgggagctttgccttgcttcagcagattcttgctgtgctgtgactgctgctagtgagacttactcataggtcaaaaagctacttatctgagcactttcatttaaaaccgattaatttatttgctgcatctgaaagtttgctaaatarttgggtagttttaattgaaattactgctttctgatccttgtattaacatgatctaaggtcctttttattatatgcaatccatattattgaccagatttgccctgttttcatttaaatgtaagcagcttgtcaaggagaaaatattttgtttaacttggcttggaaacgtgctattttaatgtgttttgtttttttcaattgacagactgtcttttaaacattcatttattttgtagtaataaattgtgctctggatagagtatgtgtttcagaatagagtagaaagcatatgttcttaaa

SEQ ID NO: 120719 - DNA, 601 bp, Human
tcttagattacagatgaggaaataggagtccacagccattaaatgactcactcatgattaccaggtattcagcaacagggccagactgtctcccactcacagtgcagtggtctttttactttagagggatggtgggggagaaagtgagataaggcatccagagactgtgagtctaaatggccgtccttattttacacacatatccactcaagtactgcctccaactggtgtgtctgcagagatgaaaattactgtcccaggatgctctgtgcctgccaggtaattgctgactggctatggrtccctggggggagaatggtcctcaacagcagtagtagcagcagcaacagacaaagacatcaacttttattatactccagtgttttacttatcaccattcagtatggaaaacttgggtagatttggggataggggctcattggcttccaagttaaaaaggggacagacctggccgagctttgtttgagcatagattactttttagatgtttaacagttatggattaatgcgtgggaggtttgggaattcttcctcaactaaaatgttaatgatgctaagaacccaaccctcttcagtgcca

SEQ ID NO: 120720 - DNA, 601 bp, Human
tttgttttctgttcagaaacaagttgcagagagcactcttctgggcataaggcatgaggcgacctggactccaggcctagttggtaaaatcctttaatcaaaagaaagttcctggccaaaggcctccttccaggccctgctctttggatagccctatgccttcttggtagccaggcagctggaaacactcagtgattcagggtagagggcataggaggcagcaaatgacacacccgacaagtgacaaattaagtcactgacagtatatgatttctacccaaacatacgcacagagctaacytgagttctggtcttggcttttcttattagttgcttgaccttctttctttttggacttcagcctcctcacctggaaaatgatggaaatgccctaggttagtaatttacagaattgtgggtagacagtgtatagaggagatggggatccacccacatacacatgtacacacaaccacacgagcagctctgcttctatctggtaatttttaaatgcatctaagtaataccttatttgaactagagttatttcgtaaacagagtctgaaaaatgctggacaggatatttctatggtctgctttc

SEQ ID NO: 120721 - DNA, 601 bp, Human
tcacctggaaaatgatggaaatgccctaggttagtaatttacagaattgtgggtagacagtgtatagaggagatggggatccacccacatacacatgtacacacaaccacacgagcagctctgcttctatctggtaatttttaaatgcatctaagtaataccttatttgaactagagttatttcgtaaacagagtctgaaaaatgctggacaggatatttctatggtctgctttcaccttagatgagcagcttcctcctcctgtccacaccttcagccctcttgctcatcaccatctcccyccgattacttccttgaagtttactgaaacctgattgtacctatatcaaaatatgggaggtgtgaagtaaaactctgaatcaaatatcaaacattggagccaggtgtgctagctcaaacctgtaatcctagcactttgggagcccaaggcaggagactcacgtgagcccaggagtttgagaccagcctgggcaacacagggagaccccgtctctacaaaaaatttaaaaaccagctaggtgtggtggcatatgcctatagtcccagctattcaggaggctgaggagggaggatcacttgtg

SEQ ID NO: 120722 - DNA, 601 bp, Human
taggctgcagtttcattggaccagttcaactccctgtgcccaggggatttagatgttgctgactaatgtaggtctgaaccacctaccataccctagagctgggggtgaagtcatcttcccatggaacacacgggcttcttgggggtgggggagtgttgttggagtatccttagtaataaaggggagaaggatagagggcaaccaaaataccaactgatcataaggaagaaaacagggatgttcattcaagaaagacaacattgtggagacatgactgctatcttcaaatatatgaagagcygtcattaaacttatatgccatagctccagatcatgggcacatcttacagaaagacatacttcttggattcaaaataagaaagaactttttttttttttttgagagggagtcttgctctgtcgctcaggctggagtgcagtggcacgatctcagctcactgcaaactctgcctcccaggttcatgccattctcctgcctcagcctcccgagtagctgggactacaggtgtctgccaccacacccggctaattttttgtatctttagtagagatggggttttaccatgttagccaggatggt

SEQ ID NO: 120723 - DNA, 601 bp, Human
aaacacataagagtctgccttacatcagaatgagacgtaactatcccctgttagtgtggttttaaatcttgaatctaacagctaatgaaagaaaaaaaaaaatctatgcccagaaaagggaagaggttcatctatcaaaatgcaactagttctagagactgattaacaaagtgtgtgactggaacaattactgttctctcattgtcccaaagtactagttagacatagaaaacactcaacacacgcaaaatgtataagcaggaatgagggcttggacaagttagttataaacagcatttcrtatgttgtgaggtgcaggcagtacatcagccctaacaatattattgcgttcctctgaactctgctctcacagctaagcatttggaaggcagacccagaataaagataggcattcacaaagccaacattttatattgaggacccttggttccacttttaatgtgctataaactaggggcttcactttttcatgaactgtgtgcaaaagcagaggcaatgactggaggttgactgtttggatctgttttatggttgctgtgcctatacagtaatgtgatcttgaaaaaggtaaacaacaaag

SEQ ID NO: 120724 - DNA, 601 bp, Human
acttccatgaatttgattttcccagagagcattgctgccctggaaacaggcagaaggaactttggaaaaggtggagttgttaccccactcctaagttaggtgcaaatacttcaactacataattaaagttttcctcacaaaataggggattgtgagcagacactggcaggaatccaaaattctaatttctgactatgatttaatttcaattttaaataaatcggtttttaatttaaaaagagtgagcttcgtaacattagcaatgattgcaacattaagcccagtgttcacaatctagcartataaaacattatttatatctgaatcgtaaacagccttttgaaatggattatggtttttctccctattctaatacaacctggagggtactaaaaagtgttgtgtgaaattaacattctgctgactttcgcctataaatgagaagcgagctattaacatttgtgtattttcattatgtaaattgtgttaacacatgcccacaaattgccaccagcaatgcaataattttctctcagtgatcataatgtgtccaagtgagtcattttgattatgacatgctaattacatattgccttttttc

SEQ ID NO: 120725 - DNA, 601 bp, Human
aagaccaaaagaaataaaagacatcattcctgctctgtaagaattcataggctagtaaggaaagaaagatatataaatatctgtaatacaacatggtaaacaggaacaaggtgacgactgttcctgaccatttcctgtatcctttagatcaggaactctcaacctttgtgcacgtgtatgtgtgtgtgcatgtaccatgtaccccttggacaatcaagaatacaagaaaccttgtattctttctcagaataatgtttttaaatgcataaaatacacaggattataagggaaattaatggcrtgaattacatttattaaaatgttaaagtggcaccatggtaatacatgcatgtatttattaatgcattatgcagcaagatccagcaggaacctaataacaatgacaattttgaagtcttttttttttttttttgagatggagtctcgctctgttgcccaggctgaagtgcagtggcgcaatctcggctcaccacaagctctgcctcctgggttcatgccattctcctgcctcaagcctcctgagtagctgggactacaggtgcctcccaccacgcccggctaattttttgcatttttatta

SEQ ID NO: 120726 - DNA, 601 bp, Human
catgcccagctaacttttgtatttttatttatttattcatttatttatttgagatggagtctcactctgtaacacaggctggagtgcagtggcgtgatcttggctaactgcaggctccacctccggaattcatgccattctcctgcctcagactcccaagtagctgggactacaggcgcccgtcaccacacccagataatttttttgtatttttagtagagatggagtttcaccgtgtcagccaggatggtctccatctcctgacatcatgatccgcccacctcggcctcccaaagtgctrggattacaggcatgagccaccgctcccagcctaacttttgtatttttagtagagatggggtttcaccatgttggccaggctggtgtcgaactcctgacctcaggtgatccccctgccttggcctcccaaagcgctgggattacaggcatgagccactgcgcccagccagtttgcataatctccaataactagtcttcaagttcagtgacagattttttttctgctgtggccaacctgctcttaagcctagccaatgaattcttaatttaaaacattatatttttcaattgtagaatatcc

SEQ ID NO: 120727 - DNA, 601 bp, Human
tgcgcccagccagtttgcataatctccaataactagtcttcaagttcagtgacagattttttttctgctgtggccaacctgctcttaagcctagccaatgaattcttaatttaaaacattatatttttcaattgtagaatatccatgtccttttttagagatttaatttctctattgacattatttatcttttcgtccattttttctaacttttcttttatttttctttaacataattacaaaaatcatcttaaagtccttgtctgctaattccaacatctgggttacctgtaggactgtytgtgttgtctattttttctcttgcttacaggccacatttttctacttctttgcatttttttttaatattaagcataaatagccatagagtctgatgtagatattatttttcaccagaaagagaacactctttcttctctcaggcagctaaggtgatggactgatcactttgatccagtctgatattgagctggatcagttcacttttcgtttcaaatatcagctgagcatagtggctcatacctgtcatcctagcactttggtaggctgaggcaggatgaccacttgagctcaggagttc

SEQ ID NO: 120728 - DNA, 601 bp, Human
atcagctgagcatagtggctcatacctgtcatcctagcactttggtaggctgaggcaggatgaccacttgagctcaggagttcaagaccagcctgggcaacatagatctcatctgtatttttttaatttttcaaattttaatttaaaaaatacttttgcccaggcgcagtggctcacgtttctaatcccagcactttgggaggccaaagcaggtagatcacctgaggtcaggagtttgagaccagcctggccaacatggtgaaaccttgtctctaccaaaaatacaaaaagtagctgggcmtggtgtcacacacatgtaatcccagctaattgggaggctgaggcaggagaattgcttgaactcaggaggcagaggttgctgcgagccgagatggcactccagcctgggtgacagagcaaaactctgtctcaaaaaaaaaaaaaacagtttcaaatatcttagagtcatgcctgtcttgtgtttattacaggcccttttttcaagcagccttctctttctcaaatacaacaatattatagggtatctttctctgaatttcaatctagccttctttactgcccagaacttagcaaaaatcct

SEQ ID NO: 120729 - DNA, 601 bp, Human
tcaacaaatgccctcatagaggaaagcagtcatgaatctccactcactttgggagggtcccttctgctctggaatttaattccattagatttccagccttccagtatctctaaaaagaaatatatatgatttttagtttatccatatatattttttctaattgctatagtggacacaatggtctactgctcccctcttacatcctatatcctaaccaccaattctaaatattttaaattcccattacaatgtcttattttattcatgagttattaaaaaaaaaaaaccaaaaaacaaaaaaccttttaaggccgggcacggtggctcacgcctgtaatctcagtactttgggaggccaaggtgggaggatagcttgaggccaggaatttgagaccagcctgagcaacatggcgagaccccatctctactagattaaaaaatacataaaaaataaaatttaaaaaaaaaacaacttaaatttgtacatttgtaatttccaagtatattgttttaaatttgatcattttgttaattttaacttaattatatgttgatttatggcctatatcagggattgactaattacttctgtaaagggcca

SEQ ID NO: 120730 - DNA, 601 bp, Human
aattgctatagtggacacaatggtctactgctcccctcttacatcctatatcctaaccaccaattctaaatattttaaattcccattacaatgtcttattttattcatgagttattaaaaaaaaaaaaccaaaaaacaaaaaaccttttaaggccgggcacggtggctcacgcctgtaatctcagtactttgggaggccaaggtgggaggatagcttgaggccaggaatttgagaccagcctgagcaacatggcgagaccccatctctactagattaaaaaatacataaaaaataaaattwaaaaaaaaaacaacttaaatttgtacatttgtaatttccaagtatattgttttaaatttgatcattttgttaattttaacttaattatatgttgatttatggcctatatcagggattgactaattacttctgtaaagggccaggcagtcacaattgtaggctctgtgggccatatgatctgtgctgttgtaacaaaaaaggagccatagacaacatgtaaatgaacgggtatggcttggttctaataaaactttatttacaaaaataagtgacaggttggatttgtcctgcaattcagtt

SEQ ID NO: 120731 - DNA, 601 bp, Human
ttgtaatgtggatttgtcagagtatttctgtaggtctaacaattcttgctttaatatttagaggttaatttattagaatattaacatctggccaggcacagtggttcatgcctgtaatcccagcactttgggaggccgaggcgggtggatcacctgaggttgtgagtttgagaccagcctggttaacgtggtgaaatcctgtctctactaaaaatacaaaaattagccgggtgtggtagtgcactcctgtaatcccagctactcgggaggctgagccatgagaattgctccaacccgggargcggaggttgcagtgagctgagatcgtgccactgccctccagcctgggtgacatagtaagactctgtcttaaaaaaaaattaatatcttaattttaagatattaattttaaatgattaaaattatttaattattaattaacataataattaaacatcaaatcattcaatcatttaattaataataattataactataactattatctttatatataattacatataataggatattttatatatctatatatatcctacatatatgtaggatggaagcgaaggattgataaatgtatctt

SEQ ID NO: 120732 - DNA, 601 bp, Human
ttaattttaaatgattaaaattatttaattattaattaacataataattaaacatcaaatcattcaatcatttaattaataataattataactataactattatctttatatataattacatataataggatattttatatatctatatatatcctacatatatgtaggatggaagcgaaggattgataaatgtatcttctcccaaagaagacaagtatttcagcatgcttttatgtattttagtctctcttacccctatagcccatcatactgaaatggtctagaattttagttatgtgytattattcataaactttcacttatttggcttcctctaagtgttttgacggagagatattatgtggcaagctgagggtttaaatcactgagaatatttttattatgccatcatatttgaatgctaatttcgctggatataaaattctagattcaaagatccctttcttctgttctttaaatctattaccttattcttttcttgcatcattggttgcaagtctaatgccaatctggttcttgtttctttttgagtaatctgttttgtgtctctgaaagcatttaaaattttctttttggctg

SEQ ID NO: 120733 - DNA, 601 bp, Human
attcataaactttcacttatttggcttcctctaagtgttttgacggagagatattatgtggcaagctgagggtttaaatcactgagaatatttttattatgccatcatatttgaatgctaatttcgctggatataaaattctagattcaaagatccctttcttctgttctttaaatctattaccttattcttttcttgcatcattggttgcaagtctaatgccaatctggttcttgtttctttttgagtaatctgttttgtgtctctgaaagcatttaaaattttctttttggctgggtgmagtggctcatgcctataatcctggcactttgggaggctgaggcacgaggattgcttaaggccaggagctcgagaccagcctgggcaaaatgttgaaaccccgcctctattaaaaatacaaaaattagccaggcatggtggtgcccacctgttgtcccagctactcagaggctgaggcaggaggatcacctgagccttgggaggtcgaggctgcagtgagccatgatcatgccactgcactccagcccgggcgacagagtaagaccctgtgtctaaataaataaagaaataaataggattc

SEQ ID NO: 120734 - DNA, 601 bp, Human
catcatatttgaatgctaatttcgctggatataaaattctagattcaaagatccctttcttctgttctttaaatctattaccttattcttttcttgcatcattggttgcaagtctaatgccaatctggttcttgtttctttttgagtaatctgttttgtgtctctgaaagcatttaaaattttctttttggctgggtgcagtggctcatgcctataatcctggcactttgggaggctgaggcacgaggattgcttaaggccaggagctcgagaccagcctgggcaaaatgttgaaaccccrcctctattaaaaatacaaaaattagccaggcatggtggtgcccacctgttgtcccagctactcagaggctgaggcaggaggatcacctgagccttgggaggtcgaggctgcagtgagccatgatcatgccactgcactccagcccgggcgacagagtaagaccctgtgtctaaataaataaagaaataaataggattctactttagaaattttatctagcttttttcatttattattatatattacaaaaaggctttcccactctccatcttttgtatttttgtagctccttataagcct

SEQ ID NO: 120735 - DNA, 601 bp, Human
ctgtgtctaaataaataaagaaataaataggattctactttagaaattttatctagcttttttcatttattattatatattacaaaaaggctttcccactctccatcttttgtatttttgtagctccttataagcctaaataaaatactatttaccacacaactgagtgctgataaaagtggtttgttttaggccaggcacagggctcacgcctgtaatcccagcactttgggaggccgacacaggcagatcacctgaggtcaggagttcgagaccagcctggccaacatgacgaaacccygtctctactaaaaatacaaaacttagctgggcgtggtggcaggcgcctgtaatcccagctactcaggaggctgaggaaggagaattgcttgaacctgggaggcgaaggttgcagtgagccgagattgtgccattgcactccagcttgggcaacaacagcgagactccgtctcaaaaaaaaaaaaggtttgttttatagtgaactgtggagggataagggacaaagctgggcacaaaaatagatctgatggtagggttaggactgagggggcagaggaaatgagactgacatttcctaggg

SEQ ID NO: 120736 - DNA, 601 bp, Human
tggctttccttgagaatatgtatatttaatctgtattttgtctatgaagctttttgagggctctgtagttctactccacacattgcccactcacccatcccattttcctccggtagctgctacatggaaagtactatggatcaaattggaaatccatctctcctctcaaaggcagctaaagctatgtggtcaggctctgggccccagattccagtcctgatttctgagtctgctttccaggtcagggaatgcactggggctgacgacaaggctggaacgtcccgggattgaagcttggatmcgaactgttggacggcgtctggagttttgcacaaaagagaattgaattgtagatcagctgggaagttactgtggtagtcctggtgccctgcggcctccagcgactggaaccctgtgggagcacatagctggcattttttgctagagattaggaagtcttttgcttcctctgtgaaaaggcttgaattcaatggactgtgtggtaagatgaagttgttttttttttcccttattgataaaaataaaacagagatttggcttgggttattacgcagtggtgggcacatgagcttgctctcca

SEQ ID NO: 120737 - DNA, 601 bp, Human
cacccatcccattttcctccggtagctgctacatggaaagtactatggatcaaattggaaatccatctctcctctcaaaggcagctaaagctatgtggtcaggctctgggccccagattccagtcctgatttctgagtctgctttccaggtcagggaatgcactggggctgacgacaaggctggaacgtcccgggattgaagcttggatccgaactgttggacggcgtctggagttttgcacaaaagagaattgaattgtagatcagctgggaagttactgtggtagtcctggtgccctgyggcctccagcgactggaaccctgtgggagcacatagctggcattttttgctagagattaggaagtcttttgcttcctctgtgaaaaggcttgaattcaatggactgtgtggtaagatgaagttgttttttttttcccttattgataaaaataaaacagagatttggcttgggttattacgcagtggtgggcacatgagcttgctctccagtgtttggcgggaagccagttgaagagcatgtggttacatttttgtccggcatcatcaagagtgtagagaagctgtgattctagcctcaga

SEQ ID NO: 120738 - DNA, 601 bp, Human
actaaggccaagggaagcaggtcagatggaggtagattgcatctcagatttaactggccaatgatgaaaaaaggttttgttttttttttttagacagagtctcgcactgtcacccaggctggagagatctcggctcactgtaagctccgcctcctgggctcacgccattctcctgcctcagcctcccaagtagctgggactacaggtgcctgctaccatgcccagctaatttttttgttttgtatttttagtagagacagggtttcactgtgttagccaggatggtctcgacctcctgacyttgtgatttgcccacctcggcctcccaaagtgctgggattacaggcgtgagccaccacgcccagcccggaaaaggttttttaaagagtgaggtagcacctacctggatcttgtcttgggtgggtgctatggtctgcatgtttatggccccccaaattcataattgaaacctaatctccgatatgataatattagaaggtggggtctttggaggttattaagtcatgagggtggagccctcacgaatgtgattcatccccttataaaggagaccctagagagcttgtctgccccttctacc

SEQ ID NO: 120739 - DNA, 601 bp, Human
cctgcctcaggggcctccaaagaaaactctgacttagaccaatgtgtcccagattcaatgtcactttctataggaagccgttcatgaaccccaggattagatgttgtggcttcctatactttttcttgatagctatcatgattcacaatttgcaactgtgatttgtgtgatttcttaatctctgtttcctccagagaatgtaagctccatgaagacaggatatacgaatagtaggaaaaaaggaagggtttgggtggggaatggtggtgagtcacccttaggattgtgcacaataaaagasagtgaaacaacagattttgtccccaaagaataaaggaaggggagggaggaggaaggaaaaaggtggcctggaatatccattagaacgttggctgccaagtctagcccagctctctctggtgccaaccagaggtttgcctgctctattttggccacagagtgggcatttcatctctccacgcattttaaaatcctagttgtttctttttttagctctgagctacttacccgctctaagcctcagctacagcacccataaaacaaagaattaaggctccatggctgaagagacctaagtaca

SEQ ID NO: 120740 - DNA, 601 bp, Human
tggggaatggtggtgagtcacccttaggattgtgcacaataaaagacagtgaaacaacagattttgtccccaaagaataaaggaaggggagggaggaggaaggaaaaaggtggcctggaatatccattagaacgttggctgccaagtctagcccagctctctctggtgccaaccagaggtttgcctgctctattttggccacagagtgggcatttcatctctccacgcattttaaaatcctagttgtttctttttttagctctgagctacttacccgctctaagcctcagctacagcaccsataaaacaaagaattaaggctccatggctgaagagacctaagtacaacacccagctctgctactgttgcatttccatgagtgcctgaattaactcctgtaagcgtcggcttccctcctgaaaagggtttctactcctaatcttgttgggacacttccaggaatcagggcacatgaagtccttagcacaatccctggctcaatgcacatgagtggccattgtcatcaccatcttcaatatcaccgtcctcctcaccattgtcaccatttctgtccccacacccaaggtttctgaggtctca

SEQ ID NO: 120741 - DNA, 601 bp, Human
aggattgtgcacaataaaagacagtgaaacaacagattttgtccccaaagaataaaggaaggggagggaggaggaaggaaaaaggtggcctggaatatccattagaacgttggctgccaagtctagcccagctctctctggtgccaaccagaggtttgcctgctctattttggccacagagtgggcatttcatctctccacgcattttaaaatcctagttgtttctttttttagctctgagctacttacccgctctaagcctcagctacagcacccataaaacaaagaattaaggctccakggctgaagagacctaagtacaacacccagctctgctactgttgcatttccatgagtgcctgaattaactcctgtaagcgtcggcttccctcctgaaaagggtttctactcctaatcttgttgggacacttccaggaatcagggcacatgaagtccttagcacaatccctggctcaatgcacatgagtggccattgtcatcaccatcttcaatatcaccgtcctcctcaccattgtcaccatttctgtccccacacccaaggtttctgaggtctcaatgggataaaataacttcataacca

SEQ ID NO: 120742 - DNA, 601 bp, Human
ctcctgaaaagggtttctactcctaatcttgttgggacacttccaggaatcagggcacatgaagtccttagcacaatccctggctcaatgcacatgagtggccattgtcatcaccatcttcaatatcaccgtcctcctcaccattgtcaccatttctgtccccacacccaaggtttctgaggtctcaatgggataaaataacttcataaccatgaagcactgtctgaatgtcaagggcatccaagtgccccatcccctgcccacaagtcctggagtaacatccaaggatgccttccttccycaggacgctggcgcaggctcaaccccttgcaagcctttggtgactcttgattttacgacaaatacatcttttgtctcttctgttttcaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggtgtctcaagtcatcccaaggcaactagggggttg

SEQ ID NO: 120743 - DNA, 601 bp, Human
gtgtctcaagtcatcccaaggcaactagggggttgcctgggctgtgacggcctcacttctgcatgagactctctctctggcttttcgcattaagtagcttcctgtccttctctgtaaaacaaaatgaatgagctgggtgcggtggctcatgcctataatcccagaactttgggaggccgaggtgggtggatcacctgaggtcaggagtttgagaccagcctggccaacatggtgaaaccccttctctactaaaaatacaaaaaaaaaaaaaattagctgggtatggtggcaggcgcctgtratcccagctacttcggaggctgaggcaggagaatcgcttgaacccaggaggcagtttgtggtgagccaagattgcgccactgcactccagcctgggtgacaagagcgaaactcagtttcaaaaaaaaaaaaaaaaaaaaaatgaatgaaggtataatctggcagggtgcggtggctcacacatgtaatcccagcactttgagaggccaaggcgggaggatcacttgagaccaggagttcgagaccagcctgggcaaaatagagagatcccatctctaccaaaattaaaaaaaaaaaaaat

SEQ ID NO: 120744 - DNA, 601 bp, Human
agaggccaaggcgggaggatcacttgagaccaggagttcgagaccagcctgggcaaaatagagagatcccatctctaccaaaattaaaaaaaaaaaaaattagcctgacgtggtggtgcatgcctgtggtcccagctactctggaggctgaggtggaaggatcacttgggcgcaggaggtcaaggctgtagtgagcccatgatcgcaccactgcactccagcctgggtgactgagtgagaccctgtctcaataataataataataatataaataaaaataaaaataaagagctggctgggygtggtggttcatgcctgtaatcctagcactttggaaggccaaggtgggcagattacttgaggtcaggagttcgagaccagcctggccaacatggtgaaaccccatctctactaaaaatacaaaaattagccaggcatggtggcaggcaactgtagtcccagctactcaggagactgagggacgagaatcgcttgaacacaggaggcggaggctgcaacaagaggttgcaatgagccaagttcgcaccaccgcactgcattccagcctgggtgacagagtgagactctgtctcaaaaaaaa

SEQ ID NO: 120745 - DNA, 601 bp, Human
actgagggacgagaatcgcttgaacacaggaggcggaggctgcaacaagaggttgcaatgagccaagttcgcaccaccgcactgcattccagcctgggtgacagagtgagactctgtctcaaaaaaaaaaaaaaaaaaagaaaagaaaaaaagaaaaagaaaataaagagctatccaagtctcaggatcttaaaaggtagatcctggggtttaagcccacttattttacagatgaggcccagagagaggcaaacactttcccaaggatacacagtaatttgtaactgggccaaagctcactatagttaagtctttttgtttgaggtgactgagataatgccatctatgattttttcttttaaggcaaatgctgtgctgatattcctcacagtttgagacttgtaaaatgcctctcttccctgagtacccatctgtcctctactaccctcagggtttgggactgatgctctgcagttgagggacagtgtgcaagattggttaagaatggaggagcctgatttcaaatctcagcttggttagcttacagccatatgaccttgggaagctacttgactgctgtgagcctcagtttcctcatgtg

SEQ ID NO: 120746 - DNA, 601 bp, Human
agatgctctagatcttgaagagggagagaggggcacagttctgcggcgacatgtgcgagtaccagagagagggccagttacttcggggtggagagtatatggagaatggaatgactagctataaaccagcttgcatggtgggctggtggaaacaccagtttctacatgacctctagaccaaacactctctagacaaaaagcaactctgctttgaatgaccttcaaagcgaatgccctgggccagtcccaagggttccttcccctcctcctactccgtctcctgggtaacaacattgtaagmctgggaagaaaggaggtgatagcataatcttctctgtcatgttacagacccagggagcttttaagaaataaataccaatgggaaagaggtaacatgcattctctgcaagtactttggtaactcatagcagtgttttaactagactcgggaagttgcctggggatcagaaaggaaggcaaaaatgtgtgtggaatttgtcaaaatttgttaagcccatatagcataataaggagaacatctatctataaaaacaaagttaaatcataaattatagctgagtacagtggctgacacctgtaa

SEQ ID NO: 120747 - DNA, 601 bp, Human
ttgaagagggagagaggggcacagttctgcggcgacatgtgcgagtaccagagagagggccagttacttcggggtggagagtatatggagaatggaatgactagctataaaccagcttgcatggtgggctggtggaaacaccagtttctacatgacctctagaccaaacactctctagacaaaaagcaactctgctttgaatgaccttcaaagcgaatgccctgggccagtcccaagggttccttcccctcctcctactccgtctcctgggtaacaacattgtaagactgggaagaaaggrggtgatagcataatcttctctgtcatgttacagacccagggagcttttaagaaataaataccaatgggaaagaggtaacatgcattctctgcaagtactttggtaactcatagcagtgttttaactagactcgggaagttgcctggggatcagaaaggaaggcaaaaatgtgtgtggaatttgtcaaaatttgttaagcccatatagcataataaggagaacatctatctataaaaacaaagttaaatcataaattatagctgagtacagtggctgacacctgtaatcccagcactttgg

SEQ ID NO: 120748 - DNA, 601 bp, Human
ttatacactttaaagggtgagtcttttggtatgtgagttatagctcattttttaaaaaatcacatataaataatgtgtacattataaagaatagccttaaaaagttatagggtgagattttaaaagtcgtaagtagactgaatgcagtggcttacacctgtaatcccagcactttgggaggctgaggcagggtaatcacttgagaccaggggttcaagaccagcttgggcaacatagcaagacactgtgtctacaaaaaaaaaaaaaaaattaaaaattaggctggcatggtggcccatgmctgtggttgcagctactcagcaggctgaggcaggaggattgcttgtgtccaagagttcaagtttgaggctgcagtgtgctacgatggcaccactgcactccaacctggtcaacggactgagactctgacttggccttttggagatgtctttgctaatttccacttctattggatttcctctccaaagcatgactctttctttggacatagtcataagcagagaaggttgtagttggtgacgaggtaccacttccagaccaggctccagggaatttcttctagaatgacaggctgccagaa

SEQ ID NO: 120749 - DNA, 601 bp, Human
agattttaaaagtcgtaagtagactgaatgcagtggcttacacctgtaatcccagcactttgggaggctgaggcagggtaatcacttgagaccaggggttcaagaccagcttgggcaacatagcaagacactgtgtctacaaaaaaaaaaaaaaaattaaaaattaggctggcatggtggcccatgcctgtggttgcagctactcagcaggctgaggcaggaggattgcttgtgtccaagagttcaagtttgaggctgcagtgtgctacgatggcaccactgcactccaacctggtcaacrgactgagactctgacttggccttttggagatgtctttgctaatttccacttctattggatttcctctccaaagcatgactctttctttggacatagtcataagcagagaaggttgtagttggtgacgaggtaccacttccagaccaggctccagggaatttcttctagaatgacaggctgccagaaaccttgactgggtgcagtagctcaggcctgtaacccagcactttaggaggctgaagtgggaggtttgcttgagcccaggagttcgaaaccagcctgagcaacagaagctgcagt

SEQ ID NO: 120750 - DNA, 601 bp, Human
ccccctggttaattgctttttagacagttatgctgcgaagtcatcagtgtgtgctggaaataggagtttggctttttcttctctaagagaagccccctctggctgaattttatattgccatgtaaaaatgggcttctgcccattaaaaaaaaaaatttttttttttttttgagatagagtctcattctgttgcccaggctggagtgcaatggcatgatctcggctcactgtaacctctgcctcctgggttaaagtgattcttgtgcctcagcctccctagtagctgaaattacaggcgtgygccaccatgcctggctaattttgtatttttttgtagagatggggttttgtcatgttgcccaggctggtctcgaaaccctggcttcatatgatccgcccacctcagcctcccgaagtgctgggattataggcgtgagctactgcacccggccaatttttttttttttttttttaaattttaacagagacaaggtcttactatgcttcccaggctggtgttgaactcctggcttcaagtgatcctcccacctcatcctcccaaagtgttgggattacagtgtgagccactgtgcccagccca

SEQ ID NO: 120751 - DNA, 601 bp, Human
ttctgttgcccaggctggagtgcaatggcatgatctcggctcactgtaacctctgcctcctgggttaaagtgattcttgtgcctcagcctccctagtagctgaaattacaggcgtgcgccaccatgcctggctaattttgtatttttttgtagagatggggttttgtcatgttgcccaggctggtctcgaaaccctggcttcatatgatccgcccacctcagcctcccgaagtgctgggattataggcgtgagctactgcacccggccaatttttttttttttttttttaaattttaacasagacaaggtcttactatgcttcccaggctggtgttgaactcctggcttcaagtgatcctcccacctcatcctcccaaagtgttgggattacagtgtgagccactgtgcccagcccagaagcccgttcttacatcttaaagagctttgattctccccctggatgttgaaataaaccctggaaaatgtttataggataaattatgttctgagtagcgggctcatttcaaattaatctatgctgtaggtgggtccctctgaagcaaggactacagctgttccaccccgccccccaccaacaga

SEQ ID NO: 120752 - DNA, 601 bp, Human
aagccttcattagagccatttcagcagggagttggctatcatgggggtgtcagtgtaaggcctaggcagttttggctttgggcatgtggaaaacctgcctggattgttctggaagctcagactgtctatgggatgctattttttgcttccgtagttttcctaggaccataattttttttaattttattttttatagatgggatattgccctgtcacccaggttggagtgcagtggcacaatcatggctcactgaagccttgaactcctgagctcaactgatcctcttgcctcagcctcccwagtagctgggactagaggcgtgtgcccccacaaccagccagtttttaatttttttttgtagagacagggtcttgctatgttgcccaggctgttcttaaatccctggcgtcaagtgatcctcctgcctcagcctcctaaagtgctgggattacaggtatgagccactgcacccagcttaggaccttgattatgtgaggtaggacaagaagtgctggaaagatcatccctgccctccaggggagatacacacatggattacccctgattcttacagggactacctgcatgtccatgggctgc

SEQ ID NO: 120753 - DNA, 601 bp, Human
gatgctattttttgcttccgtagttttcctaggaccataattttttttaattttattttttatagatgggatattgccctgtcacccaggttggagtgcagtggcacaatcatggctcactgaagccttgaactcctgagctcaactgatcctcttgcctcagcctcccaagtagctgggactagaggcgtgtgcccccacaaccagccagtttttaatttttttttgtagagacagggtcttgctatgttgcccaggctgttcttaaatccctggcgtcaagtgatcctcctgcctcagyctcctaaagtgctgggattacaggtatgagccactgcacccagcttaggaccttgattatgtgaggtaggacaagaagtgctggaaagatcatccctgccctccaggggagatacacacatggattacccctgattcttacagggactacctgcatgtccatgggctgctatgcaagcttccaggaacttcagtctccttccttatagagtgggattgccccttgtgctctgtcactctgggttccatcccttctcacccactaatagtggggaggaagaagaagagctaatatttatgc

SEQ ID NO: 120754 - DNA, 601 bp, Human
cactgaagccttgaactcctgagctcaactgatcctcttgcctcagcctcccaagtagctgggactagaggcgtgtgcccccacaaccagccagtttttaatttttttttgtagagacagggtcttgctatgttgcccaggctgttcttaaatccctggcgtcaagtgatcctcctgcctcagcctcctaaagtgctgggattacaggtatgagccactgcacccagcttaggaccttgattatgtgaggtaggacaagaagtgctggaaagatcatccctgccctccaggggagatacayacatggattacccctgattcttacagggactacctgcatgtccatgggctgctatgcaagcttccaggaacttcagtctccttccttatagagtgggattgccccttgtgctctgtcactctgggttccatcccttctcacccactaatagtggggaggaagaagaagagctaatatttatgctgtgctttctgggtctgggcactaagataggaggcactttacaggttgttattacagataaagggctgaggagggcctcagtatttgtattcgtatttttcccccagttttccccca

SEQ ID NO: 120755 - DNA, 601 bp, Human
tttgaagtccctaggcgtcaccaatatacttgagtttgggctacatctgttctgacttggggctccccagaaagtttgtctctagcagccctgagattggttgggaccaggacccaccctatcccctgctagtggtaggtggaaaggtggggtgaggctctaatccatctgattcatctcccctttcactggacaagactgatttggcctccactggctccagagcaggcatgctggctacactcccaacactcatttctggaggtgtgacttgagcccattaccaagcatttttattcayccccctgctccctatctggcatcttctgtatgtggggacgtttatcaactctgtgctccttgggtagccttcttctgtgcccagtgacacaggacagctcagttcccagcctcagccagatgccctgggcatgttaggcaggtgggctggtactcacatgtgcctgaggttcccagcctcagttcacctccaataggtctaggtttccttttccatgaagtattccagcaaccagaaagtcaagcatctaaacaggccagcttgcacatgatttttggagatactggaggaggaaggaag

SEQ ID NO: 120756 - DNA, 601 bp, Human
tcccatttactgtcagactggctccctcagaggtctgcaggcagcttgaggtctgtggcttctcttccacatctgaaagttgactggctgtaggcaagggtggtaactgggccatgtgccacacatgttcagcagaataactggggctcattcacatagtggtggttgcaagggttccaagagcagcatgggaagtcaagccccgaagcacaagcatatttctttcttttttttttttttttttttttttgagacagagtctcccactttggctcaggctggagtgcagtggcgtgatctyggctcactgcaagctccgcctcccgggttcacgccattctcctgcctcagcctcccgagtagctgggactacaggcgcccaccaccacgcccggctgattttgtgtatttttagtagagacggggtttcaccgtgttagccaggatggtctcgatctcctgaccttgtgatccacccgcctcggcctcccaaagtgctgggattacaggcgtgagccaccgcgcccggccctgcacaagcatatttcaagtgtctgtttgcatggcattgctattgtcctatgagcccaagcaagtcaca

SEQ ID NO: 120757 - DNA, 601 bp, Human
gggtggtaactgggccatgtgccacacatgttcagcagaataactggggctcattcacatagtggtggttgcaagggttccaagagcagcatgggaagtcaagccccgaagcacaagcatatttctttcttttttttttttttttttttttttgagacagagtctcccactttggctcaggctggagtgcagtggcgtgatctcggctcactgcaagctccgcctcccgggttcacgccattctcctgcctcagcctcccgagtagctgggactacaggcgcccaccaccacgcccggctrattttgtgtatttttagtagagacggggtttcaccgtgttagccaggatggtctcgatctcctgaccttgtgatccacccgcctcggcctcccaaagtgctgggattacaggcgtgagccaccgcgcccggccctgcacaagcatatttcaagtgtctgtttgcatggcattgctattgtcctatgagcccaagcaagtcacatggccagttctggagttgctgtgagtggagactatgtaaaagcatgggtatagggaggagaattagtgtggctgttttttgcaaacaatttaccaca

SEQ ID NO: 120758 - DNA, 601 bp, Human
taactgggccatgtgccacacatgttcagcagaataactggggctcattcacatagtggtggttgcaagggttccaagagcagcatgggaagtcaagccccgaagcacaagcatatttctttcttttttttttttttttttttttttgagacagagtctcccactttggctcaggctggagtgcagtggcgtgatctcggctcactgcaagctccgcctcccgggttcacgccattctcctgcctcagcctcccgagtagctgggactacaggcgcccaccaccacgcccggctgattttktgtatttttagtagagacggggtttcaccgtgttagccaggatggtctcgatctcctgaccttgtgatccacccgcctcggcctcccaaagtgctgggattacaggcgtgagccaccgcgcccggccctgcacaagcatatttcaagtgtctgtttgcatggcattgctattgtcctatgagcccaagcaagtcacatggccagttctggagttgctgtgagtggagactatgtaaaagcatgggtatagggaggagaattagtgtggctgttttttgcaaacaatttaccacaccctcc

SEQ ID NO: 120759 - DNA, 601 bp, Human
tgcaagggttccaagagcagcatgggaagtcaagccccgaagcacaagcatatttctttcttttttttttttttttttttttttgagacagagtctcccactttggctcaggctggagtgcagtggcgtgatctcggctcactgcaagctccgcctcccgggttcacgccattctcctgcctcagcctcccgagtagctgggactacaggcgcccaccaccacgcccggctgattttgtgtatttttagtagagacggggtttcaccgtgttagccaggatggtctcgatctcctgacctygtgatccacccgcctcggcctcccaaagtgctgggattacaggcgtgagccaccgcgcccggccctgcacaagcatatttcaagtgtctgtttgcatggcattgctattgtcctatgagcccaagcaagtcacatggccagttctggagttgctgtgagtggagactatgtaaaagcatgggtatagggaggagaattagtgtggctgttttttgcaaacaatttaccacaccctccctatccattcagctatcatcaggaaaaaattcatatgagcttttctcttgattggcagcagct

SEQ ID NO: 120760 - DNA, 601 bp, Human
tctttcttttttttttttttttttttttttgagacagagtctcccactttggctcaggctggagtgcagtggcgtgatctcggctcactgcaagctccgcctcccgggttcacgccattctcctgcctcagcctcccgagtagctgggactacaggcgcccaccaccacgcccggctgattttgtgtatttttagtagagacggggtttcaccgtgttagccaggatggtctcgatctcctgaccttgtgatccacccgcctcggcctcccaaagtgctgggattacaggcgtgagccacygcgcccggccctgcacaagcatatttcaagtgtctgtttgcatggcattgctattgtcctatgagcccaagcaagtcacatggccagttctggagttgctgtgagtggagactatgtaaaagcatgggtatagggaggagaattagtgtggctgttttttgcaaacaatttaccacaccctccctatccattcagctatcatcaggaaaaaattcatatgagcttttctcttgattggcagcagcttccaaaatttgtgaggcaaaggaagttataaaaaagcagaatctgccaggggca

SEQ ID NO: 120761 - DNA, 601 bp, Human
gctgattttgtgtatttttagtagagacggggtttcaccgtgttagccaggatggtctcgatctcctgaccttgtgatccacccgcctcggcctcccaaagtgctgggattacaggcgtgagccaccgcgcccggccctgcacaagcatatttcaagtgtctgtttgcatggcattgctattgtcctatgagcccaagcaagtcacatggccagttctggagttgctgtgagtggagactatgtaaaagcatgggtatagggaggagaattagtgtggctgttttttgcaaacaatttacyacaccctccctatccattcagctatcatcaggaaaaaattcatatgagcttttctcttgattggcagcagcttccaaaatttgtgaggcaaaggaagttataaaaaagcagaatctgccaggggcagtggctcacatctgtgatcccagcactttgggaagttgaggcaggtggatcacttgagcccaggagtttgagaccagcctggtcaacacagagggactccatctgtacaaaaactaaaaaatgtggccaggcacggtgcctcacacttgtaatcccagcacttgggaagctgag

SEQ ID NO: 120762 - DNA, 601 bp, Human
ggagactatgtaaaagcatgggtatagggaggagaattagtgtggctgttttttgcaaacaatttaccacaccctccctatccattcagctatcatcaggaaaaaattcatatgagcttttctcttgattggcagcagcttccaaaatttgtgaggcaaaggaagttataaaaaagcagaatctgccaggggcagtggctcacatctgtgatcccagcactttgggaagttgaggcaggtggatcacttgagcccaggagtttgagaccagcctggtcaacacagagggactccatctgtrcaaaaactaaaaaatgtggccaggcacggtgcctcacacttgtaatcccagcacttgggaagctgaggcaggcagatcactcaaggtcaggagttcaagaccagctgggccaacatagagaaatcccatctctactaaaaatacaaaaaaataattagccgggtgtggtggcggatgcctgtaatcccaactactcagaaggctgaggcaagagaatcgcttgaacctgggaggcagaggttgcagtgagcagagatcatgccactgcactccagcctgggcaacagagcgagactccat

SEQ ID NO: 120763 - DNA, 601 bp, Human
ttgcctccttgctcatcagggaagcattgcatcttcagggtgggagacacagcggggcctgcggttcagtagggattagatgcctgtgctcccacagctcctctccaggcctctgccgcagctccggtgctgctgcgcttccattactgaccggcacatctgtctttcttagtggattgtgggctccttgagggccgaaccacggttgtctttcatcttggactctccagcttccaacacagtgcctggtacatttgtaagaacctagtgtttgtgtgaataaattcatgaattgcacatkactgagctctgctgcatttcatccagagaactggtaatcatgatagaatttgcttagacattccaaggttacttgtaattacttttgttttctgagcgtgattgattagttataagcatcaatatgttgtgaatgcaagttgctaaaatgcatttgtaacactttacttgtcctgtctttctctaaggctacagcagctgaaaaaccaaaacttcatctacttgctgaaagtgaggtaagaaagctatttttttttttatttccttctgtaacattttctgtaaaagatagtgcgtggca

SEQ ID NO: 120764 - DNA, 601 bp, Human
tcttcagggtgggagacacagcggggcctgcggttcagtagggattagatgcctgtgctcccacagctcctctccaggcctctgccgcagctccggtgctgctgcgcttccattactgaccggcacatctgtctttcttagtggattgtgggctccttgagggccgaaccacggttgtctttcatcttggactctccagcttccaacacagtgcctggtacatttgtaagaacctagtgtttgtgtgaataaattcatgaattgcacatgactgagctctgctgcatttcatccagagaaytggtaatcatgatagaatttgcttagacattccaaggttacttgtaattacttttgttttctgagcgtgattgattagttataagcatcaatatgttgtgaatgcaagttgctaaaatgcatttgtaacactttacttgtcctgtctttctctaaggctacagcagctgaaaaaccaaaacttcatctacttgctgaaagtgaggtaagaaagctatttttttttttatttccttctgtaacattttctgtaaaagatagtgcgtggcaatcccctttgggataatgattttcagccagc

SEQ ID NO: 120765 - DNA, 601 bp, Human
aagaacctagtgtttgtgtgaataaattcatgaattgcacatgactgagctctgctgcatttcatccagagaactggtaatcatgatagaatttgcttagacattccaaggttacttgtaattacttttgttttctgagcgtgattgattagttataagcatcaatatgttgtgaatgcaagttgctaaaatgcatttgtaacactttacttgtcctgtctttctctaaggctacagcagctgaaaaaccaaaacttcatctacttgctgaaagtgaggtaagaaagctattttttttttyatttccttctgtaacattttctgtaaaagatagtgcgtggcaatcccctttgggataatgattttcagccagccaagcagctgtgcagtggcttctccagggtgtggagcagtattgacctccaacttgctccctgctggactcagtacacctgaacagggaaggtgctttccaagggtgcctagtaacagaggcccccttcttagccctttcttggaagcagaatgctaattgtcagagccaaacacaaggccttcctgccttggggatgcatggtgtcctgattgtgagagaccctgg

SEQ ID NO: 120766 - DNA, 601 bp, Human
aggaaagcatgtgtcaggcgaggaagggcatttcaagcagagagagcagcatgtgccaaaacagagcctgcaaaaatgggaaaaagctggggagactgaggaggttggatgggactgggattggttgtccagttgagaaactctgacagcatggcctgaaggatcctctaggctgaggagtcctgtgattacattgttttctgtctggcagtagcaaggagcttgagctggaggaagccttgggcatccaggaaaccagagagggggtagggggcataagtgtagtgagacctccaggatrtgtgctgtgcaagatgatctacttcccagtgggaagaaagtacagttgaccctgaagcaatgagggggttatggacactgaccacccccacatcatgcagtagaaaatccatatataactttctactcccccaaaaccaaactgctaaaactactgttgaccaaaagccttactgataacataaagtcaattaacaaatattttgtatgttttatattctatattctgtattcttacaataaagtaagctagagaaaagaaaatgttattaagaaaatcataaggaagagagatagattt

SEQ ID NO: 120767 - DNA, 601 bp, Human
gagcttgagctggaggaagccttgggcatccaggaaaccagagagggggtagggggcataagtgtagtgagacctccaggatgtgtgctgtgcaagatgatctacttcccagtgggaagaaagtacagttgaccctgaagcaatgagggggttatggacactgaccacccccacatcatgcagtagaaaatccatatataactttctactcccccaaaaccaaactgctaaaactactgttgaccaaaagccttactgataacataaagtcaattaacaaatattttgtatgttttatatwctatattctgtattcttacaataaagtaagctagagaaaagaaaatgttattaagaaaatcataaggaagagagatagatttactattctttaagtgggagtggatcaccatgaaggtcttcatccttgtagtcttcactttgtgtaggctgaggaggaggtagaggagggcttagtcttgctgtctcaggggtggcagaggcagaagaagatccaggtgtaagcaaactcctgcagtgcaaaccggtgttgttcgagggtcaactgtattacaattccattgtcaccaactttttaaag

SEQ ID NO: 120768 - DNA, 601 bp, Human
ggatgtgtgctgtgcaagatgatctacttcccagtgggaagaaagtacagttgaccctgaagcaatgagggggttatggacactgaccacccccacatcatgcagtagaaaatccatatataactttctactcccccaaaaccaaactgctaaaactactgttgaccaaaagccttactgataacataaagtcaattaacaaatattttgtatgttttatattctatattctgtattcttacaataaagtaagctagagaaaagaaaatgttattaagaaaatcataaggaagagagataratttactattctttaagtgggagtggatcaccatgaaggtcttcatccttgtagtcttcactttgtgtaggctgaggaggaggtagaggagggcttagtcttgctgtctcaggggtggcagaggcagaagaagatccaggtgtaagcaaactcctgcagtgcaaaccggtgttgttcgagggtcaactgtattacaattccattgtcaccaactttttaaagacaaatcaacgttggtggccttgcaggtacccaggactctcacaatgaggaggggttgatagtggccccctcctttat

SEQ ID NO: 120769 - DNA, 601 bp, Human
aaatcataaggaagagagatagatttactattctttaagtgggagtggatcaccatgaaggtcttcatccttgtagtcttcactttgtgtaggctgaggaggaggtagaggagggcttagtcttgctgtctcaggggtggcagaggcagaagaagatccaggtgtaagcaaactcctgcagtgcaaaccggtgttgttcgagggtcaactgtattacaattccattgtcaccaactttttaaagacaaatcaacgttggtggccttgcaggtacccaggactctcacaatgaggaggggtygatagtggccccctcctttatttcctagaccatctttagcatattctgaagcatcgcagctttagaattgcttggttgaggccggatgtggtggcttattcctgtaatcccagcactttggaaggccggggttggcgtatcacctgaggtcgggtgtttaagaccagcctggccaacacggtaaaaccccatctctactaaaaatacaaaaatttagccagacatggtggtgtgcatctgtaatcccaactacttgggaggctgaggcacgagaatcgcttgaacctgggaggcggaggt

SEQ ID NO: 120770 - DNA, 601 bp, Human
agtgagctgagatcctgccactgcactccagcttgggccacagagtgaaactctgtctcaaaaaaaaaaaaagaaaaaaaagtgcttggtcgggccaggtgcggtggctcacgcctgtaatcccagcactttgggaggccgaggcagatgtatcacctgaggtcaggagttccagaccagcctggccaacatggtgaaaccccgtctctactaaaaatacaaaaattagccaggcgtggtggcaggcacctgtaatcccagctactcgggaggctgaggcaggagaaatgcttgaacccargaggcggaggttacagtgagctgagatcatgccattgcactccagcctgggcaagaagagagaaactccatctcaaggaaaaaaagaaaaaaaaagaattgcttggttgaagtagtcttatgtatcatgttatttgggtttaattagactgatcctcacaaaataggcaagtggttttaaaagatttctgcataaaaaatgtgggttgagacaggtgtagtgactcatacctgtaataccagtgctttaaaagaccaaggagaggatcacttgaggccagggtcttgagaacatcctggg

SEQ ID NO: 120771 - DNA, 601 bp, Human
cccagcactttgggaggccgaggcagatgtatcacctgaggtcaggagttccagaccagcctggccaacatggtgaaaccccgtctctactaaaaatacaaaaattagccaggcgtggtggcaggcacctgtaatcccagctactcgggaggctgaggcaggagaaatgcttgaacccaggaggcggaggttacagtgagctgagatcatgccattgcactccagcctgggcaagaagagagaaactccatctcaaggaaaaaaagaaaaaaaaagaattgcttggttgaagtagtcttaygtatcatgttatttgggtttaattagactgatcctcacaaaataggcaagtggttttaaaagatttctgcataaaaaatgtgggttgagacaggtgtagtgactcatacctgtaataccagtgctttaaaagaccaaggagaggatcacttgaggccagggtcttgagaacatcctgggcaacatagcaagacctcatctctaaaaaaaattgtaaaaattagctgagcatggtgatgtgtgcctacaatcccagctacttgagaggctgaggcaggagaattgcttgagtccaagagtt

SEQ ID NO: 120772 - DNA, 601 bp, Human
ccagcactttgggaggccgaggcagatgtatcacctgaggtcaggagttccagaccagcctggccaacatggtgaaaccccgtctctactaaaaatacaaaaattagccaggcgtggtggcaggcacctgtaatcccagctactcgggaggctgaggcaggagaaatgcttgaacccaggaggcggaggttacagtgagctgagatcatgccattgcactccagcctgggcaagaagagagaaactccatctcaaggaaaaaaagaaaaaaaaagaattgcttggttgaagtagtcttatrtatcatgttatttgggtttaattagactgatcctcacaaaataggcaagtggttttaaaagatttctgcataaaaaatgtgggttgagacaggtgtagtgactcatacctgtaataccagtgctttaaaagaccaaggagaggatcacttgaggccagggtcttgagaacatcctgggcaacatagcaagacctcatctctaaaaaaaattgtaaaaattagctgagcatggtgatgtgtgcctacaatcccagctacttgagaggctgaggcaggagaattgcttgagtccaagagttt

SEQ ID NO: 120773 - DNA, 601 bp, Human
agatcatgccattgcactccagcctgggcaagaagagagaaactccatctcaaggaaaaaaagaaaaaaaaagaattgcttggttgaagtagtcttatgtatcatgttatttgggtttaattagactgatcctcacaaaataggcaagtggttttaaaagatttctgcataaaaaatgtgggttgagacaggtgtagtgactcatacctgtaataccagtgctttaaaagaccaaggagaggatcacttgaggccagggtcttgagaacatcctgggcaacatagcaagacctcatctctwaaaaaaattgtaaaaattagctgagcatggtgatgtgtgcctacaatcccagctacttgagaggctgaggcaggagaattgcttgagtccaagagtttgaggctgcagtgagctatgatttgtgcccctgcaccccagcgtgggtgacagtgagaccctgtctcttaaaaggaaaaaaaaaagtagaagcttttgaagctaacacaaatgaacaatgagaaaataagatggctgataattttcctacccctggtacagactattcagctacatcatggggttgaaagaagataaagatct

SEQ ID NO: 120774 - DNA, 601 bp, Human
tacagactattcagctacatcatggggttgaaagaagataaagatcttattagatataatgccaagtcagtcaaaaaattaaaaattagcaggctatttaaattctggctttacatatgatattgttaatgatgaactaatcactatgtgtacagagtgccttgagagaattagctaatgacactactaggccaccaaattttaaaatagttcatctttatctctttatttatttattttttggaaacagagtctcactctgttgcccaggctggagtgcagtggcatgatctcagctcaytgcaacctctccctcctgggttcaagtgattcttctgcctcagcctcccaagtacctgggattacaggcgtgcgccaccatgcccgacctatgtttttattttttttaaatgaaagtataatttactaccagtcaaacacacaaattctgtaagcttaataagtgtgttgttgttgaaacagggtctcgctctgtcatgcaggctggagtgcagtggtgcgatcttggctcactgcagcctccaccccgtgggctcaagtgaccctcccacctggtctcccaagtagctgggactacagc

SEQ ID NO: 120775 - DNA, 601 bp, Human
aaaattaaaaattagcaggctatttaaattctggctttacatatgatattgttaatgatgaactaatcactatgtgtacagagtgccttgagagaattagctaatgacactactaggccaccaaattttaaaatagttcatctttatctctttatttatttattttttggaaacagagtctcactctgttgcccaggctggagtgcagtggcatgatctcagctcattgcaacctctccctcctgggttcaagtgattcttctgcctcagcctcccaagtacctgggattacaggcgtgcrccaccatgcccgacctatgtttttattttttttaaatgaaagtataatttactaccagtcaaacacacaaattctgtaagcttaataagtgtgttgttgttgaaacagggtctcgctctgtcatgcaggctggagtgcagtggtgcgatcttggctcactgcagcctccaccccgtgggctcaagtgaccctcccacctggtctcccaagtagctgggactacagccatgtaccagcctgcccatttttttgtttgtttgtttgtggtttttgtttgtttgtttgtttgtttgtttgaga

SEQ ID NO: 120776 - DNA, 601 bp, Human
aaaattagcaggctatttaaattctggctttacatatgatattgttaatgatgaactaatcactatgtgtacagagtgccttgagagaattagctaatgacactactaggccaccaaattttaaaatagttcatctttatctctttatttatttattttttggaaacagagtctcactctgttgcccaggctggagtgcagtggcatgatctcagctcattgcaacctctccctcctgggttcaagtgattcttctgcctcagcctcccaagtacctgggattacaggcgtgcgccaccaygcccgacctatgtttttattttttttaaatgaaagtataatttactaccagtcaaacacacaaattctgtaagcttaataagtgtgttgttgttgaaacagggtctcgctctgtcatgcaggctggagtgcagtggtgcgatcttggctcactgcagcctccaccccgtgggctcaagtgaccctcccacctggtctcccaagtagctgggactacagccatgtaccagcctgcccatttttttgtttgtttgtttgtggtttttgtttgtttgtttgtttgtttgtttgagacggagtc

SEQ ID NO: 120777 - DNA, 601 bp, Human
atattgttaatgatgaactaatcactatgtgtacagagtgccttgagagaattagctaatgacactactaggccaccaaattttaaaatagttcatctttatctctttatttatttattttttggaaacagagtctcactctgttgcccaggctggagtgcagtggcatgatctcagctcattgcaacctctccctcctgggttcaagtgattcttctgcctcagcctcccaagtacctgggattacaggcgtgcgccaccatgcccgacctatgtttttattttttttaaatgaaagtayaatttactaccagtcaaacacacaaattctgtaagcttaataagtgtgttgttgttgaaacagggtctcgctctgtcatgcaggctggagtgcagtggtgcgatcttggctcactgcagcctccaccccgtgggctcaagtgaccctcccacctggtctcccaagtagctgggactacagccatgtaccagcctgcccatttttttgtttgtttgtttgtggtttttgtttgtttgtttgtttgtttgtttgagacggagtctctctctgttgcccaggctggagtgcaatggcgtgatc

SEQ ID NO: 120778 - DNA, 601 bp, Human
tgcgccaccatgcccgacctatgtttttattttttttaaatgaaagtataatttactaccagtcaaacacacaaattctgtaagcttaataagtgtgttgttgttgaaacagggtctcgctctgtcatgcaggctggagtgcagtggtgcgatcttggctcactgcagcctccaccccgtgggctcaagtgaccctcccacctggtctcccaagtagctgggactacagccatgtaccagcctgcccatttttttgtttgtttgtttgtggtttttgtttgtttgtttgtttgtttgttttagacggagtctctctctgttgcccaggctggagtgcaatggcgtgatctcggctcctgcaaccttcgcctcctgggttcaagcgattctcctgtctcagcctcccgagtagttgggattacaggcgtgcgccaccaggcccagctaatttttgtatttttagtagagacggggtttcaccatgttggttaagttggtctcgaactcctgacctcgtgattgcccagctcggcctcccaaagtgctgagattacaggcgtgagccaccgcgcccagctttgtttgtgtttttttgagatgg

SEQ ID NO: 120779 - DNA, 601 bp, Human
tcctatgtaattttgttttttgcttttttttcatgaggcattttatttgtaaatatgtataacatctctagaaaaagaatcccaggattttccttcctgtgtgttttcgtcttgcttctttatggtccatgatgccagctgagactgtcagtacaatgaaatcaaactggccagatggaagcagattattctgcatttctctagatctttgagttgcacatcaaatctggggctgatcatgccacacttgtttagactgcctgtgaggttcacaacaatttgcctagctctgtgatcatcmatgatttcaaattcgccaatataaccatgcttcatcatcacagtgagaaaccagacgatgactttggagcatggcctaagaacctggtgtttgtctctcttttcagcattgttgatgctcttgagagcatcagccaggacattaatgtgcaccactgtggtggcgtggaaagatggcaaaaagagccctgcgtgattttgtacgtagaaaatcctagaatacccacaaaaacctattagaactaataaacaatttcagcaaggttataggatacaagattaatatacaaaaatcaattgt

SEQ ID NO: 120780 - DNA, 601 bp, Human
ctttggagcatggcctaagaacctggtgtttgtctctcttttcagcattgttgatgctcttgagagcatcagccaggacattaatgtgcaccactgtggtggcgtggaaagatggcaaaaagagccctgcgtgattttgtacgtagaaaatcctagaatacccacaaaaacctattagaactaataaacaatttcagcaaggttataggatacaagattaatatacaaaaatcaattgtagccaggcacggtggctcacgcctgtaatcccagcactttgggaggctgaggcaggtggatyacaaggtcaggagttcaagaccagccttggtttcagactggtgaaacccagtctctactaaaaatacaaaaattagccgggtgtagtgttgggtgcctgtaatcccagctactcgggaggctgaggcagataattgcttgaacctgggagatggaggttgcagtgagccgagatcacgccactgcactccagcctgggtgacagagcaagactccatctcaaaaaaaaaaaaaaaaattaaattgtacttcttctataaaattgcaatgaacaatataaaaatgaaattaagaaaacaat

SEQ ID NO: 120781 - DNA, 601 bp, Human
atctcagctcactgcaatctccgcctcccgggttcacaccattctcctgcctcagcctcccaggtataataatttttgacaaagatgtgaaaacaattcaatggggaaagaaaagcctttcaacagatggtgctaagactctgtctctacaaaaagtaattttaaaatttcctgagagtggtggggtgcatctgtggtcccagctacttgggaggctgaggtgggaggatcacttgggccctggaaggtcaaggctgcagtgagctgtgattgatccactgcactccagcctgggcaaaasaatgggaccctgtctcaaaaaaaaaaaaaaaaagtttgtaggtttcatttgtttgctttgtttgtttgttctgagatacatttacaggtagaattcttagggtttggtaacaggttacatgtggagcccatgggagtggaaggagttcaaggatgatggcagattttcagcagaggcgatgaggggctagttctgcctggaacactcttttcctagacactggcatagtgtccctcatcttattctggtttctgctcaaatgccacatcttcagaggtccttccctgtccatcctgacta

SEQ ID NO: 120782 - DNA, 601 bp, Human
tcacaccattctcctgcctcagcctcccaggtataataatttttgacaaagatgtgaaaacaattcaatggggaaagaaaagcctttcaacagatggtgctaagactctgtctctacaaaaagtaattttaaaatttcctgagagtggtggggtgcatctgtggtcccagctacttgggaggctgaggtgggaggatcacttgggccctggaaggtcaaggctgcagtgagctgtgattgatccactgcactccagcctgggcaaaacaatgggaccctgtctcaaaaaaaaaaaaaaaaagtttgtaggtttcatttgtttgctttgtttgtttgttctgagatacatttacaggtagaattcttagggtttggtaacaggttacatgtggagcccatgggagtggaaggagttcaaggatgatggcagattttcagcagaggcgatgaggggctagttctgcctggaacactcttttcctagacactggcatagtgtccctcatcttattctggtttctgctcaaatgccacatcttcagaggtccttccctgtccatcctgactaaaatgaaatccctaccctttatttgttcaacgt

SEQ ID NO: 120783 - DNA, 601 bp, Human
tcccagctacttgggaggctgaggtgggaggatcacttgggccctggaaggtcaaggctgcagtgagctgtgattgatccactgcactccagcctgggcaaaacaatgggaccctgtctcaaaaaaaaaaaaaaaaagtttgtaggtttcatttgtttgctttgtttgtttgttctgagatacatttacaggtagaattcttagggtttggtaacaggttacatgtggagcccatgggagtggaaggagttcaaggatgatggcagattttcagcagaggcgatgaggggctagttctgcctggaacactcttttcctagacactggcatagtgtccctcatcttattctggtttctgctcaaatgccacatcttcagaggtccttccctgtccatcctgactaaaatgaaatccctaccctttatttgttcaacgtgtgtatcagttagtattagatttggctggcagtaacagaaaactccaaaatagcatttggataaacacattggaattttgtttttctctcaaattttagaaatatagaggtaatgtggtggggggaggggggaggctgatatggggcagcttgatgacaaggat

SEQ ID NO: 120784 - DNA, 601 bp, Human
tacaggtagaattcttagggtttggtaacaggttacatgtggagcccatgggagtggaaggagttcaaggatgatggcagattttcagcagaggcgatgaggggctagttctgcctggaacactcttttcctagacactggcatagtgtccctcatcttattctggtttctgctcaaatgccacatcttcagaggtccttccctgtccatcctgactaaaatgaaatccctaccctttatttgttcaacgtgtgtatcagttagtattagatttggctggcagtaacagaaaactccaaamtagcatttggataaacacattggaattttgtttttctctcaaattttagaaatatagaggtaatgtggtggggggaggggggaggctgatatggggcagcttgatgacaaggatgcaggttctattctattttgttgctttgttttgtatgggcatcattcccagagttatctcttttttttaattagaataacacacatgtattatctacgatttttgtaaccacccagagggttcactttgcccactgcctagacagagctgatttatcaaggtagagaattgcaatagagaaagagt

SEQ ID NO: 120785 - DNA, 601 bp, Human
agttttaaggataatttggtgggtaggaagcagccagtgagtcaggagtgctgattggttgggtcagagatgaaatcatagggaattgaaactgtcttgcactgagtcagtttctggctgggggccacaagatcagatgatccagtttatcaatctggggggtgccaactgatccatcaagtgcaaggtctgcaaaatatctcaagcactatcttaggctttacaatagtgatgtaatccccaggatcaatttgggagggtcagaatcttgtagcctccagctgcatgactcctaaaccayaatttctaatctttttgctaatttgttagtccttcaaaggcagtctgatctccagacaagaagagggtttgttttggaaaagggctgttatcatcttgttgtatttttatttttattatttatttatttatttatttatttatttatttatttatttttgggggacagagtctcgctctatcgcccagaatggagagcagtggcccagtctcggctcactgcaacctctgcctcctggattcaagcgattctcctgcctcagcctcccaagtagctgggattactggcgcccgccaccac

SEQ ID NO: 120786 - DNA, 601 bp, Human
atttctaatctttttgctaatttgttagtccttcaaaggcagtctgatctccagacaagaagagggtttgttttggaaaagggctgttatcatcttgttgtatttttatttttattatttatttatttatttatttatttatttatttatttatttttgggggacagagtctcgctctatcgcccagaatggagagcagtggcccagtctcggctcactgcaacctctgcctcctggattcaagcgattctcctgcctcagcctcccaagtagctgggattactggcgcccgccaccacamccagctaatttttgtatttttagtagaagcagcgtttcaccatgttggccaagctggtctcgaactcctgacctcaagtgatccgctcgccttggcttcccaaagcgctaggattacaggcgtgagccactgcgctcagcctcatctttgttttaaactataaactaagttcctcccaaagttagttcagcctatgaccgggaatgaacaaggacagcttggaggttaaaagcaagatggagttggataggtcagatctttcactgtctcagtaatattttgccatgggggtttcatgtt

SEQ ID NO: 120787 - DNA, 601 bp, Human
cctcccttgcctcttccagcttccagtggccccaagcgttccttggcttgtggcagcatcactcccatccctgcctgcatctttgtatggtcatcttctttctgtgtatgtcccttcacatggcgttctccctgtgtgtcccaaggttatctcataatccaagatgattgcaggatctccagccactctgcctgtcctccagtcagcgggaaggaggaatggcaaagaagcaggaaagccacagaatagctgtgtctcttaagggaggctccagaagctactgagacactctcactttcayctctggccagagcttggtcacatgcctgcatccgactataggggaggctggaaatggaatctttattctgggaggcctgagttcacctaaaaattggagcattgattagtttattaggacaaaggggaaatggatattgtgggatacagctgtgtcagctgcgcctgccttttctcctagtgcctggcctaatgtatatttaattagccatttgtttaccatctgtctctcccgatcagaatgtgggctgtgtaaaaccaaagaagaaaactgaggtaccagttaaaaaaaaagaaaaag

SEQ ID NO: 120788 - DNA, 601 bp, Human
ctgggcgacagagtgagactctgtctcaaaaaaaacaaaaaacaaaacaaaaaaaacaaaaaaaaacaaaaaataagaaaaagaaaaaaagaagaagaaaatgactgaggtgagtctcaatcaatttagagttaattttgccaaggatgagaatatgcccagaaaaaagagacataagccacagtaggatctgtgacccacactttttccaaagagggtttgaggacttcaatatttaaagaggaaagggtggggctgggtgcggtggctcacgcctgtaatcccagcactttgggaggcmaaggcgggcagatcatgaggtcaggagattgagactatcctggctaacagtgaaacaccgtctctactaaaaatacaaaaaaaaaattagccacgcattgtggcgggcacctgtagtcccagctactcaggaggctgaggcaggagaatggtgtgaatccgggaggtggagcttgcagtgagctgagatcgcaccagtgcactgcagcccgggcgacagagtgagactctgtctcaaaaaaataaaaataaaataaaataaaaaataaataaataaaataaaaaataaagaggaaagggt

SEQ ID NO: 120789 - DNA, 601 bp, Human
aatgactgaggtgagtctcaatcaatttagagttaattttgccaaggatgagaatatgcccagaaaaaagagacataagccacagtaggatctgtgacccacactttttccaaagagggtttgaggacttcaatatttaaagaggaaagggtggggctgggtgcggtggctcacgcctgtaatcccagcactttgggaggccaaggcgggcagatcatgaggtcaggagattgagactatcctggctaacagtgaaacaccgtctctactaaaaatacaaaaaaaaaattagccacgcatkgtggcgggcacctgtagtcccagctactcaggaggctgaggcaggagaatggtgtgaatccgggaggtggagcttgcagtgagctgagatcgcaccagtgcactgcagcccgggcgacagagtgagactctgtctcaaaaaaataaaaataaaataaaataaaaaataaataaataaaataaaaaataaagaggaaagggtgagcagtgcaggaaagaggaaagggaaaaaagggaagggtagataaaagagacaaggggttgcattcttttgagactttgattagcttagtgttccctg

SEQ ID NO: 120790 - DNA, 601 bp, Human
taggcagctggaaatataatcacgaacttgggagggagatgtggctgaagcccttgacaagagtgattctttgggaagggcatagcgagacagacctacagaaaacagcgagagaggagacatactcagcccactcagtggaatcaacccaagccagaagtctccacccccaccccccgggggagggcaacttcttccataacccacttatagcccctctggccttgcagatctgcctctctgtttggtttgagaattccccttataaaggaactctgcagggcccagatccacttgccaygctttaggaatctaagccacgactcagtctcctcggtgcaggttcttggaccccttcactggacctgagtgaaataagagaaataaggacaatatagtaaaataaatattgcattttgtcggaatgacaaggtgggctggagacacactgccttggcttggatcccagcttttccattcagttgctgtgtgaccttgagaaagtcacttaatcaccccgtgattcagtttcctcatctataaaatggggatattacgagtatccacctcattgtgttgttttaaggatcaatcagtcaat

SEQ ID NO: 120791 - DNA, 601 bp, Human
cttggaccccttcactggacctgagtgaaataagagaaataaggacaatatagtaaaataaatattgcattttgtcggaatgacaaggtgggctggagacacactgccttggcttggatcccagcttttccattcagttgctgtgtgaccttgagaaagtcacttaatcaccccgtgattcagtttcctcatctataaaatggggatattacgagtatccacctcattgtgttgttttaaggatcaatcagtcaataaataagtaaataatttagaacaatggtgtatagtaagttctacytaagtgctagctattaatataaagccaaatgtatttagcttacaaagcaaccattatttttacttctctgttttaaaatatattttcttttctttttttttgagatggagtctcactctgtcagccaggctggagtgtggtggcacgatctcggctcatggcaacctctgcctccccggttcaagtgattctcctgccccagcctctggagtagcagggactataggtgcacaccacacgcccagctaattttttgtatttttaatagagacggggtttcatcatgattgccaagctggt

SEQ ID NO: 120792 - DNA, 601 bp, Human
ggccaggcgaggtggctcactcctgtaatcctagcactttgggaggccgaggcaggcagatcacctgaggtcaggagtttgagactagcctgaccaacatggtgacaccccatctctactaaaaatacaaaaaaaattagccgggtgttgtggcgcatgcctgtaatcccagctacttgggaggctgaggcaggagaattgcttgaacccgggaggcggaggtcacagtgagccgggatcacgctactgcactccagcctaggcaacaagagcgaaactccatctcataaaaaaaaaaaaragagattgtaccactgaactccagcctgggtgacggagtgaaactccatctaaaaaaaaaaaaaaaaaaatctggccaggcatggtggctcacacctgtaatcccagtactttgggaggccaaggcaggcagatcacttgaggtcaggagttcgagaccaggctggccaacatggcaaaactccctctctattaaaaacacaaaaattagccgggtgtggtggtggatgcctctaatcccagctgcttgggaggctgaggcatgagaatcgcctgaacccatcaggcagaggttgcagtg

SEQ ID NO: 120793 - DNA, 601 bp, Human
actttgggaggccgaggcaggcagatcacctgaggtcaggagtttgagactagcctgaccaacatggtgacaccccatctctactaaaaatacaaaaaaaattagccgggtgttgtggcgcatgcctgtaatcccagctacttgggaggctgaggcaggagaattgcttgaacccgggaggcggaggtcacagtgagccgggatcacgctactgcactccagcctaggcaacaagagcgaaactccatctcataaaaaaaaaaaaaagagattgtaccactgaactccagcctgggtgacrgagtgaaactccatctaaaaaaaaaaaaaaaaaaatctggccaggcatggtggctcacacctgtaatcccagtactttgggaggccaaggcaggcagatcacttgaggtcaggagttcgagaccaggctggccaacatggcaaaactccctctctattaaaaacacaaaaattagccgggtgtggtggtggatgcctctaatcccagctgcttgggaggctgaggcatgagaatcgcctgaacccatcaggcagaggttgcagtgagccgagatcgtgccactgaactgcaacctgggtg

SEQ ID NO: 120794 - DNA, 601 bp, Human
tggttggctgggcctggtggctcatgcctgtaatctcagcactttgggaggctgtggcaggcggatcacctgaggtcaggagttcgagaccagcctggccaaaatggtgaaaccctgtctctactaaaaatacaaaatttagctgggcatagtggcaggcacctgtaatcccagctactcagggggctgaggcaggagaatcacttgaacctgggaggcggaggttgcagtgagccgagactgcaccactgcacttcagcctgggcaacagagtgagactccgtctcaaaaaaaaaaaaaagtgataaggggttgtggagaccaaggttttatacagatgaagcctccagatagcaggcttcagagaaaagattgtaaatgtttcttattagacttagagagtctgttctattctatcagtctgttgatgttaatgctggtcggatgggactgaattccaaaagggatgaaggtatgatgaagtatgtctgacacccccattccatcatggcctgagctagtttttcaggttaactcttgaatgccctggctgagaggagaggttgaatcagatgatgaggaggatggtgggttagaattt

SEQ ID NO: 120795 - DNA, 601 bp, Human
aaagattgtaaatgtttcttattagacttagagagtctgttctattctatcagtctgttgatgttaatgctggtcggatgggactgaattccaaaagggatgaaggtatgatgaagtatgtctgacacccccattccatcatggcctgagctagtttttcaggttaactcttgaatgccctggctgagaggagaggttgaatcagatgatgaggaggatggtgggttagaattttatttgtggtttacaatgctaactcgaaggaaaggattgaggactttttcctggccctgtgaaggtsgttgtgtgtgggtgctgggagaactatcccaggaaactcagggtaactggcaaggtgatttgagattgctctggtccaaaagataacgatttcatttggggaaaccatttcctttggagagctggctgagataaggagctagtctgaagcctgggaaggcctcaacaatctggttaacccttcctcctccaggatacaattctttctttttttttctgagacggagtcttcctctgttgcccaggctggagtgtagtggcacagtcttggctcactgcaacctccacctcctgggttcaa

SEQ ID NO: 120796 - DNA, 601 bp, Human
gaggcaatttaatgaggatgggatgtctagaaagggacagggtgggactcggatttccttggctcttctgaggaacttttaccttcaaaggggagtagaagccactgcagggtggaaggaaaacttccgcttccccctccgtgaatttgctgaaaagtcaacagacaaaagacgattaagagaaaaggcatacacattttctaatatgcctagaagaaaacacagtgattaccctaacccttcaatggagtacagaagcttatatagccttttatttctgagacagaggctcactctgtcrcccaggctggagggcagtggcatgagcttggctcactgaaatctctgcctcccaggttcaagtgattctcctgtctaagcctcctgagtagctgggattacaggcttgcaccaccacgcccagctaatgttcgtggttttaggagagagatggagtttcaccatgttggccagcctggtctggaactcctgacctcaagtgatccacccgcctcggcctcccaaagtgctgggattacaggcgtgagccaccgtgcctggccatatagcccttttttttttttctgaagctggtaaggag

SEQ ID NO: 120797 - DNA, 601 bp, Human
gaggtggggcagtctcttccagtgtctgttgatctttaagggcctttcattcaaaatactctttacacaagggagccgtattttggggtgaattatgttggtttccttcacctccttgggaggtgggaaatgtgtcctgaaaggtcagggcctctctgagtggagatgaacaggtcagggttgagtaaggaggaggctggcaggggcctttatgatacctgagaggactggggcttggatggagcaagagaggcactgatggagtaagattcaggtacaagacttaagtcttgcatcctakgcacggctcttgcctcatcctcatcccagccctaataatgggaggctttttgccggtaaattcccattattaggagctgaaaatgtcaatgccttacaggcgccagtcagcagtgtcaagcagtgggctgggtggggcctgggctggctggagctcccctaccctgtctaaagggggcggtggctgctcagctccagcatatgcggggaaggcgctggctaagataaggagctagtgccatgatgaccacgttgccacaggatcaagtgggtcctgtgtggtgtcacctttaggtgcctg

SEQ ID NO: 120798 - DNA, 601 bp, Human
gagaggcactgatggagtaagattcaggtacaagacttaagtcttgcatcctaggcacggctcttgcctcatcctcatcccagccctaataatgggaggctttttgccggtaaattcccattattaggagctgaaaatgtcaatgccttacaggcgccagtcagcagtgtcaagcagtgggctgggtggggcctgggctggctggagctcccctaccctgtctaaagggggcggtggctgctcagctccagcatatgcggggaaggcgctggctaagataaggagctagtgccatgatgaycacgttgccacaggatcaagtgggtcctgtgtggtgtcacctttaggtgcctgaaatctagattttattttatttattttattactatacatattttttgagacggaatttcgcttttgttgcccagactggagggcaatggcgcaatctcggctcaccacaacctctgcctcccgggttcaagcgattctcctgcctcagcctcccaagtagctgggattacaggcgtacaccaccatgctgagtagctgggattacaggcatgtgccaccatgcctggctaattttgtatttttagta

SEQ ID NO: 120799 - DNA, 601 bp, Human
atacctgccattccttaagtgtgtattatgtgcacgtattttgcgtacagtattacacaacaatcaaggggaggtgaggtgggcattagtgtcttcatcttatggatgaagacacagtctcagaggtgattcaagatgcccctctgcataggccctaaggcagggggtggggactgtgacctggacaggaagctggggcctcaggactgcatctaagctcctccttttctgtgggtgatggtggctgtcaggcccctgaacctacgtcatccctccctctgatttgactgtacctttgctrggcctggtcaagggctagggactcctaaagtcaagagctagggtagaggttgggggttggatctcagggcaccatatggtgcagacttggttgcaggaaagtgacctatttaggcagaggggctctatacaactgggaccacagcaaaccctagaggtgagcacctgcttcaaagactcacagatccaagctgtgatcctagatctacaacttcctggctgtataaagtccagcaagactgaggcctcactgagcttcaatttccttacctgtctaaccagaatagcaacaacttgtttg

SEQ ID NO: 120800 - DNA, 601 bp, Human
gtagaggttgggggttggatctcagggcaccatatggtgcagacttggttgcaggaaagtgacctatttaggcagaggggctctatacaactgggaccacagcaaaccctagaggtgagcacctgcttcaaagactcacagatccaagctgtgatcctagatctacaacttcctggctgtataaagtccagcaagactgaggcctcactgagcttcaatttccttacctgtctaaccagaatagcaacaacttgtttgtatatttgagctcattacatgtcattttgtaaggcactaaagytcctggaggcttccggaacacagaaataattaatctaagaatcctaaagtggctgtcctggtagcacctctagggagtcctcccatcctacgtaacttcctctgggaaagtagaaaacacggcacctgggaaggggcgctgaaccgtgccccaagtcccagtgggcctggatgcccaagagcaagaggaggcccagaggatggggacaggccacgacctgtggcccaagtcccgcccagagggagtgcgccctgagggagagccaccggagctggtgactcgggggcgggtgctctgggg

SEQ ID NO: 120801 - DNA, 601 bp, Human
tgtggcatgcttgttctagcacttggacgcatgcatcctcctgtcctgaggtgttgttgcctttgacatcttagtgtaaaatactgtccgctggcaggtcttaaaggtgtatttgtctcttctgccagctgtgctaccatattttaaagaaacagcctaagctgtagggaaagacgcccgttttatcagtgccaggtctggtacaggctccaggcccacccaccctgaacgtggtgacgttattgctggggttagctgggatggactggcaaagtcatcttgactttggcgttcagacagrtggagttctacaggtgaaaggcaggagtgacaggccttgattttctgcccggcaagccatagggtgttccatcctcttcctgtgcatctaagacgactccctcatctggcaccataggaaacaggcctactgagggcagcgaccttatcaaggtcacccagtgagttagaggcagagccagtcagggggatccaggtctcccagtgcctccacccaggaacttcaccagggtcctcctggaggtcagcttccaggagggagtgggtactgagagacaaagccgctggggaccctgccgtg

SEQ ID NO: 120802 - DNA, 601 bp, Human
gctcttctggggcccaggatttcttagagaccagctctttccacgtaccactcaccataggaaaggctaggtgaaggtgcgggaccccctgttcttcctgtggggctggactctgcctgcctcccagcagggacctgctgaggatggttcccccccagcgtgggcagccatgatgattcagccctccagctgtaggcagcctccggggctctggagacagacctggcatccctcagtaactctcatctatcttcttgccctcagagccagaggtaggagaagggaagctggggaccatgcyggggaagtttttgggattgcttagaatccaaacgtgatcatgaaaatggtgtcatttctttcttcattgcctatgaggcacatcaataattcaactccataaaaatatatcctgggttgaaacagttcaggtgtctgacttcccagcttggaaccccattatccagacggcatctgcataaattggttaatgggtgctgttgaagagggtgtactggcattaggctgagctaagcacaaaacacatatattcctttcactcttctagtgcctgtaggaggaaagggaggcatatgtgtgc

SEQ ID NO: 120803 - DNA, 601 bp, Human
taaaaggccgatgtagtggctcacacctgtaatctcagcactttgggaggctgaggcgggtggatcacctgaggtcgggagttcgagaccagcctgaccaacatggagaaaccccgtctctactaaaaatacaaaattagctgggtgtggtggcgcatgcctgtaatcccagctacttgggaggctgaggccggagaatcacttgaacctggaaggcagaggttgcggtgagccgagatcacgccattgcactccagcctaggcaacgagagcgaaactccgtctcaaaaaaaaaaaaaaatgcccattcattattgctcaggggtgagagaggtgatagttagaaaattgtgaaaaatctggctgggcacagtggctcatgcctgtaatcccagcactttgggaggctgaggcaggtgaatcacgaagtcaggagttcaagaccagcctgaccaatatggtgaaatcccgtctctactaaaaatacaaaaattagctggacgtggtagcatgcacctgaagtcccagctactcgggaggctgaggcaggagaattgcttgaaccggggaggcggaggttgcatgagccaggatcatgcca

SEQ ID NO: 120804 - DNA, 601 bp, Human
ggtgaaatcccgtctctactaaaaatacaaaaattagctggacgtggtagcatgcacctgaagtcccagctactcgggaggctgaggcaggagaattgcttgaaccggggaggcggaggttgcatgagccaggatcatgccactgcactccagcctgggcaacagagcgaaactctgtctcaaaaaaaaaaaaaagaaaattatgaaaaatctgtgggttcttgcagtggcaaagaaaaaaaagaaaaaattatgaaaagtcagcctgggcaacaaaattaaacctcatcttaaaaaaaawttttttttagcctgctttggtggcatgcacacacctgtagtcacagctactcaggaggctcattgagcccaaaagattgatcccaaaacagtgagctgtgatgctatgattgtgttaccgtactccaggctggatgatagagcgagactctgtctcaaaaaaaaaaaaaaaaaaagaagaaagaaaattatgagaagtgtctcataacctctcaattctgatgttgtacaaatattcagtgagagcttcttggtgaatcttgactttataatccctgcctttcctaccttagatactcct

SEQ ID NO: 120805 - DNA, 601 bp, Human
ctttccccttacaagactgatttggcatgactgggactgtctgtgtgtgtctgcagtcagggattcctggcagacagatttagccactggaatcacctctgagcatgcctgagaaggtccagggaagacatggataaagacagggagctgtatacctctgcatccaggaatcagttgtggtcagactgctggcacctgcttatggatttgtttttatttttttatagagacagggtctcaccatattgcccaggctggtcttgaactcctgggctcaggcagtcctcccgccttggcctcmctaagtatgcttattgatttgaaaaccctgaagatcaaatctgatcacaggagctcaatcatttctttaaaaaatgtttgatttttttattatgtgcagaggactgtgctaggctggggtgacaactataaacaaggcagaaacggtcccagttctcatggagcataaaatatttgctggccgggcgtggtggctcatgcctataatcccagcactttgggaggccaaggcaggctgatcatttgaggtcaggaggtcgagaccagcctgaccaacatggtgaaaccccgtctctactaa

SEQ ID NO: 120806 - DNA, 601 bp, Human
gtatgcttattgatttgaaaaccctgaagatcaaatctgatcacaggagctcaatcatttctttaaaaaatgtttgatttttttattatgtgcagaggactgtgctaggctggggtgacaactataaacaaggcagaaacggtcccagttctcatggagcataaaatatttgctggccgggcgtggtggctcatgcctataatcccagcactttgggaggccaaggcaggctgatcatttgaggtcaggaggtcgagaccagcctgaccaacatggtgaaaccccgtctctactaaaaatwcaaaaaaggtgccagatgtggtggctcatgcctgtagtcccagcttctcgggaggctgaggcagaagaatcacttgaacctgggaggcggaggttgcagtgagctgacactccagtctgggtgacagaacgagactccatctaaacaaaaataataattaaaaaaaaatgaagtatttgctgtgttatatgtgcaaagcatatgggctatgagggcccacagcatggtgtggtcataccttgggtgggaaatccctaggctaggaactgcttacagctaggctgcagatgttagctcctt

SEQ ID NO: 120807 - DNA, 601 bp, Human
ttatacttagaaactttgtaaggtggagtcaaaattaattgtcacaaaaatgtgtattttttttttttttttttttttttgagatggagtcttcgctctgttgcccaggctggagtgcagtggcacgatctcagctcactgcaagctccgcctcctgggttctcgccattctcctgcctcagcctcctgagtagctgggactacaggcgcctgccaccactcccgtctaattttttgtatttttaggagagacggggtttcactgtattagccaggatggtctcgatctcctgatcttgtsatccgcctgcctcgacctcccaaagtgctgggattacaggtgtgagccaccacacccggccatgtattttcttattctttttttttgagatggagttctgctctgttgcccaggctggaatgcagtgatgtgatctcggctcattgcaacctctgtctcctgggttcaagcgattctcctgcctcagcctcctgagtagctgggattacaggcaccagccaatgctcctggcctgcatttttttttttttttttgagatggggtctcactctgtatcctgggttggagtgcagtggtgtg

SEQ ID NO: 120808 - DNA, 601 bp, Human
tttttaggagagacggggtttcactgtattagccaggatggtctcgatctcctgatcttgtgatccgcctgcctcgacctcccaaagtgctgggattacaggtgtgagccaccacacccggccatgtattttcttattctttttttttgagatggagttctgctctgttgcccaggctggaatgcagtgatgtgatctcggctcattgcaacctctgtctcctgggttcaagcgattctcctgcctcagcctcctgagtagctgggattacaggcaccagccaatgctcctggcctgcatytttttttttttttttgagatggggtctcactctgtatcctgggttggagtgcagtggtgtgatctcagctcactgaaacctccatctcgcgggttcaagtgatacttctgcctcagtgcccccccctgccccccagtagctgggattacagtcgcctgccaccatgcccggctaatttttgtattttaaatagagactgggtttcaccatgttggccaggctggtttcaaactcctgaccgcaagtgatctgcccgccttggcctcccgaaatgctgggattacgggtgccagctactgc

SEQ ID NO: 120809 - DNA, 601 bp, Human
ctctgtatcctgggttggagtgcagtggtgtgatctcagctcactgaaacctccatctcgcgggttcaagtgatacttctgcctcagtgcccccccctgccccccagtagctgggattacagtcgcctgccaccatgcccggctaatttttgtattttaaatagagactgggtttcaccatgttggccaggctggtttcaaactcctgaccgcaagtgatctgcccgccttggcctcccgaaatgctgggattacgggtgccagctactgcctctggactgcattttttttttttgagacrgagtcttactctgtcgcctgggttgtagtacagtagcacgatctcacctccctgcaacctctgcctgccaggttcaagcgattcttctgcctcagcctccctagtagctgggattacaggtgcctgccactacacccagctaattttttgtattttttgtagagacggggtttcaccgtgttggccaggctggtcttgaattcctgacctcgtgattcacccgcctcggcctcccaaagtgttgggattacagacgtgagccaccgcgcctggccgctttttttttttttaatggctttt

SEQ ID NO: 120810 - DNA, 601 bp, Human
tgaatgacagggataggaacactactgctggtcccctgattcagaaatccatgttctttccaccattacacccaactctcattgtgcagtttagggaaacagatgcaaggagggaaagactggggtgggagaggggtggaattggcttgggatcctccaggttccctgccccccatctcctgcccctccccagcaccagcatggtgtctcctgcctgtgcctgctgcctcacccccagccccatttgcttagtgttgatgagccccttccacttgggaaggaaatggatccgataaggtcrttaacagtgaaatgttaggaatttgccctgtttttcaaatctcccttttcatttgtctccctctcccattcttgtctgcatttaaaagaggaccccccaggagggcaatgcttaacctgcatgaaaaccccctcaatgctccttgcgatgcccactcctggcctctgcctgggggtactgtaagcagctgtcgattccatcaattgattgacacatggggcttgtcttcagccatgttattcacccagacctcatgtccctgatgtctcctggtgccttctaggaccctgtctgggtggg

SEQ ID NO: 120811 - DNA, 601 bp, Human
tcatctgttctttttaaatgtggctagtaggaaacttaaaattgcatatgtggctcatattatcttcctgttggacagtgctctgctagatggtaaattccatggctcaggagtttgcactctgcatttaaagcagtgggtttctgggcatccttgggcctcagtttcctcatgtgtaagccgcagtttcctcatctggaatccattatctcgaaaggacccatccagcttgagcagtattgtgaggtgaccatcaagttccctaggcctcattttctttctttctttctttctttctttytttctttttttgagacagactcttgctctgtcatccaggctggagtgcactggcgcaatcttgactcaccgcaacctctgcctccctggttcaagcggttctcatgcctcagcctctctagtagctgggattacaggagcgccgcaccacacccagctaacttttttttatagttttagtagagacgggttttgccatgttggccaggctggtcttgaactggccaagtgatccacccacctcagcctcccaaagtgctgggattacaggtgtcagccattgtacctggcctggcctctg

SEQ ID NO: 120812 - DNA, 601 bp, Human
ggaatgggggcctgctttatttttagctagttcagtgtgacagccttgttctctttctgggcaaggacttggccacttttaccagtcaggaagctccctttagaacctccaggccctactcaggttctcctaggaagagggggccaagggaaggggagctgaagttggagtgccgctctgcttgctgggggcctggggcatttggcttaactgcacagccctaggttccacctgcctcatgtggggttcataacagctaccttacacattgtgcagatttggatggaggagcttagagcasccagcgtgggccctgtccacattcacgttgctagaacgtcagtttcttcatcaagaatggggatcctggctgggcgcagtggctcacgcctgtaatcccagcactttgggaggccgaggtgggcagatcacaaggtcaagagatcaagaccatcctggccaacatggtgaaaccgtgtctctactaaaaatacaaaaattagctggacatggtggtgtgcgcctgtagtcccagctactcaggaggttgaggcaggagaatcgcttgaacccgggaggtggagtttgcagtgagctgaga

SEQ ID NO: 120813 - DNA, 601 bp, Human
ctctgcttgctgggggcctggggcatttggcttaactgcacagccctaggttccacctgcctcatgtggggttcataacagctaccttacacattgtgcagatttggatggaggagcttagagcacccagcgtgggccctgtccacattcacgttgctagaacgtcagtttcttcatcaagaatggggatcctggctgggcgcagtggctcacgcctgtaatcccagcactttgggaggccgaggtgggcagatcacaaggtcaagagatcaagaccatcctggccaacatggtgaaaccstgtctctactaaaaatacaaaaattagctggacatggtggtgtgcgcctgtagtcccagctactcaggaggttgaggcaggagaatcgcttgaacccgggaggtggagtttgcagtgagctgagattgcgccactgtactctccagcctggtgacaaagcgagactctgtctcaaaaaagaaaaaaatggggatcccattttcctcatgatttgttgtgcgtaaacagagttcattgaaacagaaccaacagtttacacatgctgagagacacatatgaacctggaagaagagaccgggc

SEQ ID NO: 120814 - DNA, 601 bp, Human
gcccctctgtccctctgggcctcagccatgcagtggtgaagtgctgaggggaaggcaggggttagaagtgcctggaactctgtaccttaaagtgagaggccgctgccgggggagaagggctgggccattcggggaagtctccgggccttatctgagccagcaaaccctctgagacctccctaggctagtcattactggaggcctcccgcccagcacaggagccacccaacctggcccaggagccaccacgtggtgcctcctagggctcctgggcacacaaagggcccagagggcatggctyctgtacccctggcactcacggtctagctggcggtgtggaccatgcatgtgtccctgcaacgcccaggaaagacacacaccacgaagtgtctcccaggcagatcgactcctacatagtgaacacctaaggccgaggggatgctgaggagaggagtggacggtgtggggtggggcggatcatggcatgtgctcctgagaaggtgagttgggaggtgagctttgggaggaagaaggagctggggacggagaggcccaggaggcagactggacggggcttgcgaggaaggacctttgaggtgat

SEQ ID NO: 120815 - DNA, 601 bp, Human
tcctacatagtgaacacctaaggccgaggggatgctgaggagaggagtggacggtgtggggtggggcggatcatggcatgtgctcctgagaaggtgagttgggaggtgagctttgggaggaagaaggagctggggacggagaggcccaggaggcagactggacggggcttgcgaggaaggacctttgaggtgatgagccaccatcagggtgctgggggttagtggttgctttagggaccccactagatcagggctgcctcccctcgtggccatttccctccctgctcagagaccggctgccgagagcaggacagaaactaggttcccggctgccacccacactactgaggtggggctgggcagccgcagaagccatgtgcagtcaggaagaggagtccggggctgctgggcgggcacagaccacggtgcgggcccaggctctcagcttgctatggctgttgaacttccttcccagactgtgtgaaaggggaaggagcagatcggacagcttgttgtggctctgatcccagctggaggggagaagaggcctcctggaggtcacactggagtggcgtgcttttggcaaggccaggcagccatg

SEQ ID NO: 120816 - DNA, 601 bp, Human
aggagcagatcggacagcttgttgtggctctgatcccagctggaggggagaagaggcctcctggaggtcacactggagtggcgtgcttttggcaaggccaggcagccatgctgttcttgggtggctggagctgtggcggtgatagcccctgtagtaccgcatctccctctccaggaagcccctggccctggctctccctggactgagaggatagagcacaggaccaggaatcagggagcttgctgtccaccccagtctctgcaagtatgtcgccctggccagttgaggaacctcctggccmctcattcttgcccagggtgttggaagtgatggtacctgctctgcttctgcagacaggatgctgtaaggaccaacaggtaaacgcgctgtgccaattagagaggcctttataggtcaaagtcataggaacgcacccacttgacagatgggaagactgaggtgcccacaggatggcagagccagaagtcaaatgcaggtgtctacatggccccgactgtgccctgtcatcggaccgggaggggtcctgaggaagtctttagtacggctttgctagtttgagtcttagagagtgtctgcagga

SEQ ID NO: 120817 - DNA, 601 bp, Human
agtacatagagctctaaagtccttgtacataaagcagggatatctctggggagactgggggaagaattaataatttttacttttatgcatttttatgatgttggaatatattttacaataagtatatattactgttattgcttcttttttgttgtttttttgagatggagtttcgctcttgttgcccaggctggagtgcaatggcgtgatctcggctcactgcaacctccgcctcctgggttcaagtgattcttctgcctcaccctcccaagtagctgggattacaggcatgtgccaccakgcctggctcattttgtatttttggtagagacagggtttctccatgttggtcaggctggtcttgaactcccgatctcaggtgatccaccagcctcggcctcccaaagtgctgggattataggcacgagccaccgcgcctggcctattattgcatctttaaaaaaaaaaatgaaacagtgtaaatgtttcaagtagttttgttagaatctttcatttgccatttttttcaggcatattgcctcccagctttagttttctaccaatgggtcaatagcattttggtagatgccttttttttttt

SEQ ID NO: 120818 - DNA, 601 bp, Human
gagatttctccaatgccctttcttcctccctctctccttcaacccactgcccattcccagcctctttcccagggagacaggcgtggtccagtggagtgccaggaggggctggtctgaacgaggaagatgcgttttgctcagtgaagtgctgggttctctgggcccctggaagttttctgcaggtgtctctagtcatgtgcttttctccagtgcctccgggccacttaaaggcccacagtccagaggggcatgtctgctgagtcctgcaccaggtgcctgcctggctgggcagtgtggcagrtaccagggagctgacttctcccctggcagcccagccccaggcctagggtatttgctggttcagtggccccttctgatctcccgaggaccagtggaaagaaagggcttcccttcattgtcctcattcatgtaaaatccaggaggccccagtttcagttccggccttgcctcaattgggcctcccttttggccccagtattcatgtctcttctgagaggggttgtacctcatgacgactcatgaacctgaacaaaaggaggaaaaccctccctccatagcagcttgaggaccaggccgttct

SEQ ID NO: 120819 - DNA, 601 bp, Human
atggggattaagaacatctcccagacagttttgaaggttaaatgacatactggatcttgatatactgatatactgtaagccacaagagaattatatagtattattccaggatccagcattgtttgaattcctcctttgtgtcaagcaactgggtgagttccaaaggtctattcaatatgttttctttccctggggaactcacgcagtatcataggagatggacagcttggtaaaaggataatcatgatgtgtgaggagtgtggtcgttggggcgtgtccaaaatgctggagtagcaatgtrccttttttaaaattaaaattaaaaaaaattttttgagatggagtcttgctgcattgcccaggctggagtgcgatggcgcgatcttggctgactgcaatcttctctacctcctgggttcacgcgattctcatatctcagtctcctgagtagctgggattacaggcatgcaccaccatgcccagctaatttttgtatttttagtagagaccgggttttaccatgttggccaggctggtcttgaactcctgacctcaggtaatccactcgcctcggcctctcaaagttctggggttacaggca

SEQ ID NO: 120820 - DNA, 601 bp, Human
atagccagtgacaacccagggtgcctaaggttaggagcctgggcagcttgaggagaacggggaactcaggaagaggagcaggttgggtcaggcctggtgaagggtgggagtagtttgactcggaggtgcagggcccatggcctggcacacaggcccggcacatgggtatgggagcccaggggctgtctccattcattgaggctgggtttaaggtttctgtgctctgggcctgccaccctgtgttctcagaagggtcctagccctttggccgccatttctgtctttctagaagtcttgcccrtggacacctgccagtactactgtctcatgttaataataatagctgatgtttattgagcagttactgtgttctaagtgcttgtgtctcatttgaacttgtcctatatgttaggtcctatctatcatctcagtttttcagttgaggaaactgaaattcacacagctgttaagctctggggctaggattgaacccagttggctggctccagagcccttgttcgtagcctctctgtcattcccatcccagtgagagtgagccagccaattctcagagagagaaggaggcttgaggtgttcctga

SEQ ID NO: 120821 - DNA, 601 bp, Human
atcaagtacttgggggttgaagagcagcttccatgtcatatttgagggttggaaaggatcttagagatatcgggttcattttacaggccaggaactagggctcagagcatttgcaagcctgttctgggtgacatggatgacagcagttgaatgaccttccgccatgcgatgtgccagcgtgcgtgttcctgtgcctgtgggagctggctatctcagcgggtgggtgcctcaccttgccctgtcctccccctcgacctcactctccttccttctcatccccctccagattgacaagtatctstatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctggtaagtctgtcacccagagattgaaccctgagggctaaatgttctgtgaaatcttccttctaacttcatttgttcatacatttgctcattcattcattcaccattccatcaatctgctctcccatccatccatccatccatccgctgatcca

SEQ ID NO: 120822 - DNA, 601 bp, Human
agcgggtgggtgcctcaccttgccctgtcctccccctcgacctcactctccttccttctcatccccctccagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctggtaagtctgtcacccagagattgaaccctgagggctaaatgttctgtgaaatcttccttctaactwcatttgttcatacatttgctcattcattcattcaccattccatcaatctgctctcccatccatccatccatccatccgctgatccatctgctgatccatccatccatccatccatccgctgatccatccatccaatatgtgtctactgagaccttatgccagtcactggggataccatggttgggcaaggctgacctgctgtcattgactttactgtctagtggcttgtgatactttagaaagtgtagtgtttatgggtctcgcagatactgtgtgggttgctcttatgtcttcagaaca

SEQ ID NO: 120823 - DNA, 601 bp, Human
gatttcttccctgctctcgaggctcttatttaaaggagtgatttggggcatcttgtatgcagcctgcaaaatggacgccaggaaactgcagctgttgcaactgatgttcttgaaagatgggcaagtgggagtaggctggttgcagcaggaaaagacctctgctctctgcctgcagtcatcctgaatgagatttggacgctgataaagaggccttgtgctgttcactgtggccacgggtggggtctacttcatgctcacatattagcatgtatatctctgatgtaagcctactccacctccmcccttttgtttaggtgttgattactagcacctacttctagctttttaagaactactgaagagattctggccatcagagtgaatagactgtggtctaccctgggtgtgttcgcttgtctctggctggagaagaaagaactttatatatagttcactcttgctttttcccagccatggatgtcacctacagccaggagcactggaacctttccaggatgaggagagctatgtagcagaggcatggctctgactgcttccagctgagagaagaggaaggagcggggaggggagggggtatggg

SEQ ID NO: 120824 - DNA, 601 bp, Human
atacattctgatacctatcagcccatttttaattagtttctttcttttttggtcattttttttttaatgggcagtgaggtttttgtttttggtattttgtagagatagggttttgccatgttgcccagactggtcttgaactcctaggctcaggcgatcctcccacctcccaaagtgctgggattacaggcgtgagccacctcacctggcctgtttttatttttattttttagttgttcttcaataatctgtatatcattaaaaaaaccccaaaaacctaaagtggctttttgctgctgcrtatcatttttgaggtagtggatgaatgaataataaagaaggaaaatattgaagcctcttaacattggtgatttggctaaatagaattccctcttcaaagctactgtagggagcaagggaaaacgtcccctttgccctctgaatgttggctgaaaaatcagctcacaaaaggcagattaataggagaaagggcatacacatttattaacatgcatgtgggagaatcacagactgattactcaagtatcccggtggggcccagatacttacatttcctcttttcttttcctttttttttttg

SEQ ID NO: 120825 - DNA, 601 bp, Human
attacaagtgtgagctactgcgcccggccacacatttcctcttttcagaggggaggcaggagacagggaacagtaaatgattactagggagaatgaagatatcagggaacagagattaaccagtaccggttctctttggaaattgaataggagacagattttttttttttttttaagacagtctcgctctgtcgcccaggttgcagtgcagtggcatgatctcggctcactgcaacctccgcctcccgggttcaagcaattctccggcttcaacttcctgagtagctgggattacaagtgygcaccaccacgctgggctaatttttgtatttttagtagagacgaggtttcaccatgttggccagactggtctcgaactcctgaccttgtgatctgcccgccttggcccctcaaagtgctgggattacaggtgtgagccaccacgcccggtttaggaacagacatctttaaaaaggtccattcaggtgtggtcagattcttcagtcttcttttctgcaatagataatgagataacagggagggtaaggataaagttctccttggagggtctgcgtggtctttatgcagataggagaaaagc

SEQ ID NO: 120826 - DNA, 601 bp, Human
ctgggattacaagtgtgcaccaccacgctgggctaatttttgtatttttagtagagacgaggtttcaccatgttggccagactggtctcgaactcctgaccttgtgatctgcccgccttggcccctcaaagtgctgggattacaggtgtgagccaccacgcccggtttaggaacagacatctttaaaaaggtccattcaggtgtggtcagattcttcagtcttcttttctgcaatagataatgagataacagggagggtaaggataaagttctccttggagggtctgcgtggtctttatgyagataggagaaaagcattttccagcatctgttgatctttaagggcctttagttcaaaatactcattataccagggagccatattttggggtgaagtattttgggtttccctcactacccagtctcttgggaattgctgtccctctgtgcccagcctcccccattcgcgaagtgtcccttttttctccttttctcatttatccctaaggatattgtaagcactaattagagtgtaagcttttggaggctaaataggaatcgatacttcttggtttcggcttcattgttcctacacagcctt

SEQ ID NO: 120827 - DNA, 601 bp, Human
agttcaaaatactcattataccagggagccatattttggggtgaagtattttgggtttccctcactacccagtctcttgggaattgctgtccctctgtgcccagcctcccccattcgcgaagtgtcccttttttctccttttctcatttatccctaaggatattgtaagcactaattagagtgtaagcttttggaggctaaataggaatcgatacttcttggtttcggcttcattgttcctacacagcctttacccaaaagagaagtttttacccaaaggagaagtaaaaaaaaaaatttkctagaagcttggatgtgccattatcttttttcatgcaaagcagagccatttacagtgtagtcacggttgttttggggccctaaatattcatactactgttttccagtcaacggaaggaaaatatttaccttctcttcttgcagcatttgggtggtctcagttttcttatatggaaggatagttgggttatctcaagtattctctctatctgtgaaacctcctgagttgaaggcgtggagttcccatcatgcagctggattgtagatgggcaggaatgcctgtgtatctcatgtacagaat

SEQ ID NO: 120828 - DNA, 601 bp, Human
tagagtgtaagcttttggaggctaaataggaatcgatacttcttggtttcggcttcattgttcctacacagcctttacccaaaagagaagtttttacccaaaggagaagtaaaaaaaaaaattttctagaagcttggatgtgccattatcttttttcatgcaaagcagagccatttacagtgtagtcacggttgttttggggccctaaatattcatactactgttttccagtcaacggaaggaaaatatttaccttctcttcttgcagcatttgggtggtctcagttttcttatatggaargatagttgggttatctcaagtattctctctatctgtgaaacctcctgagttgaaggcgtggagttcccatcatgcagctggattgtagatgggcaggaatgcctgtgtatctcatgtacagaattaattcattgaggctgggcacggtggctcatgcctgtaatcccagcactttgggaggccgaggcaggcggatcacctgaggtcaggagttggagaccggcctagccaatatggcgaaaccccgtctctactaaaaatacaaaaattagctgggcatggtggccggtgcctgtaatc

SEQ ID NO: 120829 - DNA, 601 bp, Human
tgttcctacacagcctttacccaaaagagaagtttttacccaaaggagaagtaaaaaaaaaaattttctagaagcttggatgtgccattatcttttttcatgcaaagcagagccatttacagtgtagtcacggttgttttggggccctaaatattcatactactgttttccagtcaacggaaggaaaatatttaccttctcttcttgcagcatttgggtggtctcagttttcttatatggaaggatagttgggttatctcaagtattctctctatctgtgaaacctcctgagttgaaggcrtggagttcccatcatgcagctggattgtagatgggcaggaatgcctgtgtatctcatgtacagaattaattcattgaggctgggcacggtggctcatgcctgtaatcccagcactttgggaggccgaggcaggcggatcacctgaggtcaggagttggagaccggcctagccaatatggcgaaaccccgtctctactaaaaatacaaaaattagctgggcatggtggccggtgcctgtaatcccagctacctgggaggctgaggcacgagaatcacttgaacctgggaggcagagttgca

SEQ ID NO: 120830 - DNA, 601 bp, Human
gttttggggccctaaatattcatactactgttttccagtcaacggaaggaaaatatttaccttctcttcttgcagcatttgggtggtctcagttttcttatatggaaggatagttgggttatctcaagtattctctctatctgtgaaacctcctgagttgaaggcgtggagttcccatcatgcagctggattgtagatgggcaggaatgcctgtgtatctcatgtacagaattaattcattgaggctgggcacggtggctcatgcctgtaatcccagcactttgggaggccgaggcaggcrgatcacctgaggtcaggagttggagaccggcctagccaatatggcgaaaccccgtctctactaaaaatacaaaaattagctgggcatggtggccggtgcctgtaatcccagctacctgggaggctgaggcacgagaatcacttgaacctgggaggcagagttgcagtgagctgagatcacgccactgcactccagcctgggcaacagaaactctgtctcaaaaaaaaaaaaaagaagaatcaattcattgagctggactcaggcaggcatttcccgcaggcagagtttttgcttgccctg

SEQ ID NO: 120831 - DNA, 601 bp, Human
aatgagagtctttggaaactgcaaaccaccgtgagttatggtgcgtcatcgtcatcctcatcagtcttatgatataataactggctttggaagaattccttgggaaagtctttcctaaccaatggagccagtccaaggaccgcacccagcaggcctgaatgtgtaagccgagcccctgcaggaaggatgcagagtttttcaggattcgctggcatctctgtgatgttacaggggaaggaggcagagaaaaggggcaagccaaggcaggctgtctcacccccaacccctgagctagccacayaaaatgtgggtgagaccacaggctacagctccagtacctctgcaagggggtgactggacacgacagctctgaatcagggagccaacccgaggtaaaagggactgataggtcccttttgttatggagggcaagtgggtatttgggggattcatttcctgacaaagaatattgaactaacctggaaaccttctggttgtagctgaaggaaatctgactcaaatttgtttaagaaaaaaagagaattctagtttcctataactgggaagtctcgctgtgagttgacttctgtatctagggatt

SEQ ID NO: 120832 - DNA, 601 bp, Human
ctggccgggcgccgtggctcacgcctgtaatcccagcactttgggaggccaaggcaggcggatcacgaggtcaggagatcgagaccatcctggctaacacagtgaaaccccgtctctactaaaaaaaaaaaaaaaaaattagctgggcgtggtggcgggcacctgtagtcccagctacttgggaggctgaggcaggagaatgatgtgaacctgggaggtggagcttgcagtgagccaagatcacgccactgcactccagcctgggcgacagagcgagactccgtctcaaaattaaataaaaaaataaataaataaataaataaataaaaccaaagctaggccaggcacggtggctcacgcctataatcccagcactttgggaggccagggcagtcggatcatctgaggtcaggagtttgagaccaacctggccaaggtggtgaaacctcgtctctactaaaaatacaaaaaatgagctgggcgtggtggtgggtggctgtaatcccagctactggggaggctgaggcaagagaatcgcttgaaccccggaggcggaggttgcagtgagccgagatcgcgccattgccgtccagcctgggca

SEQ ID NO: 120833 - DNA, 601 bp, Human
tcacgaggtcaggagatcgagaccatcctggctaacacagtgaaaccccgtctctactaaaaaaaaaaaaaaaaaattagctgggcgtggtggcgggcacctgtagtcccagctacttgggaggctgaggcaggagaatgatgtgaacctgggaggtggagcttgcagtgagccaagatcacgccactgcactccagcctgggcgacagagcgagactccgtctcaaaattaaataaataaataaataaataaataaataaataaaaccaaagctaggccaggcacggtggctcacgcctrtaatcccagcactttgggaggccagggcagtcggatcatctgaggtcaggagtttgagaccaacctggccaaggtggtgaaacctcgtctctactaaaaatacaaaaaatgagctgggcgtggtggtgggtggctgtaatcccagctactggggaggctgaggcaagagaatcgcttgaaccccggaggcggaggttgcagtgagccgagatcgcgccattgccgtccagcctgggcaacaagagtgagactccgtctcaaaaacaaaaacaaaaacaaaaaaaacaaaacaaaaaaacc

SEQ ID NO: 120834 - DNA, 601 bp, Human
ttaggactccaatgggagcccaaagaaaattctatattgatttgaacaatgccacaaagtcggggtcagaatttccaccaaatctatgacacctgcttcccagcattctcccttgttctctctctttcctttggaccacaaataatttaaaaccagtggcttcatgtgatatatacatataatggaatataatcggttcataaaaaggaatgaggtactgatccacgctacagcatggatgagccttgaaaaccttatgccgggtgaaagaagccagacacaaaggacctaatattatacrattccacttatatgaaatgtctggaataggggcatctgtagagcagaaagtacattagtggttgctgggagatagggaggttgggaggaaatggtgaatggttgttaatgggtatggaatttcttttgggatgatgaaaattttctaaaattagatagtggtgatggttgcacaactctgtaaatatgctgaaaaccactgaatttttcactttaaaatgggtaaaaattgtatgctatattattatatctcaataaaactgttattaaaaaaacaaccaaccaatatgtgaaataataa

SEQ ID NO: 120835 - DNA, 601 bp, Human
cattctcccttgttctctctctttcctttggaccacaaataatttaaaaccagtggcttcatgtgatatatacatataatggaatataatcggttcataaaaaggaatgaggtactgatccacgctacagcatggatgagccttgaaaaccttatgccgggtgaaagaagccagacacaaaggacctaatattatacaattccacttatatgaaatgtctggaataggggcatctgtagagcagaaagtacattagtggttgctgggagatagggaggttgggaggaaatggtgaatggtygttaatgggtatggaatttcttttgggatgatgaaaattttctaaaattagatagtggtgatggttgcacaactctgtaaatatgctgaaaaccactgaatttttcactttaaaatgggtaaaaattgtatgctatattattatatctcaataaaactgttattaaaaaaacaaccaaccaatatgtgaaataataagaaatatacatgttggtctctgcccctagtctctagcatttagcttctaaaacccttgtaatttcttgagcaatacaggtgctaggagaatctttgatcctgg

SEQ ID NO: 120836 - DNA, 601 bp, Human
aattagatagtggtgatggttgcacaactctgtaaatatgctgaaaaccactgaatttttcactttaaaatgggtaaaaattgtatgctatattattatatctcaataaaactgttattaaaaaaacaaccaaccaatatgtgaaataataagaaatatacatgttggtctctgcccctagtctctagcatttagcttctaaaacccttgtaatttcttgagcaatacaggtgctaggagaatctttgatcctggtcctgactcagagctcctaaatcccttggaatttcttgggtgatakgagagtctcttttgttccttggtgggaccctggatagcctcaggatggggggctggttgccagggggaaccaaccatgtgatcagagggttgctgtcagccccaacccccatgccgcctccagggagggagagagcctgaaaatagagcgaataaaccaatggtcgatgatttaatcaatcgcaactgtgtaatggtgcttccacaaaaacctaaaacaggccaggtatgatggctcacgcctgtaatcccagcattttgggaggcccaggtgggtggatcgcttgagcctaagagtttg

SEQ ID NO: 120837 - DNA, 601 bp, Human
gcacaggccacaacctgtgcttgtgactggtgtctgaagttggagggagggcagcctcgtgtgaacgagccctcgacctgtgggatatgatgctatctccaggtagctagtgaaataattgaattgaattagagagcatggagctggtgttcactggagaattcactgcagaattacttgcttggtgtgtggggaaaaacccacatgcatccagggtcacaggtgtgttctgtgttgtggtgagtagagaaaaggaaaaacatactctggtttttcctctgtgtgtgtctcacatgatggygtaactgctttgtgcttaataaacagcaagcaggggtgctgtattagtccgttttcatactgttaaaaagaactgcctaagactgggtaatttataaaggaaagaagtttagttgactcacagttcagcatggctggggaggcctcaggaaacttacaatcatggtggaaggagaaaaggcatcttcctcacaaagcggcaggaaggagaagtgctgagcgaagggggaagagctccttataaaaccataaggtctcatgagaacccactcactatcacgagaacagcatggggggaacc

SEQ ID NO: 120838 - DNA, 601 bp, Human
ttagagagcatggagctggtgttcactggagaattcactgcagaattacttgcttggtgtgtggggaaaaacccacatgcatccagggtcacaggtgtgttctgtgttgtggtgagtagagaaaaggaaaaacatactctggtttttcctctgtgtgtgtctcacatgatggcgtaactgctttgtgcttaataaacagcaagcaggggtgctgtattagtccgttttcatactgttaaaaagaactgcctaagactgggtaatttataaaggaaagaagtttagttgactcacagttcakcatggctggggaggcctcaggaaacttacaatcatggtggaaggagaaaaggcatcttcctcacaaagcggcaggaaggagaagtgctgagcgaagggggaagagctccttataaaaccataaggtctcatgagaacccactcactatcacgagaacagcatggggggaaccacctccatgattcagttacctccacctggtctctttcttgatatgtgggcattgtgggggttacaactcaagatgagatttgggtggggacacaaagcctaaccatatcaggtgccttgaatgaatga

SEQ ID NO: 120839 - DNA, 446 bp, Human
atggctggggaggcctcaggaaacttacaatcatggtggaaggagaaaaggcatcttcctcacaaagcggcaggaaggagaagtgctgagcgaagggggaagagctccttataaaaccataaggtctcatgagaacccactcactatcacgagaacagcatggggggaaccacctccatgattcagttacctccacctggtctctttcttgatatgtgggcattgtgggggttacaactcaagatgagatttgggtggggacacaaagcctaaccatatcaggtgccttgaatgaatgaaaggaccaccagtccctgtgaccaggcagctaatgagcatttgctgagctgtcctgggtgccaaggacagagaatcccaagttgtggtctttccctcaaggaacttgagaacgaagataggaacaggctgggcgcagtggctcatgc

SEQ ID NO: 120840 - DNA, 601 bp, Human
ccaagggtccatcaacagatgaaaggataaacaaaatgtagtggatccatacaatggaatattattcagtcttaaaaaggaatgaggctgggcacggtgactcacgcctgtaatcccagcaccctgggaggccaaagcgggtagatcacctgaggtcaggagtttgagaccagcctggccgacatagtgaagccctgtctctactaaaaataaaaaaaattagccaggcatgctggcggatgcctgtaatcccagctactcgggaagctgaggcaggagaatcacttgaacctgggaggcsaaggttgcagtgagctgagattatgcctctgcattccagcctgggcaacaagagcgaagctctgtctcaaaaaaaaaaaaaaaaaaaaggatgaaattctattgggggcagggtggctcatacctgcctatagtcccagttacttgagaggctgaagtgagaggatcttgggagcccaggagcttgagactgcagtgagctttgatcacaccactgtactctagcccaggtgacagagcaagaccctgtctctattaattaaaaaaaaaaagagtaaaattctgaaaatatggatgaacc

SEQ ID NO: 120841 - DNA, 601 bp, Human
aatgtagtggatccatacaatggaatattattcagtcttaaaaaggaatgaggctgggcacggtgactcacgcctgtaatcccagcaccctgggaggccaaagcgggtagatcacctgaggtcaggagtttgagaccagcctggccgacatagtgaagccctgtctctactaaaaataaaaaaaattagccaggcatgctggcggatgcctgtaatcccagctactcgggaagctgaggcaggagaatcacttgaacctgggaggccaaggttgcagtgagctgagattatgcctctgcaytccagcctgggcaacaagagcgaagctctgtctcaaaaaaaaaaaaaaaaaaaaggatgaaattctattgggggcagggtggctcatacctgcctatagtcccagttacttgagaggctgaagtgagaggatcttgggagcccaggagcttgagactgcagtgagctttgatcacaccactgtactctagcccaggtgacagagcaagaccctgtctctattaattaaaaaaaaaaagagtaaaattctgaaaatatggatgaaccttgaaaacgttatgctaagaggaataagccggtc

SEQ ID NO: 120842 - DNA, 601 bp, Human
ctgaagtgagaggatcttgggagcccaggagcttgagactgcagtgagctttgatcacaccactgtactctagcccaggtgacagagcaagaccctgtctctattaattaaaaaaaaaaagagtaaaattctgaaaatatggatgaaccttgaaaacgttatgctaagaggaataagccggtcacaaaaggacaaataactgtgtgattcttcttgtatgaaatatccagaataggcaagttcatagagacagagagtagaatcgtggatgctggggactgagggtgaggggaaatggaarttattgcttaatggttatagagtttgtgttggggtgatgaaaaagttttgaaaatagtggtgatggttgcacaacattgtgaatgtacttaatgctactgaattgtacgcctgaaaatggttgcagtggtaaattttatgctatgtgtatgttaccacaataataaaacacaaccctgaggagtaagcagaaccctggaataattgatgtcagagctgacatgcagagacccagggcaggcactgggtggacctcagatgtagggctttgtctgagttgaaatgcggtgtgattttttat

SEQ ID NO: 120843 - DNA, 601 bp, Human
aaaaaaaaaaagagtaaaattctgaaaatatggatgaaccttgaaaacgttatgctaagaggaataagccggtcacaaaaggacaaataactgtgtgattcttcttgtatgaaatatccagaataggcaagttcatagagacagagagtagaatcgtggatgctggggactgagggtgaggggaaatggaaattattgcttaatggttatagagtttgtgttggggtgatgaaaaagttttgaaaatagtggtgatggttgcacaacattgtgaatgtacttaatgctactgaattgtacrcctgaaaatggttgcagtggtaaattttatgctatgtgtatgttaccacaataataaaacacaaccctgaggagtaagcagaaccctggaataattgatgtcagagctgacatgcagagacccagggcaggcactgggtggacctcagatgtagggctttgtctgagttgaaatgcggtgtgattttttatttctgcatagcagtgctgtttttgaaataggttaagaaactagagaaacatggggtgggaatttgtacttaattcagtacttccattcccctatagtcagaagtaagag

SEQ ID NO: 120844 - DNA, 601 bp, Human
cattgaaaggccaccacaatcattagtcaggacattgatcaatgtcacattgatagcagagatagcctcagacctttactggctcttcctagtgatgatggtgaaggtgttagcacctttcatttgttcagggctctgaagtcttcctgaactctaatttcatttgaacctcttgtggctcctataggatggagagggacagatacagaaaaagattcagggggttgtctaaggtcacaggcttggttaagcggtaccattaggagtagtaggtatgttttttggctctttctacttgtcyacctttggacttgtagtgtgtgctcaattacaaatgcctctcaacttatgatgaggctgtgtcccaataaacccaatcgtaagttgaaaatactgaaagtagaagatgcatttaatacacttaacctactaaacattatagattagcctaacctaccttaaacatggtcgaaacactcacattagcctactgttggacaaaatcatctgacacaaagcccatttgataataaagtgttgaatagctcatgtaatttattgaatactgtattaaaagtgaaaaatgaaatggttgtatggg

SEQ ID NO: 120845 - DNA, 601 bp, Human
tttgtatttcctgtagaaatggggtttcatcatgttggccaggctggtcttgaactcctgaccccaagtgatctgcccgtctcgtcctcacaaaatgctgggattacaggtgtgagccactgcgcctggcctttctggggtatatttggcttaagttagttggaagggctctctttattttttattctgcctcccactgaagagacagagttcgctcttgtcacccaggctggagtgctttggcgtgatcccagttcactgcacctccatctcctggattcaagtgattctcctgcctcakcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatcctcttcatcctgttctg

SEQ ID NO: 120846 - DNA, 601 bp, Human
gattctcctgcctcagcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatccycttcatcctgttctgtacttcgttttctctcattactgaattagctggcagcattccttatttgccacagagctatttcttaaaagctgtacttacactcaggatacagttttccttggtatagaactcttccatggcattgctctttcactgagctttattaaccctcaggcttccagtaccccttcttctgctctccccacttcattccctatcatcttacaaaggcttcttcaaccaggaattggcatgagctgaccgtgtatgggaagagattgtcagttaacctcattattgtaa

SEQ ID NO: 120847 - DNA, 601 bp, Human
tagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatcctcttcatcctgttctgtacttcrttttctctcattactgaattagctggcagcattccttatttgccacagagctatttcttaaaagctgtacttacactcaggatacagttttccttggtatagaactcttccatggcattgctctttcactgagctttattaaccctcaggcttccagtaccccttcttctgctctccccacttcattccctatcatcttacaaaggcttcttcaaccaggaattggcatgagctgaccgtgtatgggaagagattgtcagttaacctcattattgtaaatgctcagtgttcagaatgctg

SEQ ID NO: 120848 - DNA, 601 bp, Human
cccttaagtgaggggtggggcggggtgggagagaggagcagtctagagtcttaagggcagagcctgctttgcgaagcccaccctggccatgcctgactttttcagcaacggaaaaatgtacattttgaaattccccgtcatggaaagtgttatgaaactcttgggtagacgtttcgaaatcttttaatgttcaggctacataataatttttaaatactaactataataattcaggactattttaaaaattgttaaattccttgttaaattcttgggatagaacagtggctgtcaaacatcttttttttttttttttttgagatggagtctcgctctgtcgcccaggctgtagtacaatggtgtgatctccactcactgcaacccctcctcccaggttcaagcgattctgctgcctcagcctcccgagtagctgggattacaggcatgcaccaatgcgccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcc

SEQ ID NO: 120849 - DNA, 601 bp, Human
cctgctttgcgaagcccaccctggccatgcctgactttttcagcaacggaaaaatgtacattttgaaattccccgtcatggaaagtgttatgaaactcttgggtagacgtttcgaaatcttttaatgttcaggctacataataatttttaaatactaactataataattcaggactattttaaaaattgttaaattccttgttaaattcttgggatagaacagtggctgtcaaacatcttttttttttttttttttgagatggagtctcgctctgtcgcccaggctgtagtacaatggtgygatctccactcactgcaacccctcctcccaggttcaagcgattctgctgcctcagcctcccgagtagctgggattacaggcatgcaccaatgcgccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcccagcctgtcaaacttatttgaccacaacccatagcaagaaacattttaccttgtgctcaaat

SEQ ID NO: 120850 - DNA, 601 bp, Human
aaagtgttatgaaactcttgggtagacgtttcgaaatcttttaatgttcaggctacataataatttttaaatactaactataataattcaggactattttaaaaattgttaaattccttgttaaattcttgggatagaacagtggctgtcaaacatcttttttttttttttttttgagatggagtctcgctctgtcgcccaggctgtagtacaatggtgtgatctccactcactgcaacccctcctcccaggttcaagcgattctgctgcctcagcctcccgagtagctgggattacaggmatgcaccaatgcgccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcccagcctgtcaaacttatttgaccacaacccatagcaagaaacattttaccttgtgctcaaatacacatatctgtaggcaaaacaaaatagaaaaaggaaaatacaatctggtggaacagcccctccccttaacttgcagggga

SEQ ID NO: 120851 - DNA, 601 bp, Human
cctgtgcaatttgtctcaaacaaacaaacaatagcaaaagagctgaacacaaactagtagatgacatgataccatttctgaaataaaatattcatatatggacacatcatctataaactgcatttcaaacaatttttatactaagatcttaatagtgattatttctgggtgacagttgagtgctgtttttacttctgtacgtctttatatttaaaagaatgagcatcccatatatacataaatatatatataaatcccacatataaatatatacataaatcccatataaaaatataaataaatatatatatatatacacacacacacacacacacacacacacatatatatatattttttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctc

SEQ ID NO: 120852 - DNA, 601 bp, Human
tgtgcaatttgtctcaaacaaacaaacaatagcaaaagagctgaacacaaactagtagatgacatgataccatttctgaaataaaatattcatatatggacacatcatctataaactgcatttcaaacaatttttatactaagatcttaatagtgattatttctgggtgacagttgagtgctgtttttacttctgtacgtctttatatttaaaagaatgagcatcccatatatacataaatatatatataaatcccacatataaatatatacataaatcccatataaaaatataaatataaatatatatatatacacacacacacacacacacacacacacatatatatatattttttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctcag

SEQ ID NO: 120853 - DNA, 601 bp, Human
gtgcaatttgtctcaaacaaacaaacaatagcaaaagagctgaacacaaactagtagatgacatgataccatttctgaaataaaatattcatatatggacacatcatctataaactgcatttcaaacaatttttatactaagatcttaatagtgattatttctgggtgacagttgagtgctgtttttacttctgtacgtctttatatttaaaagaatgagcatcccatatatacataaatatatatataaatcccacatataaatatatacataaatcccatataaaaatataaatatatatatatatatatacacacacacacacacacacacacacacatatatatatattttttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctcagc

SEQ ID NO: 120854 - DNA, 601 bp, Human
gaacacaaactagtagatgacatgataccatttctgaaataaaatattcatatatggacacatcatctataaactgcatttcaaacaatttttatactaagatcttaatagtgattatttctgggtgacagttgagtgctgtttttacttctgtacgtctttatatttaaaagaatgagcatcccatatatacataaatatatatataaatcccacatataaatatatacataaatcccatataaaaatataaatatatatatatatatatacacacacacacacacacacacacacacayatatatatattttttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctcagcctcccgaaatccggggattacaggcataagtcattgcgcct

SEQ ID NO: 120855 - DNA, 601 bp, Human
agtagatgacatgataccatttctgaaataaaatattcatatatggacacatcatctataaactgcatttcaaacaatttttatactaagatcttaatagtgattatttctgggtgacagttgagtgctgtttttacttctgtacgtctttatatttaaaagaatgagcatcccatatatacataaatatatatataaatcccacatataaatatatacataaatcccatataaaaatataaatatatatatatatatatacacacacacacacacacacacacacacatatatatatatattttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctcagcctcccgaaatccggggattacaggcataagtcattgcgcctggctccttata

SEQ ID NO: 120856 - DNA, 601 bp, Human
tatatatataaatcccacatataaatatatacataaatcccatataaaaatataaatatatatatatatatatacacacacacacacacacacacacacacatatatatatattttttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggytttgctgtgttggccaggctggtctcgaacttctggcctcaagttatccggctgcctcagcctcccgaaatccggggattacaggcataagtcattgcgcctggctccttatatgattttaaaacggcaggatataaggagcaatggaatgaagccagtgggactgcagaaggcaggtggaagcagacagggaactttggagctagagtgacttgaaggacgcttgatggatataattgtaagagtcctgtctcaggagagctgatgcgctgtaaatgttgtaaatagaacattttctta

SEQ ID NO: 120857 - DNA, 601 bp, Human
gctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctcagcctcccgaaatccggggattacaggcataagtcattgcgcctggctccttatatgattttaaaacggcaggatataaggagcaatggaatgaagccagtgggactgcagaaggcagrtggaagcagacagggaactttggagctagagtgacttgaaggacgcttgatggatataattgtaagagtcctgtctcaggagagctgatgcgctgtaaatgttgtaaatagaacattttcttaaagaaccttccactgctatgtttagtattcagtttagcaaacttttcctgggtagctactgggagtcccgcacagtgttaggagttggggtacacacctgccatgttggtggaaatcctgaagggagtgggccacacaccctggaagaaggggctttcctgaggaaggacagcctga

SEQ ID NO: 120858 - DNA, 601 bp, Human
ggaggataatttgagctcaggagtttgagaccaggctgtaaccccaggcaggagtacagtggtgcagtcatagctcactgcacccttgacctcctgggctcaagccatcttcccacttcagcctccaagtagctgggactacaggtgtgtgccactatgcctggcttattttttgtagagatggggtttggccatgttggccagcctggtgtcaaactcctaagctcaagggatccacctgcctcagcctcccaaagtgctgtgctgggattacaggcgtgagccaccacacccagcccawgtatatttatcgagtgctgtatgtcatgatagtgggtggtttgggggaataccaacataaataagtgggaggtttctatcctagaggagtttattgtgctctgttctctctggattgttcacaaaccagaatgccgatcaaagactttgctagggttgtgggtgggcgacttgctcaggagatccctggcacccaaatgagtgcccagaaatcactctgaatggtcaaaagtaaggcagggcagggcggtagagcacagggtgtcgaattaatttcatgtgggggctgaaatcccaggtc

SEQ ID NO: 120859 - DNA, 601 bp, Human
ctttgttggtgggagtgtaaaatgctacagctatgatggaaaatcatatggtagttcctcaaaaaattagacatagaattgccatatgatgcagcaatgctgcttctgggtatataccccaaataactgaatgtggggtctcagagatatttgtacacttgtgttcatagtagcattattcacaatagccaagaattagaagtaactcatgttcatcaatggatgaaataaaatgtggtttatatgtacattggaattttttttttttttttgaaacagggttttactctgtcacccgggmtggagtgtggtggcaccattacagctcactatagacttgacttcctgggctcaggtgatcctcccacctcagcctcttgagtagctgagactacaggtgcatgccaccatgcctggctagttttttgtattttttgtagagataaggttttgccatgttgtccaggctaatcttgaactcctgggctcaagcaatctacctgctgcggcctcccaaagtgctgggattgcaggcatgaaccaccgtgcccagccatacaatggaatgttattcagcctttaaaaaaaggaaatgctggct

SEQ ID NO: 120860 - DNA, 601 bp, Human
gaaccaccgtgcccagccatacaatggaatgttattcagcctttaaaaaaaggaaatgctggctgggtgcggtggctcatgcctgtaatcccagcactttgggaggccaaggtgggcggatcacctgaggtcggcagtttgacaccagcctgaccaacatggagaaaccccatctctactaaaaatacaaaattagtcgaacatggtggtgcatgcctgtaatcctggctacttgggaggctgaggcagaagaatcacttgaacccgggaggcagaggttgcagtgagtcgagatcccgcsactgcactccagccagggcaacaagagcaaaactccggctcaaaaaaaaaaaaaaggaaatgctgacacatgatacaacaaggacaaaacttgaggacatcatgctaagtgaaataagccagacacaaaaagacaaatactgtatgagtccactaatgtgaggttcctcaaatagtcaaattcatagagacagaaaatagaatggtgtcttccaggggcttgatgggggagggaatgggaagttactgcttaatgggtacagagtttcagttttgcaagatgaaaagagttctggagatg

SEQ ID NO: 120861 - DNA, 601 bp, Human
aggtgggcggatcacctgaggtcggcagtttgacaccagcctgaccaacatggagaaaccccatctctactaaaaatacaaaattagtcgaacatggtggtgcatgcctgtaatcctggctacttgggaggctgaggcagaagaatcacttgaacccgggaggcagaggttgcagtgagtcgagatcccgccactgcactccagccagggcaacaagagcaaaactccggctcaaaaaaaaaaaaaaggaaatgctgacacatgatacaacaaggacaaaacttgaggacatcatgctaastgaaataagccagacacaaaaagacaaatactgtatgagtccactaatgtgaggttcctcaaatagtcaaattcatagagacagaaaatagaatggtgtcttccaggggcttgatgggggagggaatgggaagttactgcttaatgggtacagagtttcagttttgcaagatgaaaagagttctggagatggatggtgtgatggttatataagaatatgaatgtacttaatgccactgagttatatacttaaaatagttacgatacaagttttatattgtgtttattttaccacaacttt

SEQ ID NO: 120862 - DNA, 601 bp, Human
ccatgcaaggaataaccataccccaagagatcatgctgagcctgtagtttgcctgtctgcatcccccaacccccccagcttatttttattttattttttactttttattattttagacagggtcttgttctgttgctgaggctggagtgcagtggcatggtcatggctcctgcagcctccacctcctgggcttaagtgatcctccctcctcagcctcctgagtagctgggactagaggtgcatgccactgtgccagattaactttcttaatttttttttttttttgagacagtggtcactytgtcacccaaacttaagtgcagtggctcaatcttggctcactgcagcctcaacctcctgggctccagggatcctcccaccttagcctcccaagtagctgagactacaggcatgtgccactacacctggctaatttttttttttttttgacggagtcttgttctgttgcccaggctggagttcattggcgctatcttggctcactgcaacctctgcctcgtgggttcaagctattctccttcttcagcctcctgtgtagctattattacaggcacctgccaccatacccagctaatttttt

SEQ ID NO: 120863 - DNA, 601 bp, Human
tgctgaggctggagtgcagtggcatggtcatggctcctgcagcctccacctcctgggcttaagtgatcctccctcctcagcctcctgagtagctgggactagaggtgcatgccactgtgccagattaactttcttaatttttttttttttttgagacagtggtcactttgtcacccaaacttaagtgcagtggctcaatcttggctcactgcagcctcaacctcctgggctccagggatcctcccaccttagcctcccaagtagctgagactacaggcatgtgccactacacctggctaatttttttttttttttgacggagtcttgttctgttgcccaggctggagttcattggcgctatcttggctcactgcaacctctgcctcgtgggttcaagctattctccttcttcagcctcctgtgtagctattattacaggcacctgccaccatacccagctaatttttttgtatttttagtagagacggggttttgccgtgttggccaggctggtctcaaactcctgatctcaggtgatccacccgcctcagcctcccaaagttctgggattacaggcatgagccaccatgcctggcctgcc

SEQ ID NO: 120864 - DNA, 601 bp, Human
catgtgccactacacctggctaatttttttttttttttgacggagtcttgttctgttgcccaggctggagttcattggcgctatcttggctcactgcaacctctgcctcgtgggttcaagctattctccttcttcagcctcctgtgtagctattattacaggcacctgccaccatacccagctaatttttttgtatttttagtagagacggggttttgccgtgttggccaggctggtctcaaactcctgatctcaggtgatccacccgcctcagcctcccaaagttctgggattacaggcrtgagccaccatgcctggcctgcctggctaatttttgtattttttgtagagatggggttttgccatgttgcccaggctggtttcaatctcctgtgctcaagtgatccatccatgtgcttcagccttccaaagtgctgggattacaggtgtgagccacagtgccaagcctaaaattttttgtatagttggggatctcactatgttgcccaggctggtcttgaactcctggtctcaagcgatcttcccacctgcttcagcctcccaaagtgctgggattacagacgtgaaccactgcagccag

SEQ ID NO: 120865 - DNA, 601 bp, Human
tagtaacactgtagtagctaatgaaaaatattccaggttgtgaactttggggtgtctgagagcagcatgatgtcgtagtcataaactgagagtcatgaattggtttctgggctgggtgtggtggctcacacctgtagtcacagcacttggggaggccaaggcaggaggatcacttgaggccaggaattcaagaccaggctgggcatcatagtgagacctcatccctacaattttttttttaaaggaattggcttctagtcaatgctttgtcaaataccagtcttgggacattagatgaagytccttcatctaatgtttttctaatacataaaacagtaataacagatttttgtttggtatctcatccagttgttgcaaggattaaacggggtaatgtacctgggagttccttgaagagtctaattttctacccagttttggctgttgttttggattaaactgtactaccccgagccttttcttgattttggaggatccctacccactccctactcatggtacccctggcctgttctggtagattcactcatgcatcatcaccagtcctgtggggaagtggaaatttggtgtacataccagg

SEQ ID NO: 120866 - DNA, 601 bp, Human
agttccttgaagagtctaattttctacccagttttggctgttgttttggattaaactgtactaccccgagccttttcttgattttggaggatccctacccactccctactcatggtacccctggcctgttctggtagattcactcatgcatcatcaccagtcctgtggggaagtggaaatttggtgtacataccaggtgcactttcattcttctcaaaatgttatgacaaatagcaaagagaacaccttttcttttatcattagctcatccttaagcatctcgttaggggtaaagcaattwaaaaaaaaaaacaagttttagctagacgtggtggcatgcccctgtcatcctagctgctctggaggctgaagtgagagggtcccttgagtccaggagttggaggctgcagtgagctatgattatgccactgcactccagcctgggtagcagagcaagactctcatctctgaaaaaaaaagaaaagaaaaagaaacaacaacatcaaacaaagaaacaaaagcaagtttataaataaagaaacagaatagcagggacatggatgcagctggaaaccatcattctcagcaaactaacataaga

SEQ ID NO: 120867 - DNA, 601 bp, Human
atgcccctgtcatcctagctgctctggaggctgaagtgagagggtcccttgagtccaggagttggaggctgcagtgagctatgattatgccactgcactccagcctgggtagcagagcaagactctcatctctgaaaaaaaaagaaaagaaaaagaaacaacaacatcaaacaaagaaacaaaagcaagtttataaataaagaaacagaatagcagggacatggatgcagctggaaaccatcattctcagcaaactaacataagaacagaaaaccaaacacggcatgttcttactcataartgggagctgaacaatgagaacacatggacacagggaggggaacatcacacaccggggcctgtcggggggtggggggcctaagggagagatggcattaggagaaatacctaatgtagatgacgggatggtgggtacagcaaaccaccatggctcatgtatacctatgtaacaaacctgcatgttcggcacacgtatcttagaaattagagtataataaaaaaattttaaaaaaaagaaacatagaataaaaaccatacctaatttagtaagagaggcattccccccaagctcctcacgttt

SEQ ID NO: 120868 - DNA, 601 bp, Human
gcagctggaaaccatcattctcagcaaactaacataagaacagaaaaccaaacacggcatgttcttactcataagtgggagctgaacaatgagaacacatggacacagggaggggaacatcacacaccggggcctgtcggggggtggggggcctaagggagagatggcattaggagaaatacctaatgtagatgacgggatggtgggtacagcaaaccaccatggctcatgtatacctatgtaacaaacctgcatgttcggcacacgtatcttagaaattagagtataataaaaaaatttwaaaaaaaagaaacatagaataaaaaccatacctaatttagtaagagaggcattccccccaagctcctcacgtttatttatttatttatttagagacagagcctcgctctgttaaccaggttggagtgcagtggcgtgatctcggctccccgcaacctctgccttccgggttcaagcaattctccctacctcagcctcctgagttgctgggactacaggtgcccgccatcacccccagctaatttttgtatttttagtagagacggggttttgccatgttggccaggttgatttcaaactc

SEQ ID NO: 120869 - DNA, 601 bp, Human
tgagatcaggagggagcattctgacgctgagcacacctctgactttgcacatggtggtttcgaggggttgacagcagaagatctccagagtctagtaacagttctgtcttactgttcaaatttgccttttctacctcaatttctcctccattttaacagaaaacctactactactacttcatatgtatctaaaatatttcaaaatctttagtaatgggatataagcactcttagccatcagaataacttttaaggtcaggtgcagttgctcacacctgtaatgctagcactttgggaggcygaggcaggaagatcacttgagcgcagaagtttgagaccatcctaggcaacatagtgagacctcatctctataggaaattaaaaaaattagccaagagtggtggcatgggcctgtattcccagctactcaggaggctgagttgggaggattgcttgagcctgagaggtggaggctgcagtgagtcgagatcgcgccactgtactccagcctgcgtgacagtgaggccctgtctcacaaacaacaacaacaacaacaaaaacttttaaagattagtaagcaatttttttctttggaaaaaat

SEQ ID NO: 120870 - DNA, 601 bp, Human
gggattgcaggcacacgccaccatgcccagataattttttgtattttagtagagatggggtttcaccgtgttgcctaggctggtctgagctcaggcaatccacccgcctcggcctcccaaagtgctaggattacaggcatgagccaccgtgcccagccttatcatcccttttctgcagataagtaaagatgaattaccttgccaatgtcatgtcactgtacgaggtggagctgaacttgggcctaggatgtttagctcaagcttaactactgctccaggaatctaatgcgctgccactcgracttcaggaagacaagagctcagacactgaaaaccagtcagcaaggccaaaacaagagagcccccagttctgccaacttggtgcaatttttactataaccatagctgggaaaaatgaagaagaaaaaaattcactggagttgcaatgaatatttaaacattgcgtcaagtttaaagcatgatgagtgtcaagccagttgagttttctgcattaacttcagctgacaactcagtttatatctattataaatgtcactatttgttgggggaaaaataatcttcctcttttttatttttaatt

SEQ ID NO: 120871 - DNA, 601 bp, Human
cttttttttccctctccttccccccgtaatactttatgaatagatgtttccacttctgaatagttctccgattagaatagcagttacaaaatgggtaagacttcacctcgtcctttaaaacaggaaaattgatagaattcctccacctcctttcattactgaggctgtcagatgattctttaagcaaaaccccagtgttctcttgtctgatgaagtcagtgtaagtgatggtatttttacattgactttaatatgaaaggaactgtttaattgaacggtttcatctcaaggccaggctttrgactccttcttgggctcatgcatgggatccttcttttgcacacctgtggcctccctggaactacttctggtggtttccctggacttagtatcccccaaacctggcagcccagggcctagtgacaggcagaggaatgtattgctcttgctctgtggggtcaggtagggccgggggaggtcctgcatgaatattttcagtgctgattcagaaagagcattgggcatacacttcaggaaaccctacctggaagctacagcagcactgctctatcctagactgaccacttcagatatttccaac

SEQ ID NO: 120872 - DNA, 601 bp, Human
tagactccttcttgggctcatgcatgggatccttcttttgcacacctgtggcctccctggaactacttctggtggtttccctggacttagtatcccccaaacctggcagcccagggcctagtgacaggcagaggaatgtattgctcttgctctgtggggtcaggtagggccgggggaggtcctgcatgaatattttcagtgctgattcagaaagagcattgggcatacacttcaggaaaccctacctggaagctacagcagcactgctctatcctagactgaccacttcagatatttccarcgcggagctggatgtggctaggaaccggctcccagctgaatagcttgtgctgagtcattatcaagttgcatttcctggctcaaccaaagataagcagggaagaacctaaatcaaaaatgactttcagactgtgatttgggttagtataccacctcagggcagcaatggagtcatgactgcacagacacgggaaaggatctggttgcagaaaccaagtgagtcagtgatgatgtatcatcattctaaaaaacgtacctgtactttcttttttttttgagacgagtttcactcttattgccc

SEQ ID NO: 120873 - DNA, 601 bp, Human
agtacacttatattttgacacctgatccaaaacacagtcatgtaccacattacaatgtttcaatcaatatatagcatacaaaaaaaaaacaacaacaacagtagtcctatgagataagagctgaaaattccttattacttaaatgttattttgaaagtcaacatttttcttctacatattttactcataagcatggcaaaatgttacaggtctcattgtcaccactgcaatatgcatactgtgatggaagcataacctatctcaatttagccacattaactatttttggacaccttgatcracagtgcccattctcatctagcatgaggctttttttttttggagacggagtctctctttgttgcccaggctggagtgcagcggcgcaatctccactcactgcaacctccgcctcttgggttccagcgattctcctgcctcagcctcccgagtagctgggactacaggtgtgtgccaccacacccagctaattttgtattttttagtacagacagggtttcaccatatcggccaggctggtctcgaactcctgacttcgcgatccgcccacttcagcctcccacagtgctgggattacatg

SEQ ID NO: 120874 - DNA, 601 bp, Human
cacgcctgtggtcccagctactagggaggctgaggtgggaggattgcttgggcctgggaggtcgaggctgcagtgagctgtaatagggccactgcactccagcctgggtgacagagtgagaccctgtttcacataaataagtaagtagtttaaataaataaataaatacaaatttttaaaaatgtatatctaaataagagacagggcttaattactattgcaaacattttattaccttagcagattgtaagggttgaaaccaaaacttcaagttttacttgtttagaaactccaacagttctaatgaataaagaggattataaaatcctgggaaggattagcatatgctgcttgaggtcacactgctcgttagccataccatggatgatttgcaggcaacccgttttttcctcctaagcttgaaagctaaaaatagaattaaaggtgataagggcatcaattcccagacagctaagctgtttaaaccatttatttatttatttatttatttatttatttatttatttgagacagagtctcactgtgtcacccaggctggagtgcagtggtgcaatctcgactcactgcaacctctgcctcc

SEQ ID NO: 120875 - DNA, 601 bp, Human
atatatatatatatatatatttttttttttttagtagagacagggtttcaccatgctggtcaggctgctcttgaactcctggcctcaagtgatctgcccaccttgacctcccaaagtgttgggattacgggcgtgagccaccgcacccaaccggttttttactaaattttaaaaattacaaggttaaaatacaatgaaatactcaaggaattgcgtcaaccatctcttttgtacagactgagatgactctcctggtgaccctgaactcgtaggggcagcaggtggaaatgtacattcactmcttggtggaaagaagtctgaattggggaagtatttatacatatgtgaaattccattgtactagggtgtcctgtattttatctggtaaccctgggggcagtcctatgagctggggcacctgccctggagactgaggcagggagtcaaagcgacatgagattggggataggttttgcatgtccgtggaaagggcttgctgatgaatttgatttgaagattgagaaacagaggaatcaagggcgacttcttggttttaaacttcagcacctggtgccctttactgagatggagaagatgggag

SEQ ID NO: 120876 - DNA, 601 bp, Human
ccaaataagaaattcttggctgggcatggtggcttatgcctgtaatcccgcactttgggaggtcgaggcaagcggatcacctgaggtccaggagttcgagaccagcctggccaacgtggcgaaaccccgtagctactaaaaatacaaaaaattaactgggcatcgtggcacatgcctgtaatcccagctactcaggaggctgaggcaggagactctcttgaacctgggaggcagaggttgcagtgagccgagattatgccactgcattccagtctgggtgacagagtgagactccatctgaaaaaaaaaaaaaaacaaaacaaaacagagaagaaattccttcattataaggaaaaaagaaatgcacataagcacagttacaatattatatttcctgactaaaaatatgtcttcttttaatggactacaaatattataatttttcttaaaatggcccgtgtgtaaaaagtttattcccctttactttacttttatatagtaatgaaatttcataattaaatctatattttgtattatcaatatttaaccactagaagaattgatgatgctacttattgaaaatgacaagtgatgtaataga

SEQ ID NO: 120877 - DNA, 601 bp, Human
atacgtgtgtgtatatatatataagttatatatatataacttgtatatgttactttttatatataataaaatatattatatttttaaataaaatatattatattttaaaatataatatgtaactcgtacatagcacatattatatgtaatgtatcctatacataaccttatgttgtacataaatatgtatattgtttacctattgtactatatgtacatgtataacttgtctatgtattatgtattataataaaatacattgatacttgtatacataatttgtacacaatggaaaacattkttaaaattttagactaaggggaactgagcacaaaacctaagggcctcgaaactctgattttatacatatataaaattatacatatatgtatataaaatataccttttaaataaggtatatatgatgggaaaattaaaaatttgcaagggcaaaaccaaaaatagctgtagatgaacattgcggtagtttagcctatttcttttcagacttttttctattcatttgtaccttttccctcacaaaatgatatcatgctatatatactgtttttacattttttcacttaaatatattgtgaat

SEQ ID NO: 120878 - DNA, 601 bp, Human
ttcctgtgcatagggataccagaaagaagcagaagacttgaatctcaaatgtaataaaagatgacattaaggttgaagaattttttaaaaattaaaattctaaaaatgtaaggagaggtaaagcaagaagtgaattaggaaactacagaaacaaccatatctcacattaaacttaagctactaattactagtgacagattaatatagttctaagaagactcaataatccttagctttctaaaaaatagaacatttgtcaaaatcttttaaaacaattatatatatattttttgtttgtttttttttgtttttttttagatggagcctcactcttttgcccatcctggagtacagtggtgctatcttggctcacagcaacctccacctctcaagttcaagcaattctcctgcctcagctcctgagtagctgggatcacaagcatgcaccaccacgcctggctaatttttgtatttttagtagagacagggtttcgccatgttggccaggctggtctcgaactcctaacctcaggtgatcctcctgcccgggcctcccaaagtgctgggattacaggcatgagccaccacaccaggcctaaaa

SEQ ID NO: 120879 - DNA, 601 bp, Human
gccaactccttattcagacccagagacatccctcctgtgttgaggggggtgcaccctgtaactagctagctagtcttaaacccacttcccacctcacccccctttcccaattgaccctcaatagtcaaagtgaatggaggctggcaggcaccttggacacaggttctatcccagtctttactctttccaacactccttcagacacctctttctcacttctcctaaatcatatcctcctcccttctagggggagcctgatggctcaccttagtcacagacaggagctgacacctaaccatcraagcagctctgtggtggaggtgatgcccacaccatggacggaagcagctccacgggccatggtcatagcctagaggtgacgcccacaccatggaggcagctctgtgatctgagggattcccggcaccgaaacagcattgccttaattgcccccaaacactgttcctattacacatgacatttaaaccttagggagttacattcataatgttaggttgcctaaagaaaaaaaacaaaaacaaaagcaaactgaaaaagccttaagtagggccttatgttgcaggctggtcagatagagaaa

SEQ ID NO: 120880 - DNA, 601 bp, Human
aaaaaaaacaaaaacaaaagcaaactgaaaaagccttaagtagggccttatgttgcaggctggtcagatagagaaagccgtgctatgcagcttggccagcccgggttaccagctcaccaactgtgcccaccctggctgctgggagattttattgaggaaaaatattggagaatgtttgaaaataatgaccatggtatgtaaggcaaaaaatcttagttgtttaaataaagacggtctggctaggtccttttcagttctctctcttttaaaagtgatttaggtgctgggtgcagtggctcaygcctgtaatcccagcactttgggaggccgaggcgggtgtatcacctgagatcaggagttggagaccagcctggccaacatggtgaaaccctgtctgtactaaaaatacaaaaattagccatgcttggtggcggacgcctgtagtccccactacttgctactcaggaggctgaggcaggagaatcgcttgaacccaggaggcagaggttgcagtgagccgagatcgcaccactgcactccagcctgggcaacagagggagactccatccaaaaaaaaaaaaaaaaaaacaggaatttggga

SEQ ID NO: 120881 - DNA, 601 bp, Human
ttacagcagacctgttccctacaatgttaccacattcgcatttttctcattgccttggctctggttttctggttttattttattaacttcattattgactcttttgtggtaaaacattttaaagctttttttctctgagaaagaggtagcctataaaaataatctctttgtttggcattgttaataaatagatgaaacatgcatttcaaaatacccattgtatggcaaagtggtaagagcccaggctgtagacttagcttatgacttagacttgagagcgcactcctgtgtgagtgagtcytagcctcacccctcccagctatgctgtgcgcgagtcttttaacctttctgagcctcagttttctcctctgtaaagtcatctggccgtatggtttcttcaaggattaaatgagatgctcaatatattataaatgtgtaatagaagaatactaaggtggaaatcattgtaaagtgtagctcatatcacttggaacatgtaaccactctcagtttttgtcaggagtatattgtattttctacatttctggtactttcatacagcataaggaattgcaagacctgttctgagtttgggttgctc

SEQ ID NO: 120882 - DNA, 601 bp, Human
ataaacaagttgaagttcctagaccaattggaagcctgcaggaaaaaacgcaggcctggacgcgtggcagcgatgccggagagggccgagttcccagaagagctcttgaggtttcttagtacaattcctcccccacgagatattgcctagtcacaccacctctcccccttccccaaactcctgtcatctctccttcctctagacttaactctaagccctaggcaccagatttggcagtgcttcagaattacacatcacatggggagcagcatgctcccactgtgccccagaagagtttccsggacagtgtccagagaatctgttcggtgagaaccaacttctaatgaagtttgtgagattttatttttttattatttattattattatttttttgagacggagtcttgctgtcgcccaggctggagtgcagtggcgcgatctcggctcactgcaccctccccgggccgggttcaagcgattctcctgcctcagcctcccgagtagctgggactacaggcgtgtgccaccacgcccagctaatttttgtatatttagtagagatggggtttcaccatgttggccaggatggtctccatctct

SEQ ID NO: 120883 - DNA, 601 bp, Human
caaatcccattattaagaattttcaggctgggcatggtggttcatgcctgtactttgggaggtcacaaggtcaggagtttgagaccagcctggccaacatggtgaaacctcagctctactaaaagtacaaaaattagccgggtgtggtggtgcgtgcctgtagtcccagctacttgggaggctgaggaagaagaattgcttgaacccagagggtggaggttgcagtgagccgagattgcgctactgcactccagcctgggtgacagagcgagactctgtctcaaaaaaaaaaaaaaaaaaaggcatttttatagtttctctagtctgacatgtttttaaatgctcaggtgttttagaaatatattcccattatcaaacctttctgcctgccctcccctcaatatgtccccattaccctgaaggtaggaaatatctgccatgtatcaaagtcacatgtcatcattgagacaaagaaatcaacatcggtcttcttaagaagtggagataggccaggcacggtggctcatgcctgtaatcccagcactttgggaggccgaggcaggtgcatcacctgaggtcaggagttcaagaccagcctggc

SEQ ID NO: 120884 - DNA, 601 bp, Human
atgtggccaaactcaacaccttagaaacagaagagtgagtcctcatgtgttgtcatcttggtggctttatttgccacattggatttcttgttaatattcttcacctttttcttgccgtggaacataatatgcaggaaatgttgaaatgtcttcacaggtggtttttcaaggatataaccaggaaggacgcagaaaggcagcttttggcaccaggaaatagcgctggagctttccttattagagaaagtgaaacattaaaaggtaggaaattgttcaaagcctcttttaaaacactatttargaaattatttttagaaactattctagagctactcaaggggaaaaaagggcatatagtatgctctggtagtaaaagttttatggtttgataacaaataacaaacctcagtgattagttgtgctactaaaagtaatatagttgagtgtggtggctcacacctgtaatcctaacactttgggaggccgaggcgagaggatcacttgagtccagcagttagagaccagcctgggcaacacagcaagaccccatctctacaagaaatacaaaacttagccaggcctggcagcacatgcctatagt

SEQ ID NO: 120885 - DNA, 601 bp, Human
cttggtggctttatttgccacattggatttcttgttaatattcttcacctttttcttgccgtggaacataatatgcaggaaatgttgaaatgtcttcacaggtggtttttcaaggatataaccaggaaggacgcagaaaggcagcttttggcaccaggaaatagcgctggagctttccttattagagaaagtgaaacattaaaaggtaggaaattgttcaaagcctcttttaaaacactatttaggaaattatttttagaaactattctagagctactcaaggggaaaaaagggcatatartatgctctggtagtaaaagttttatggtttgataacaaataacaaacctcagtgattagttgtgctactaaaagtaatatagttgagtgtggtggctcacacctgtaatcctaacactttgggaggccgaggcgagaggatcacttgagtccagcagttagagaccagcctgggcaacacagcaagaccccatctctacaagaaatacaaaacttagccaggcctggcagcacatgcctatagtcccagctactctggaggctgaggtaggaagatcacctgaacccagggaagggaggc

SEQ ID NO: 120886 - DNA, 601 bp, Human
ggacgcagaaaggcagcttttggcaccaggaaatagcgctggagctttccttattagagaaagtgaaacattaaaaggtaggaaattgttcaaagcctcttttaaaacactatttaggaaattatttttagaaactattctagagctactcaaggggaaaaaagggcatatagtatgctctggtagtaaaagttttatggtttgataacaaataacaaacctcagtgattagttgtgctactaaaagtaatatagttgagtgtggtggctcacacctgtaatcctaacactttgggaggcygaggcgagaggatcacttgagtccagcagttagagaccagcctgggcaacacagcaagaccccatctctacaagaaatacaaaacttagccaggcctggcagcacatgcctatagtcccagctactctggaggctgaggtaggaagatcacctgaacccagggaagggaggctgcagtgagccgtgatcacgccactgcactctaactagcctgagtgacagagtgaggcactgtctcaaaaaaaaaagagaaaagaaaagaaaagtactgtagaaagcacacatgattgtggccagttc

SEQ ID NO: 120887 - DNA, 601 bp, Human
aaggaggtcgaggctgcagtgggccgagatggcactcctgcactccagcctgggtgacacagtgagaccctgcctcaaaataaataaataaataaataaataaataaataaataaaagttttcatagtgaatgtgaacttctttggtgataagagttttttagaacaaaaatgctaaagcataacattcttttaatggttctaatggaatgtgcggttatttctggaaagagtaacatgttaggtcacacacatctgactgggtcactttttctgtgtcagctttgttgagtgaaagcaamtgtgatttctaaatggaaggggcagatggcttttaaacactctccagccccggcagaacagaagctgcagccacgtggacacgtcacctctgcatccaggttttccctctacagtcttggcccctgggatcatagccttgctcactttctcctgttggcccctcttgagcagaagtgacttttaaacacggcacatactgagccagcctatcattaattaattcttactgcactgtaagtctttctgcacatatttgcagaattcaggtaaactgtaattacatgacttcacattctccg

SEQ ID NO: 120888 - DNA, 601 bp, Human
tggcttttaaacactctccagccccggcagaacagaagctgcagccacgtggacacgtcacctctgcatccaggttttccctctacagtcttggcccctgggatcatagccttgctcactttctcctgttggcccctcttgagcagaagtgacttttaaacacggcacatactgagccagcctatcattaattaattcttactgcactgtaagtctttctgcacatatttgcagaattcaggtaaactgtaattacatgacttcacattctccgtgtggatcggcatgtgtcagaactggytggcagtgcaaatcaggtcctcagtttctgttccactcagcagattcatgggtgtgagtgctcactctgaatgttgtctcttcccatgcacactctgttgtcttcctcctcatttctctgtgtgctctttttttaattaacatgaaattcacctgacataaattaatcatttaaaaggaacaatccactggcatttagtacattcacaatattgtgtagccaccacctccatctactttcaaaatgtttttatcatcccgaaaggaaacaatgtacccaataaacaatcactcttcattc

SEQ ID NO: 120889 - DNA, 601 bp, Human
ttttgtgtctggcttatttcacctagcataatgttttcaaggttcatccatgttgtagaatgtattagaattttcttgttttatggctgagtaatattccattgcatgactataacagagtttgtttatctacttatccattggtggacctttcagttgtttttaccttttgactgttatgaataatgctgtatgaatgttcacatacaaattattatgtggacacattttcatttctcttgtgtataaacctaggagttcagttgctggggcatgtgataagcctctgttgaactttttsaagaaccacaaaactattatatgctcattaaaaaaagaatgacttggcttcttttttcctcctttgatgtttatatttatttttttccaaatctacagaatggggcaggaatagtataatgaatattgtatacccttcacatagattcaccagttgttaatattgtcctaattttcttgttcttttatatacgtacacatacatacatgttattattgccgttgaccacctgagattaagtgcagacgtgacttgctgagttttgtgaagagtgtttaagcacctaagcagtactgtgtt

SEQ ID NO: 120890 - DNA, 601 bp, Human
tgataagcctctgttgaactttttcaagaaccacaaaactattatatgctcattaaaaaaagaatgacttggcttcttttttcctcctttgatgtttatatttatttttttccaaatctacagaatggggcaggaatagtataatgaatattgtatacccttcacatagattcaccagttgttaatattgtcctaattttcttgttcttttatatacgtacacatacatacatgttattattgccgttgaccacctgagattaagtgcagacgtgacttgctgagttttgtgaagagtgtytaagcacctaagcagtactgtgttctcagggcacctgtcaggaggcatagtattagccggtcctattcttaatgatgttctatttgattttatctacagtaatccaccatcacttttatttaaagtgatccaaaagtttaaatggatcatttaaatttagtttctccgtggcaactttttactcccttttgtagtaaataaatactctgtgggaagtttaagattatgtaaatagaactttctccaaatggtttcagcacgatctgtgaattctcttccctcttagaagccgtcacttct

SEQ ID NO: 120891 - DNA, 601 bp, Human
acttctgcgttctcttcccggcttctccgtctgttcactgagagtattggcaggaaaaccaggatcgcaatcacacttaattgtgctcttagtccatctgagtacttactgtgactttgtgtggggagaaggaggagaagacaggaggaagggagaaaagagtgtacaggctctacgggccctgctctaagtgtgtttgcattgacattctcacttactcattgctgtagcactgtgaatgagaggcattactgtgatcattcgataaacaacatcactgagaatcagataagcaacttaytcaaggtcattcaaggcagtgagagagccaggctgctctggcatctgggaaccctggactcaattatttgctacactatttctaagctaatttgacttccctagcctcagtttccacatcagtgaagtggacaaactccaatctttcagttgttcaaaggaagaatgagattatgcacctgggatgtttcccagagtctgactccatgtgccctatttttattattgtcacttttttgttttttattctagttattggaagctatattttggtgtattttccccaattttaatcataaaa

SEQ ID NO: 120892 - DNA, 601 bp, Human
ttttattctagttattggaagctatattttggtgtattttccccaattttaatcataaaacagagccataaataatccaattagactttcctatggatatttgctggcaaaggaattaacgtgtctgtcatgaaaagaaatgtagagggaggttaatcaggatgtactggttcatcctaaatcagtagccctgcatataaagtgatggcttggaatcttgttctagcctctcctgttcagctgtgaagccaggataaagcatcaaattgcatgctatttgctcctgagagacaagtaaagkgaacaaagtaattcaaatccaactgcttgagtgaattatttcttagtaacactgtttttaaagatgcagttgttggcagggcacggtggctcacacctgtaatcctggcacttcgggaggccgaggcaggtagatcacttgagctcagaagttcaagactagtctggacaacatggtgaaaccctgtctctatcaaaaatacaaaaaaaaattagttgagcatggtggtgttgcacctgtgtttccatctacttaggaggttgaggtgggaggatcgcttgagcctaggaggcagaggtt

SEQ ID NO: 120893 - DNA, 601 bp, Human
ctcagaagttcaagactagtctggacaacatggtgaaaccctgtctctatcaaaaatacaaaaaaaaattagttgagcatggtggtgttgcacctgtgtttccatctacttaggaggttgaggtgggaggatcgcttgagcctaggaggcagaggttgcagtgagctgagattgcgccgctgtcaccaaactgggtgacagagtgagaccccatctcaaaaaataaataaataaatatgcagttgctgccagcctggatgcctggcatcaaaagtgctgctgtcagctgtggtgtcagtgmgtcctgcagggggtgcctggcgaggttgggagcaggaagtcaggagctaggcagcctggagcacacacctcagcagacctgcttacaccccctgttctgtcgtaaggtgtaagtctgcactaaaattgtacacctggagcttaagaacattggtcctttctgggattgggaaaaccgccttgcttctaattccagatacactgaatcctccaatttctcttctttcctgcacacagcttaattttagagaacttttgcttaacatatattcaggtggtgcctaggagaaacaagtttaga

SEQ ID NO: 120894 - DNA, 601 bp, Human
gtgttttcctaataattagtgaccaagcatcttttcatgtccttcctggtcatttctacatcttctttggagaaacgtatgttcaagtccctttctcactttttaaattgtgttctttacttgatttactaataacgttttaaatgacagaggcagtagagcctcatctaaaatggggtttaatggaacctatctcagagggattacataacaattgaaagaaattgtgcaggtaagttcaattgacagcattcaaagcactgttattaaataatatctttagtaagaaaatatgtcacaytagtgcaaaggctatacagtagaggaaagaaattgcccagggtttcccactaaatagaagttgtttgtatttttgctttttaattttttttattttgagataattgtggatttacatgccattgtgagaaataatacaaaaaggataacatatgtccacgcaaaaacctgtacatgagtgttcatagtagcattatttgtaatagccaaaaagtacaaacaactgaaatgtccatcagatgatgaatgggtcaataaaatgtggtgtattcatacaatggagtatttggcaataaaaaaa

SEQ ID NO: 120895 - DNA, 601 bp, Human
gaccaagcatcttttcatgtccttcctggtcatttctacatcttctttggagaaacgtatgttcaagtccctttctcactttttaaattgtgttctttacttgatttactaataacgttttaaatgacagaggcagtagagcctcatctaaaatggggtttaatggaacctatctcagagggattacataacaattgaaagaaattgtgcaggtaagttcaattgacagcattcaaagcactgttattaaataatatctttagtaagaaaatatgtcacactagtgcaaaggctatacagyagaggaaagaaattgcccagggtttcccactaaatagaagttgtttgtatttttgctttttaattttttttattttgagataattgtggatttacatgccattgtgagaaataatacaaaaaggataacatatgtccacgcaaaaacctgtacatgagtgttcatagtagcattatttgtaatagccaaaaagtacaaacaactgaaatgtccatcagatgatgaatgggtcaataaaatgtggtgtattcatacaatggagtatttggcaataaaaaaaaaaaatgacctggcatactt

SEQ ID NO: 120896 - DNA, 601 bp, Human
tgtgcaggtaagttcaattgacagcattcaaagcactgttattaaataatatctttagtaagaaaatatgtcacactagtgcaaaggctatacagtagaggaaagaaattgcccagggtttcccactaaatagaagttgtttgtatttttgctttttaattttttttattttgagataattgtggatttacatgccattgtgagaaataatacaaaaaggataacatatgtccacgcaaaaacctgtacatgagtgttcatagtagcattatttgtaatagccaaaaagtacaaacaactsaaatgtccatcagatgatgaatgggtcaataaaatgtggtgtattcatacaatggagtatttggcaataaaaaaaaaaaatgacctggcatacttcaacatggatgccatgctgttttatggatgacttataataacactatgttaagtgaaagaaatcaggcccaaaggagcacatattatactgttccatttatatgaaatgtccagaataggcaaatctagagttagaaagtagatgactggttgcctagggctggggggcctgggagtatggtaggagtgactgctaatgagcatg

SEQ ID NO: 120897 - DNA, 601 bp, Human
tgtacatgagtgttcatagtagcattatttgtaatagccaaaaagtacaaacaactgaaatgtccatcagatgatgaatgggtcaataaaatgtggtgtattcatacaatggagtatttggcaataaaaaaaaaaaatgacctggcatacttcaacatggatgccatgctgttttatggatgacttataataacactatgttaagtgaaagaaatcaggcccaaaggagcacatattatactgttccatttatatgaaatgtccagaataggcaaatctagagttagaaagtagatgactrgttgcctagggctggggggcctgggagtatggtaggagtgactgctaatgagcatgggatttctttttggagtcatgacaacattctaaagctaattgtggtgatgattgtacaattctgaatatgcaaataactgatgaactatatactttaaatgggtaaatgacatggtatatgaattatatttcaataaagctggcaaatatataaaagaaatgatacagagagatcccatgtaccatttacccagtttcctccagtggtaacatcttgtaaaactatagtacaacatcactacca

SEQ ID NO: 120898 - DNA, 601 bp, Human
accactctcccttttgtggtacgtgggcactttttagcaagccagtcacagccggaattagagtgctctcaaggtgccacatcagctttctttaactgtggcaaagtgtcactccacaagacgctttttactagctcaaaaagttttttttaacataatttttcatctgtattgacaacccaaatctccatgactaggttaatttgaaccttcaaactaccagagagtatcttagaaacctatgatttgatccttagcactgaataaaaatcatgcctttaacagagggatgaaaaccacyctattgtttcaatatcacagccctaagagatcatctgggagctgccgccattcttgggccatgtttgacacagctgctttatctaccactcacctcaaactccttatcagtatttaaaatatatgcagctgcaatatttcctgatgacttcccccctaaccttggaaagcgttttttttccttcgtcctttactcatacttttctatttataagtctccatgagcttcattgtttttatgatggcaaaagggaaatggttttgtttctttaacttttattgctatgtaatgtaacaagca

SEQ ID NO: 120899 - DNA, 601 bp, Human
tccgtgcttttgggtgtgactacagttcattcatcttcatctcatgtcgtgtttgtgagatgcactcgtgcttctgggtgtggctatggttcattcgtcttcatcccatgtcgtgttggtgagatgcatctgtggctacggttcattcatcttcattccatatggtattggtgagatgcattcatgcttttgggtgtggctatggtttattcatcttcatgccatattgtgctgtgctgcatgtgttttcaagatatacgatcatttatccatttatttcaccatttactgatgaaattgragttcatgttagtccattttgctttgctaaaggaatacccgagactgggtaacttataaagaaaatgtttatttgctttacggttcttcagattttataagaagcatggcacctgtctctgcttctggtgaagcctcaggaagcttccattcaaaaaggaaggcaaaagggagtgagcatgtcacacagtgagagcaagagagtgaccagaagaggtgccatgcttttagacaaccagctctcttgtgaactaatagagcgagaactcactctttaccacggggatggccccaagccatt

SEQ ID NO: 120900 - DNA, 601 bp, Human
agaagcatggcacctgtctctgcttctggtgaagcctcaggaagcttccattcaaaaaggaaggcaaaagggagtgagcatgtcacacagtgagagcaagagagtgaccagaagaggtgccatgcttttagacaaccagctctcttgtgaactaatagagcgagaactcactctttaccacggggatggccccaagccattcatgagggattcattcccatgacccaaatacctccctctagtccccacctccaacactggggatcaaatttcaacatgagatttggagaggacaaacatycaaactatatcagagtttttcccagtttgggctgctatgaacaatgcgctgcacatttttgtgcctcatttttgtgctgatgcaagcatgcatgagctctagggtgagtgggagtggatttgctggatcgtaaggtgtatgaatcttcagctcttctaagttattgccaacttattttgcaaagtgctggtcccagcttaagattctcaccagcaatatgccagtccccacgtcccctttcctgactagcagagctgtacttagagagatgtgggccccaaggcagcacaggcagtgggt

SEQ ID NO: 120901 - DNA, 601 bp, Human
ctgactagcagagctgtacttagagagatgtgggccccaaggcagcacaggcagtgggtggttatccggaaggaagtgtgcactcagcatccttcatggacaccttggatgttgtcacagaagctctgcaattgaatttcagtgatgctcagcaaagaacacagaatgaggcctagggcagctgctccagagtccctcccaaggggcaggtgctcatcagcacttgatattaccagactttaaaaatttttgctgagctcggcagtggtttctcatgactttatttgcatttctctggttrctaataagattgagtacttttcacgtgtttattactcatatgaatttcttcttttgaaatgcccttccaagcctttgcctatttcttctgatttttcttattgatttgtaagaattctttctatatcctggatgcaagttccttgcagttatatgtatcatatagtttatgtattttcatctattttatatcatgtattttcctgctgtgatttgctatggatatgctcatgtaacttagggttagagttagggctggggttaaggttagggtttataaacgttaaaaaatttataataa

SEQ ID NO: 120902 - DNA, 601 bp, Human
gaagtgtgcactcagcatccttcatggacaccttggatgttgtcacagaagctctgcaattgaatttcagtgatgctcagcaaagaacacagaatgaggcctagggcagctgctccagagtccctcccaaggggcaggtgctcatcagcacttgatattaccagactttaaaaatttttgctgagctcggcagtggtttctcatgactttatttgcatttctctggttactaataagattgagtacttttcacgtgtttattactcatatgaatttcttcttttgaaatgcccttccaagyctttgcctatttcttctgatttttcttattgatttgtaagaattctttctatatcctggatgcaagttccttgcagttatatgtatcatatagtttatgtattttcatctattttatatcatgtattttcctgctgtgatttgctatggatatgctcatgtaacttagggttagagttagggctggggttaaggttagggtttataaacgttaaaaaatttataataaaacctttttgatttaaatgtaatattaaaaggcttttgttggtggaatgtactttacaataactcttaagat

SEQ ID NO: 120903 - DNA, 601 bp, Human
ggttagagttagggctggggttaaggttagggtttataaacgttaaaaaatttataataaaacctttttgatttaaatgtaatattaaaaggcttttgttggtggaatgtactttacaataactcttaagatctacagaaaaggccatattgcttgtaattatgcatttagatgtcagaacaatttaatatattcataattccattattttaggtaggtggtagctttttaaaaggacctaggatggtttttttttgtcagctttatgttactatcttctccatatgttctaacacttatyttgtactgcatttttctttttcttttctttttttgttttgttttagagaagggggtctcactatattgcccaggttagtcttgaactcctgggctcaagcgatcctcctgcctctcaaagtgctgggattacaggcatgaaccaccttgtctagcctcatttttctatagagcactgcaagctcctaagtattaaccaaagtggaatacaaaataaaacattttaatagaggaatcagtcttaatgaccaaaagaaacatcattggataggttgactgctagctataaataaacttttta

SEQ ID NO: 120904 - DNA, 601 bp, Human
ctctcctggaaaaaagaaagagaagagaagagaaaagaaaagagtacatactcattgacaaatccaatcagaatagaaaagaacaagagaaagtagaagtcactccaaattctaccagccagggataatcactgttgttttactcagcaggcttccagtcatctttctatgctattcacatacagatactcttgcaccctaaaaaggggaccgtccactccacgtcacctttccttaggtggatagggcaggtgctatccagcttttgcgcaccaggcagcaggaactgcaggaagatttrcagtgacaccagcagctattactcccttctccccattttttttttaacatttccaagagaaagatggaagcagaagagaggacaggaaggaagagtatgattattaatatttctgctttgccaaattactgagaaaaggctttcccaagagaaagtcaggattaaagtgctcaatcccagtcccagaagggtggtgcctcgggggaactatactaaggagtcagtattgcccagagcgtgttccatgcggtgtaagaggctacttgaacaagtgttctgaggtcaagaaattgtgggaaa

SEQ ID NO: 120905 - DNA, 601 bp, Human
gaaaagaaaagagtacatactcattgacaaatccaatcagaatagaaaagaacaagagaaagtagaagtcactccaaattctaccagccagggataatcactgttgttttactcagcaggcttccagtcatctttctatgctattcacatacagatactcttgcaccctaaaaaggggaccgtccactccacgtcacctttccttaggtggatagggcaggtgctatccagcttttgcgcaccaggcagcaggaactgcaggaagatttacagtgacaccagcagctattactcccttctmcccattttttttttaacatttccaagagaaagatggaagcagaagagaggacaggaaggaagagtatgattattaatatttctgctttgccaaattactgagaaaaggctttcccaagagaaagtcaggattaaagtgctcaatcccagtcccagaagggtggtgcctcgggggaactatactaaggagtcagtattgcccagagcgtgttccatgcggtgtaagaggctacttgaacaagtgttctgaggtcaagaaattgtgggaaacgctggggtgaacaaatgcaggcttttcccc

SEQ ID NO: 120906 - DNA, 601 bp, Human
acatactcattgacaaatccaatcagaatagaaaagaacaagagaaagtagaagtcactccaaattctaccagccagggataatcactgttgttttactcagcaggcttccagtcatctttctatgctattcacatacagatactcttgcaccctaaaaaggggaccgtccactccacgtcacctttccttaggtggatagggcaggtgctatccagcttttgcgcaccaggcagcaggaactgcaggaagatttacagtgacaccagcagctattactcccttctccccattttttttttaacatttccaagagaaagatggaagcagaagagaggacaggaaggaagagtatgattattaatatttctgctttgccaaattactgagaaaaggctttcccaagagaaagtcaggattaaagtgctcaatcccagtcccagaagggtggtgcctcgggggaactatactaaggagtcagtattgcccagagcgtgttccatgcggtgtaagaggctacttgaacaagtgttctgaggtcaagaaattgtgggaaacgctggggtgaacaaatgcaggcttttcccctgaaggcctcccag

SEQ ID NO: 120907 - DNA, 601 bp, Human
tcagtattgcccagagcgtgttccatgcggtgtaagaggctacttgaacaagtgttctgaggtcaagaaattgtgggaaacgctggggtgaacaaatgcaggcttttcccctgaaggcctcccagggcacctgctgcatctcctgggtgggggaggagtggagggagtggctccctgtccttttagtgggggatcctttttcactaacagtcacccaagtccagttgtctgcaaattttgggaagtgcttgtttgactctagcatattgtactttaaagttagtatatataagtaatttttataaagaacaccttttttaaagaaaatgtggtaaatagttaaagatatggtgaacaaaattaaaatcgctcgtaatcacaccattggaaataaccagcatttgatatattttggtgtcttttcttccagactgttgtttatatgtgtgtgtctgtgtatctataaaatatgtctgtattttaaaatggggattataatgtgagtgtatgcctgtgtgtgtatgtatatgtatgtaagggattatagcatatatagagttttgttttgttttttttggtcttgaataaagaacattttatt

SEQ ID NO: 120908 - DNA, 601 bp, Human
gccactacactccagcctgggcgacagagcaagacgtagtctaaaaataaataaataaatattagccctcatggtagagtgccaataaaaacgtttttttgctactatttcatagaaaccttttgatttttgaataatttaaacattttttggtaaagaaagaaaattcctagatacttttcatctagcctcccctaattttatcactacatagtgttttaactcaggctttttctatctgtaattaaattttttgctaactctgcatctacaaagtgaagttttaattttttttttttttaattgagacggagtcgcactctgtcacccaggctggaatgcaatggtgcgatctcagctcactgcaacctccacctcctgggttcaagcaattctcctgtctcagcatcctgagtagctgggattacaggcgcctgccaccacacccagctaatttttgtatttttagtagagatggggtttcactgttttagccaggctggtttcgaactcctgacatcaggtgacccactcacctcgacctcccaaagtgctgggattataggtgtgagccacctcccccggctagattttctgtttt

SEQ ID NO: 120909 - DNA, 601 bp, Human
ctcagagtctttccaaacaatggcattgtttgttttaaagcaaacaaaccaattagctcttgtggcttgggttgccatatatagcccagaaaccaggctcagggccagacaccttataggagttcagtaaatattgttgaattaattaacttagagtattcctaatgataggtataaatatgagttttcctatgtaacaatgcctaatatatatatatatttatttttttgagacagagtctcactctatcacccaggctggagtgcagtggcactatcttggatcactgcaacctctgcytcccaggttccagtgattctcctgcctcagcctcccaagtagctgggattacaggtgcctgccaccatgcctggctaatttttgtattttttagtagagacagagtttcaccatgttggccaggctggtcttaaactcccgacctcaggtgatctgcctgccttggcctcccaaagtgctggaattataggtgtgagccaccaagcttggccaacaatgcctaatatttattgagcacttactatatgccagactgctcttggtgctttccatgggtgatctcacttagtcttttcagca

SEQ ID NO: 120910 - DNA, 601 bp, Human
aaacaatggcattgtttgttttaaagcaaacaaaccaattagctcttgtggcttgggttgccatatatagcccagaaaccaggctcagggccagacaccttataggagttcagtaaatattgttgaattaattaacttagagtattcctaatgataggtataaatatgagttttcctatgtaacaatgcctaatatatatatatatttatttttttgagacagagtctcactctatcacccaggctggagtgcagtggcactatcttggatcactgcaacctctgcctcccaggttccagygattctcctgcctcagcctcccaagtagctgggattacaggtgcctgccaccatgcctggctaatttttgtattttttagtagagacagagtttcaccatgttggccaggctggtcttaaactcccgacctcaggtgatctgcctgccttggcctcccaaagtgctggaattataggtgtgagccaccaagcttggccaacaatgcctaatatttattgagcacttactatatgccagactgctcttggtgctttccatgggtgatctcacttagtcttttcagcagcctgagggctaag

SEQ ID NO: 120911 - DNA, 601 bp, Human
ttggatgcaacctttgattccaaccccccaaaactgtaatatagcctctagtacatgcccattttacagagacctagatgaggtaaacaacttgaccaaggctacccgtaaggctggtacttaaagttctaggggaaaaacaggtcttgctttagagatgaagccataggaggttggagagtttgttcagcagcacactccttcttaggtaggtttccacttttttccaaagcacagttcactcatcaaatattctttgaggctgggcgtggtggctcacacctataatcccagccctttkggaggccaaggtgggaggattgcttgagtccaggaatttgagaccagcctgggcaacatggtgaaatcctatctctacaaaaaaaagaattagctgggtgtgatggcatgtaccctcagctacacaggaggctgaaagtgggaggattgcttgagcttgggaggctgatgctgcagtgagatgtaatcatgccactgcgctccagcctgggtgacagagtaagaccctatctcagaaaacattcattgagcacctacagtaagtgccaagttctgtgctttttgctgaatacagatggga

SEQ ID NO: 120912 - DNA, 601 bp, Human
cggctagtttttgtatttttaatagagatgaatttttgtcatgttgcacaggttggtctcgaactcccgggctcaagtgatccacctgcctcagcctcccaagtgttgggattacaggcgtgagtcaccacactcagcccagaaactgctttctttgcccatccataacaatcaagtcctcatccgttcaagttttatcgtgagactgcagcatttcagtcacatctttaggccctacttctaattctagatctcttgctatttccaccatatctgcagttacttcctccactgaagtttygactccttcaaagtcatccatgagagctggaatcaactttttccaaactcctgttactgttgatattttgacatgatcaccaatgttcttaatggcatctataatggcacatgctttccagaaggttttcaatttattttgccctgatctgtccaaggaatcactatctatggcagctatagccttacaaattgtatttttttttttttttttttttgagacggagtctcgctctgtcgcccaggctggagtgcagtggcgggatctcggctcactgcaagctccgcctcccggattcac

SEQ ID NO: 120913 - DNA, 601 bp, Human
acatggagggaaatcaggaattaagcacaattacaagaagagaaggcagccggaatcaagacagaaagacggtggagaggtctcggtcttaccctgcaaccaattgctcatcggttggaggacatggctcgctgaaatgggaacaggaccatcaagaccaaacaaaaacatatcacttttttaaaaaccatgaaaagttacaaggctattttataaaaactgcacaaaagtctagcagaagtgccaccattaagcattaactgttgaccatcacgactaagcaacttaccagacaagaaasaggatcacacactccccacgctgagaaacagggtcacacactccccacgctgagaaacagggtcacacactccccacgctgagaaacaggatcacacactccccacgctgagaaacaggatcacacactccccacgctgagaaagagggtcacacactccccacgctgagaaacagggtcacaccctccccacgctgagaaacagggtcacacactccccacgctgagaaacagatcacacactccccacgctgagaaacaggatcacacactccccacgctgagaaacagggtcacacc

SEQ ID NO: 120914 - DNA, 601 bp, Human
ccaattgcaaagaaacgctagaatcacctaatttgcataccacagggcacacagagacaattcatccaatcaatgtgtaagcttttaaatgccagtttacgataggagctctacaaatattaccagctgcagagtgaggacacttgcatttctctttaggttgtggacgaagtgtttatttatcatgcctgaacctgctaagtccgctcctgctccaaaaaagggctccaaaaaggcggtgaccaaggcgcagaagaaggatggtaagaagcgcaagcgtagccgcaaggagagctattcygtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtacgcctgctgctgcccggggagctggctaagcacgccgtgtcagagggcaccaaggccgtcaccaagtacaccagctctaagtaattctaacgtcttcatacccaatcccaaaggctcttt

SEQ ID NO: 120915 - DNA, 601 bp, Human
tatcatgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtrcgcctgctgctgcccggggagctggctaagcacgccgtgtcagagggcaccaaggccgtcaccaagtacaccagctctaagtaattctaacgtcttcatacccaatcccaaaggctcttttaagagccacccactttttcagctatagagttgtaattacctgcatattttccgtgtttaccaccaacaggtttggttttatcctcatttgagggggttgctgctgtgtaggtctagaccacagttcttttgactggttgaaggaaaatgctatacttaaccgtagcatgtttgttttac

SEQ ID NO: 120916 - DNA, 601 bp, Human
ctgaaaagggccattggaagaaaactgacgaaaagattaaccgccgaagccgtacagagtgcgtccttgacgcttgagcgcgtaaaccacatccatggcagtgacagtcttgcgcttggcgtgctccgtgtaggtcacggcgtcccggatcacgttctccagaaacaccttgagaacgccacgagtctcctcataaatcaaaccggaaattcgcttaaccccaccacgcctagcaaggcgccgaatggccggtttggtgatgccttggatgttatcccgcagcacttttcggtgacgcttrgcacctcccttacccaaacctttaccgcctttgccgcgaccagacatgtctaaccagctgacaacaaaaaccaggtacgcgaaaagaaagcaagccacgagcatttatacacgaacatcggaccttattgagaactgaaagcgggagcgaggataaggaggcgttgctgcctcactttttgctccgcccctcgaggggcagtgacctaaggactgcgagggagaacacaatagtttcactttttaatccctttagtttttccctcccgtttacgacactactatttgaatctgaatttat

SEQ ID NO: 120917 - DNA, 601 bp, Human; identical to SEQ ID NO: 27828

SEQ ID NO: 120918 - DNA, 601 bp, Human; identical to SEQ ID NO: 27829

SEQ ID NO: 120919 - DNA, 601 bp, Human
ctttgctgttaggctgattttgtctgctgacagaaaaacagcagtgcatgaagcgttaactcttcactttcccttggccttatgatggctctcagttttcttaggcagcagcaccgcctgaatattaggcaaaacgccaccctgcgcgatggtcacacgccccaaaagtttattaagctcctcgtcattgcggatggccaattgcaggtggcgcgggatgatgcgggtcttcttgttgtcgcgggccgcattgcccgccagctccaggatctcggcggtcaggtactcaagcaccgccgcragatacaccggcgcgccagccccgacgcgctcggagtagttgcctttgcggagcaggcggtgcactcggcccacaggaaactgcaaacctgcacgagaagaccgagtcttagccttggcgcgagctttaccgccttgtttgccgcgaccagacataactacttctgataagtagggaaaatcgccacaagaaaatgtaatgaaactacattagaacgcaaggcagagaagtatttatactgactggaggtaggctgtgaggaattctcccattggctaatgtcaaatacccaatgggaaa

SEQ ID NO: 120920 - DNA, 601 bp, Human
aatttctgcaggacaaattactaaaagtgccacactcaaagccattaaaaacacctcaaaaacatctttatgggcggcataatccaaagcacaacagctcatttaatggaagtcgtaggtggctctgaaaagagcctttgctgttaggctgattttgtctgctgacagaaaaacagcagtgcatgaagcgttaactcttcactttcccttggccttatgatggctctcagttttcttaggcagcagcaccgcctgaatattaggcaaaacgccaccctgcgcgatggtcacacgccccaaragtttattaagctcctcgtcattgcggatggccaattgcaggtggcgcgggatgatgcgggtcttcttgttgtcgcgggccgcattgcccgccagctccaggatctcggcggtcaggtactcaagcaccgccgcgagatacaccggcgcgccagccccgacgcgctcggagtagttgcctttgcggagcaggcggtgcactcggcccacaggaaactgcaaacctgcacgagaagaccgagtcttagccttggcgcgagctttaccgccttgtttgccgcgaccagacataactacttct

SEQ ID NO: 120921 - DNA, 601 bp, Human
tcagaacttagtctttgaggaaaacgtttgagaggagttacatctaagttgtgagactgagttctgtattctggtgagttaacggggttgcctcccagcttcttataagactcacagtataactaaacatgatatatgagcttttgccttttaatttatcaatctcttaaagagaatccagctttattactattagtatatgatcaaacttccatatttgccctgggaataatggacaaagggaaatactcttaattcatgaataaaaactttgcagaaaattagacggtgtttaattttygaaaacttccctctgtagtcagtagataccacctactgatggctacatatactagggaaattttaaaattaggaaatgctgttatctcacattataaatttctaaatcctaggaagaaatgcttggaatacttctgaatatagagaagttccatttaagggcaagtttccccttgtatacatatcaaaatattaccaattgtaaactgagatttaattctcaaatgtgttctacttgttctaaaacaatctgtccacagatataaaactataagtaataaattgttattttcgcacaatg

SEQ ID NO: 120922 - DNA, 601 bp, Human
gacggtgtttaatttttgaaaacttccctctgtagtcagtagataccacctactgatggctacatatactagggaaattttaaaattaggaaatgctgttatctcacattataaatttctaaatcctaggaagaaatgcttggaatacttctgaatatagagaagttccatttaagggcaagtttccccttgtatacatatcaaaatattaccaattgtaaactgagatttaattctcaaatgtgttctacttgttctaaaacaatctgtccacagatataaaactataagtaataaattrttattttcgcacaatgggaatctctaatgtgaaaatgtattctatgaaaataatttgtttaaataaagcgttgtataataaaaaatggagataatgggtttcataccattgtaaagtagaaaaattatagatcaaaccaccataaatcagggatatctgtatatgccttctatttatttttcttgccttattgcattgaaaaaaaaccttcccgtatgacactgaataggagtaatgagagtggatatctttgtcttgttcccaatattaggcaaacattctttcaccatgaagtggatg

SEQ ID NO: 120923 - DNA, 601 bp, Human
tgttaagataatttttaaaattcatccttttggtggaataattttatatctagaaaataacaaggaaaaagaatatgtgcaaacatactcactatggcattatttataatgacaaaaattgccgacagccaaatgtatgacaataaggaaatagttacatatattagaacgtatatatgccttgaaatattgtgcaaccacttaaattgtgtttttaaaaatgactaaattattctagaaaatatgatattaagaaacgagaaaaggctttgcagacgccgccgccgaggaaaaccgtgtrctattagccatggtcaaccccaccatgttcttcgacattgccgtcgacggtgagcccttgggccgcgtctcctttgaggtaaggggcctggaaaccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtgg

SEQ ID NO: 120924 - DNA, 601 bp, Human
tttataatgacaaaaattgccgacagccaaatgtatgacaataaggaaatagttacatatattagaacgtatatatgccttgaaatattgtgcaaccacttaaattgtgtttttaaaaatgactaaattattctagaaaatatgatattaagaaacgagaaaaggctttgcagacgccgccgccgaggaaaaccgtgtgctattagccatggtcaaccccaccatgttcttcgacattgccgtcgacggtgagcccttgggccgcgtctcctttgaggtaaggggcctggaaaccaagaastgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtcaccactgggagaaatttgaagatgagaacttcatcctaaagcatacaggtcctgaaatcttgtccatggcaaatgctggacccaacacaaatggtt

SEQ ID NO: 120925 - DNA, 601 bp, Human
taagaagctccgccctatatctatgtctcctcccaagacctcccccctaaaaaaaaaaagaaaaaaacagtagggaaatgttggaacagattgctctgtgggaactagacccggaatgttccgatagggcagggcctgtcactgctacacaagtggctagaattgatcccaaacgcacacctagcgcctcagagctggccatgccttcccaaatgcactcactcaaccgctttcggcatctcagatgtctaaagtaaaacctccaaaagcccaacaaccagcgagaccacacccacaccaytgccctcgtctacggtggaaagcgcactccacaggtaacaaagcagcgggtttagaccacgcctctttaccttcctcagatattgcctcagccagctgccaggggtaaaccgcactgtgagagaactctcaactacggctgcagtttctcatggaggctgaacttttggcaggaggtctgaacagcagtccttctggtggtgcagcccgtgactgatggtttctttcaactgccccgttactcccctgggaaggacacaaccctcatgaggattgatggacatgctttttgacagaacat

SEQ ID NO: 120926 - DNA, 601 bp, Human
ggtcacaagaagggcatttccactttcgggtcctatggcgtggcaccactgtctactaatttagtgaaatgtacctcaaaaggaaggggactttacccatattgtcccctcataagtcattctccccaggagacacctggcaatgtctagagacatgtcatgaccgcaagtggagggcagcagccatgggcatcctggaatgcacaggacagcctcccacaaccaagaattatccaagttgccatgagaagctaagaagctccgccctatatctatgtctcctcccaagacctcccccctaaaaaaaaaaagaaaaaaacagtagggaaatgttggaacagattgctctgtgggaactagacccggaatgttccgatagggcagggcctgtcactgctacacaagtggctagaattgatcccaaacgcacacctagcgcctcagagctggccatgccttcccaaatgcactcactcaaccgctttcggcatctcagatgtctaaagtaaaacctccaaaagcccaacaaccagcgagaccacacccacaccattgccctcgtctacggtggaaagcgcactccacaggtaacaaagcagcg

SEQ ID NO: 120927 - DNA, 601 bp, Human
taatcacagcactttgggaggcagaggcgggtggatcacgaggtcaggagatcgagaccatcctggctaacacggtcaaactccatctctaccaaaactacaaaaaattagccgggtgcagaggctggcgcctgtagtcccagctactagggaggctgaggcaggagaatggcgtgaacccgggaggcgaagcttgcagtgagctgagatcgcgccactgcactctagcctgggcgacagagcgagactccgtctcaaaaaaaaaaaaaagaaaatttcactaaaaaacaaaaggtcggcygggcgcggtggttcgcgcctgtaatcccagcactttgggaggcagaggcgggcggataacctgaggtcaggagtttgagaccagcctgcccaacatggtgaaaccccgtctctactaaaaataaaaaaaattagctgggtgtggtggtgcacgcctgtaatcccagctacttgggaggtcgaggcaggagaatcgcttgaacctgggaggtggaggttgcactgagctgagatcatggcattgcactccagcctgggcaacaagagcaaaaaactctggtctccaaaaaaattcaagata

SEQ ID NO: 120928 - DNA, 601 bp, Human
taattgaaaacttttactaggccaggtgcggtggctcactcctgtaatcacagcactttgggaggcagaggcgggtggatcacgaggtcaggagatcgagaccatcctggctaacacggtcaaactccatctctaccaaaactacaaaaaattagccgggtgcagaggctggcgcctgtagtcccagctactagggaggctgaggcaggagaatggcgtgaacccgggaggcgaagcttgcagtgagctgagatcgcgccactgcactctagcctgggcgacagagcgagactccgtctcaaaaaaaaaaaaaagaaaatttcactaaaaaacaaaaggtcggccgggcgcggtggttcgcgcctgtaatcccagcactttgggaggcagaggcgggcggataacctgaggtcaggagtttgagaccagcctgcccaacatggtgaaaccccgtctctactaaaaataaaaaaaattagctgggtgtggtggtgcacgcctgtaatcccagctacttgggaggtcgaggcaggagaatcgcttgaacctgggaggtggaggttgcactgagctgagatcatggcattgcactccagcctgg

SEQ ID NO: 120929 - DNA, 601 bp, Human
ttgacatccctgaccaccaggctcctaaggcacaaaatgagacttgtaggcttgggtaaagagtgcctaagaacatcctcccatccttcatcttcaggcccctgaaggcagtcaccatgtcatccaacaacccttcagactccaaagttcactaacaactgagttctcagcatcagccacttctcagggaagagaatttgcttgaagtttctgactgagtttggtcttaagaaaacatgtccatcagtcctcctgggagggtagtattgaaatatcaaaagcatgtgtgacggtaagcacktctaccttctttgagacactcttcatcccaaattattttatttcacataaccctgctgagttgcttacagcacaggaactttggaaggaagagcagctgaaagaggcgcatcttgtccaaaataattatttatttgagcctcttcaagtggtattcccctaatccttttgaggatagaagtctactaaaaggcaagaaacttgtttaagataataacgtctagaatggcgtggtggaataagttttgccatgtgcttttaggatcatgcaattcacagctgatcaggagttaagttctgc

SEQ ID NO: 120930 - DNA, 601 bp, Human
accttggcctcccaaagtgctgggattataggcgagagctaccgcacccagcctcacccatatgttcttgataaaaagataatacagaaaaagtaaacaaaaaacaaaatcagcccccagagaactacttttatttcctacttattggagcaccatttctttttttgttttgttttgtttttgagacggagtcttgctctgtcacccaggctggaatgcagtggcgtgatcttggctcactgcaatctccgcctcccaggtccacgccattctcctgcctcagcctccccagtagctgggrctacaggtgcacgccgccatgcccagataatttttttgtatttttactagagacggggtttcaccatgttagccaggatggtctcgatctgctgacctcatgatccgcccgcctcggcctcccaaagtgctggaattacaggcatgagccactgcgcccagccatggagcaccatttcttaacttaccattacttgtgaaacaaagatttgattaaaaacttaaatgtgactagaattacccatactgagctgtccctgggatatatcacgacaacctgtctgggtggctgtgcaaacat

SEQ ID NO: 120931 - DNA, 601 bp, Human
ttcctgatgactgtgcaattgataaaccactttgggaatctcgctaacttgatccatcaagctggacatacgcacaccctacaggccagtaatcctcttcctccaaatgcaaacaggcattaagaatggtcgatctgccttatgcctaaccacctcaaatggagaccaacccaaatatcaagcaaaagaagaaagatttcaaaatttttgtggtatattctcaaaatggaatactataaagcaacaaaaatgatcaaactatgactactcccagcgtggatgtatctcatgaatgtgctgrgcaaaaggaatcagacacaggctggacatggcagctcatgtctaattccagtgctttgggagcccaaggcaggaaggttgcttaaacccaggagttcaagaccagcctgagcaacaaagtaagaccccatctcttaaccaaaaaaaaaaaattagctgggtgtggtggcacacgcctgtgttcccagccactggggaagctgaagcaggaggatcgcctgagtcctggagttcgaggctgcactgagctatggttgcaccccagcctgtacagcacaacaagaccctatctcaaaaaaca

SEQ ID NO: 120932 - DNA, 601 bp, Human
aaacaagcctcacaggaagcaaatgacttacaagtcacttatctgtgcataagagcaaaggttaggaatatctaacacccagcaagataaaaaccaccatgcctgctgttcaataaaaaagttaccaagcatgtgaaccagtgcagtggctcagtggctcacgcctgtaatcccagcactttgggaggcagaggtacgtggatcgcctgaggtcaggagttccagaccaccctggccaacatggtgaaaccccgtctctactaaaaatgcaaaaattagctgggtgtggtggtgggcaccygtaatcccagctactcaggaggctgaaaggagaattgcttgaacccaggagacaaaggttgtagtgagctgagactgcatgactgcactccagccggggcgacagagtgagactccatgtcaaaaaaaaaaaaagaaagaaaaaagaaaataaacattaccaagcatgcaaagaagctgaaaccaccacccatgatgaagacaacaatccttcaatagaaacagatgcagaaatctcacagatgacagaattagtagacaagagcattatcaactatacttaagtccaaaggagaagaaa

SEQ ID NO: 120933 - DNA, 601 bp, Human
catatttaggattagcagagaaggtaaacaacactaacagtaactctccccctgtagccaagactgtaggtaaatgtgctgttagcacctttgctcattggccaaaggtcattggtatctttcttaaggacattaaaatgacaatatggaggtaacagttaaggttttactgttattcgaacaaagcacatactgtaaagctatgattatgaagacagcttggaattgggcagtgtggacaaccccttggtctcaaaagcagagatgcacaaatgtgaatggctggctgatgtggcagaaygacaaggaaaacctcgatttcctcagaggtcaacacggggtggggtggaagttggtcctgacatctccccacccccacctgttccaggtggattgtagataaatggaaaaggcaaaatagtaaaacgtaacaattttttaggacataaaaagcaaacaaggacacactatttccctaaaattaagaatggtaacattaagagtgaaagggcgagccacatgctgagtgacaagctctcaatccaacacggaattgtatatccagagtgtatggagagctcgtcctgctccggtcatgaag

SEQ ID NO: 120934 - DNA, 601 bp, Human
gagtcaatgagtcaaggttataagattacaaaacagaccctggatcactggatccatgaggacactgcagatccaacagaccagccagaccagcagccagaaacagcccatttcccttcatccaagcgggggctggccacctggtcgcccaccatgctcactgctctctcagatgcccagaaacctgggggacacaaccctagagaacacactactcattctaaagtcgtgatcctcagaaaactaaattcattaaaaatacatttaaaaataaagaaacacaacctaaacacagtccaayttactaagaaatcccacttgtgaccaggagaaactgagggaaaactggagcagtgacaccagtaaggtgaggaacggggaaaggacaagatgcctaaaaccccacaagaccctccggactgctggatgtgcttctacaggataaaccagctgcactccatctcccaacatccccctctccctccccattcaattatcctacaaacagaatccttgtatattctaaataccagaaacacatgaaaaggcacaagcaaatttttatttagcaattaaaagaattgaaaataaagaagaaagc

SEQ ID NO: 120935 - DNA, 601 bp, Human
caaatacatactgctcaaccagaccctaaaacatccagaatagagaacagtaattctcgtcaacagaccagaatatttcttcatcacaccaagttctcattaaaaagcaactttctggatgagcaagtggctcatgcctgtaatcccagcactttgggaggccgaggcaggcggatcacaaggtcaggggtttgagacctgcctggccaatatggtgaaaccccatctctactaaaaatacaaaaattagttgggcatagtggcgggcgcctgtagtcccagctacttgggaggctgaggkagaagaatcacttgaacccaggaggcagaggttgcagtgagtcgagatcgcgccactgcactctagcctggggaacagaccgagtctccgtctcagaaaaaaaagcaactttctgatctatacctcagtccctcagtccaactggactgacctagcagaagagtacatttggagctgacagctgactacaaaatgggtacacaggcaccatgaactatatacactggcaggctttgtaagcacaggccagactgacatttttaattataaattagttgagtcaatgagtcaaggttataa

SEQ ID NO: 120936 - DNA, 601 bp, Human
cttggcaggagctcggtgctggccctgtggtcttgggggtagattccaagaccctcatctgccaaatgagtatggcgccctctacactcccaagagtggtggtgaagactgcatgagatccccatgagaggaaacaaggtaggaccagggggcacgcagagggacatgcgaccagccagcctccccgactgggcccaccgcatgggtaattatcccacgagcattcagaagaaaatataagtgtctcatatgacatataagggattctgtagggcccaacattgattactcacaaagagamgcacaaatgctaatttactatttaccttcaaatctcagcaattaaatggatgggaaaacagcatttagcagccagagaatacatagatcagttaggggtccctgacaaggttccgagtaggaaccagaacaggctgaagcagagcttgtgttaactttctgatgagcttgcattcagccctgggtcccaccacttactttgccatcccctttggggtttagataaaccacataatgtccaccatgattatctccactatgaaccaggactgcatgaagaatataatttgcagggtcctta

SEQ ID NO: 120937 - DNA, 601 bp, Human
ccacattaaacagtgatgaacgctgctgttacacgcactcttcactgttctctcgtgctgtcgggtccctccaccaaatccccttggcaggagctcggtgctggccctgtggtcttgggggtagattccaagaccctcatctgccaaatgagtatggcgccctctacactcccaagagtggtggtgaagactgcatgagatccccatgagaggaaacaaggtaggaccagggggcacgcagagggacatgcgaccagccagcctccccgactgggcccaccgcatgggtaattatcccacragcattcagaagaaaatataagtgtctcatatgacatataagggattctgtagggcccaacattgattactcacaaagagaagcacaaatgctaatttactatttaccttcaaatctcagcaattaaatggatgggaaaacagcatttagcagccagagaatacatagatcagttaggggtccctgacaaggttccgagtaggaaccagaacaggctgaagcagagcttgtgttaactttctgatgagcttgcattcagccctgggtcccaccacttactttgccatcccctttggggtt

SEQ ID NO: 120938 - DNA, 601 bp, Human
agaaggcagcgttgttctaaaatgtgtgaacttctaggtatgcccctagttgaaaaaatatccatgtgtgttcttatacaggcacacaatctgacggtgtgctaggcaggcagcgcctcaggcatccgctcatacaattcaccaggaccttcgcagtccccattcaacattctgtgggcactgctaccattcgcccaatggcaatttttataatctactgaaatagcccattttccacttacattcaatctactgacactaccaactctttacagaattaaaaaggccatactgagcacaycaaacgagagttcaaattttatcctttagttatcaaactaaatgagctgttttatcctatcccatggcattttatggaagcaagttaagggccagactgaagtcaacgtagcatgttcctaacagttatcttcccatctgcgttgtggatgcagccacattaaacagtgatgaacgctgctgttacacgcactcttcactgttctctcgtgctgtcgggtccctccaccaaatccccttggcaggagctcggtgctggccctgtggtcttgggggtagattccaagaccctcatctgcca

SEQ ID NO: 120939 - DNA, 601 bp, Human
cccagaagggcgggggctgacctgcacttgcatatagagatgggcttcctgccgctccttccgcttctgagcctcgatccttttctcttcttgtaatcgctccaccaactgctgaggaatatcatggtcggtgaccgcctgtaaaacttcacctgcaggacaaaggcatcctctttgacccctgcagatggactttcccctcttagaagctcccgattctaggtcatcattaataaaataatctattaggccggcgtggtggcttacgcctgtaatcccagcactttgggaggctgaggcsggccgatcacgaggtcaggaaatcaagaccatcttggctaacatggtgaaaccccatctctactactaaaaaaaaaaataaaataaaaataaaataaaatacaaaaaattagccaggcgtggtggcagacgcctgtagtcccagctacttgggaggctgaggcaggagagtggcgagaacccgggaggtggagcttgcagtgagccgagatcgcgccactgcactccagcctgggcaagagcaagactccgtctcaaaaaaataaaataaaataatctattaacatgaaattacttggta

SEQ ID NO: 120940 - DNA, 601 bp, Human
atccctgaaaaaaatattaagagtagattaaaataaaaacacgctcatattttagtcctctatattacacacacatatgtatatacatatacatatatatatatagtcaatgttaagactgtgatcgtaggccaggtgctgtggctctcgcctgtaatcccagcactttcggaggccgaggcaggtggatcacgaggtcgggagttcaagaccagcctggccaacatggtgaactctcgtctctactaaaaatacaaaaatcagctgggcctggtgacgggtgcctgtaatcccagctacytgggaggctgaggcaggagaattgcttgaaaccaaaaggcggaggttgcagtgagccaagatcgcgccactgggcaacaagagtgaaactctgtctcaaaaaaaaagaaaaaaaaactgtgattctaagaaaaagaattctaattcttccccggttgatttggacaactgtgacttatccttcaggatcgaatgcccattttcaaaaataaagagggggtaggggtgcagggagtggagtgggagatgaggaaaaggggtgaaaacatgtctgcaaaatcctgtgggttcccctgtgcag

SEQ ID NO: 120941 - DNA, 601 bp, Human
gtctaatggcttaggtgacagagcgaaaaactacagtcaagtattgaagaaaacgtccaattctagttaagtggaccaaaagggaaacaagctgcactaagtgcagaggactaacgccttctgcacggttccaaaccagatacgctattaacaatatttactgttttattgccgtcggcttcattatctaacattgctggtcgttttgttccattactccttgcttgcatgggccacaatcgaatttgatcttgtggaaatccctgaaaaaaatattaagagtagattaaaataaaaacaygctcatattttagtcctctatattacacacacatatgtatatacatatacatatatatatatagtcaatgttaagactgtgatcgtaggccaggtgctgtggctctcgcctgtaatcccagcactttcggaggccgaggcaggtggatcacgaggtcgggagttcaagaccagcctggccaacatggtgaactctcgtctctactaaaaatacaaaaatcagctgggcctggtgacgggtgcctgtaatcccagctacttgggaggctgaggcaggagaattgcttgaaaccaaaaggcg

SEQ ID NO: 120942 - DNA, 601 bp, Human
tggtccctgacagacaacgtttgcaaccctgctctttaggatctgaccaacgtgattagcacagcacagcagctgagactgaagacagaacaggacggccccacgtggctgctactgtctccgggcctcacaggaaactcgcagccaagtcagtcttatttgacttcatcaggaagtctagtgagcttttgtggaattgatcaacacatctttctgcaagggaagaaggcttaaccctgtgtgtttagaacaacaatccaggaatccaacgctactgctctaagtgcaggcaggcgtctcrtgggcacttacgatctttatcaaacttgggtaaggtcgctccactagcagccagctcgggatcaactgtttccaggaatattgtccaagggttttcattatcactgagctcaatcatctatttccaaaagagacgctgattttagaagagtctaatggcttaggtgacagagcgaaaaactacagtcaagtattgaagaaaacgtccaattctagttaagtggaccaaaagggaaacaagctgcactaagtgcagaggactaacgccttctgcacggttccaaaccagatacgctattaa

SEQ ID NO: 120943 - DNA, 601 bp, Human
ggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtrttcgacaatggcagcatctacaaccctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtggctgctgcccctgtggctgctgacaccacagctgctcctgctgctgct

SEQ ID NO: 120944 - DNA, 601 bp, Human
cagcctgggcaacatggcaaaaccctgtctacaaaaaatacaaaaattggccggctgcggtggctcacacctataatcctagctctttgggaggccaaggcaggcggatagcttgagctcaggagttcaaatccagcctgggccacgtggtgaaaccctgtctctacaaaaaattagccaggtatggtggcacacacttgtagtcccagctgcttgggggctaaggcaggaggatcgcttgagcccaagaggtttgaggtgcagtgagccctcaagattgcacctgtctcaaaaaagaaamaattagctgggcatgttggtgcacagttgtggtcccagctactcaagaggctgaggtgggaggatcgcttgaacctgagaggtcgaggctgcagttagctgtgatcatgccactgcaccagcctaagtgacagcaagaccctgtcgcaaaaaaaacagagtgcaggccgggcgcggtggctcacacctgtaatcccagcactttgggaggccaaggcaggcggatcacgaggtcaggagatccagaccatcctggttaacaacagtgaaaccccgactctactaaaaatacaaaaaaata

SEQ ID NO: 120945 - DNA, 601 bp, Human
gagtttaaaaacattcagtattacttctgggtgtggtggcttacgcctgtaatcccaacactgggaggctgaggccggtggatcacctgaggtcaggtgttcgagaccagcctgaccaacatggtgaaaccccatctctactaaaatacccaaattagctgggcatggtggcacaggtctgcaatcccagcaacttgggagactgaggcaggaggattgcttgaacccaggaggcagaggttgcagtgagctgagatcatgccactgcactccactgcactccagcctgtgtgacagagckagactctgtaaaaataactgggaggctgaggcgggtggactgcctaagctcaggagtttgagaccaccctgggcaacatggtgaaaccccatctctactaaaatacaaaaaattagctgggtgcagtggcgggcacctgtagtcccagcaactcaggaggctgaaatgagaattgcttgaacccgggaggtggagtttgcagtgagccgagattggttcagtgcactccagcctgggtgaaagagcaagactctgtctcaaaaataaataaataaagataaaaataaaaaacattcagta

SEQ ID NO: 120946 - DNA, 601 bp, Human
gtggctcatgcctgtaatcccagcactttgagaggcgaggcgggcggatcacaagatcaggagatcgagaccatcctggctaacacggtgaaaccccgtctctattaaaaatgcaaaaaattagcctggtgcggtggcgggcgcctgcaatcccagctactcgggaggctgaggcaggacaatggcgcgaacccgggaggcagagcttgcagtgagctgagcgccactgcactccagcctgggcaagagtgacagactccgtctcaaaaaataataataatcatcatcatcatcatctatyccacagcccttttacctgcacctctcataaatcacctattactttcttctctgagatacaactattaatgtaatgtctgtctgagtattggctgttaaggatagtattgatgctaaataaatgacttttcactagactgtgaaccaattttttaaaaaatagggtaaggggaatatgaagagtttaaaaacattcagtattacttctgggtgtggtggcttacgcctgtaatcccaacactgggaggctgaggccggtggatcacctgaggtcaggtgttcgagaccagcctgaccaaca

SEQ ID NO: 120947 - DNA, 601 bp, Human
aaaatatatttaaattaattttacctatatcttttctcccctgctcccctcaggcttagctcagctgaatttttgcctattttaatgtggctattagaaaatttgtaattatttatgtgacttgcatcatatttctgttgggcagcactggtctagattctccctatgctttcatacctagctcaaattccacctcttttttcatgaagagttctctgatttaaccagcgcctaaaaataatctatcccggccgggcgcagtggctcatgcctgtaatcccagcactttgagaggcgaggygggcggatcacaagatcaggagatcgagaccatcctggctaacacggtgaaaccccgtctctattaaaaatgcaaaaaattagcctggtgcggtggcgggcgcctgcaatcccagctactcgggaggctgaggcaggacaatggcgcgaacccgggaggcagagcttgcagtgagctgagcgccactgcactccagcctgggcaagagtgacagactccgtctcaaaaaataataataatcatcatcatcatcatctatcccacagcccttttacctgcacctctcataaatcacctatt

SEQ ID NO: 120948 - DNA, 601 bp, Human
gggtgacagagggagactccatctcagaaaaaaaaaaaaaaagcaaggcaatcatgttacttccctgattaaatccctttaatgatgcagcagactactgaataaagtccaaaactcaagcttgtcacctgcagccaagttactaattatatttcagatatgttgagttagataaaatatatttaaattaattttacctatatcttttctcccctgctcccctcaggcttagctcagctgaatttttgcctattttaatgtggctattagaaaatttgtaattatttatgtgacttgcatyatatttctgttgggcagcactggtctagattctccctatgctttcatacctagctcaaattccacctcttttttcatgaagagttctctgatttaaccagcgcctaaaaataatctatcccggccgggcgcagtggctcatgcctgtaatcccagcactttgagaggcgaggcgggcggatcacaagatcaggagatcgagaccatcctggctaacacggtgaaaccccgtctctattaaaaatgcaaaaaattagcctggtgcggtggcgggcgcctgcaatcccagctactcgggagg

SEQ ID NO: 120949 - DNA, 601 bp, Human
gaagatgcacaaatcgtcaaatctgaaaccatcttaacctcttccttagagtagctttctaattattctccattgctctgcatctctagcccactttatatcctgccaccagtacttcttgtaatcccagcacattgggaggccgagacgggtggatcacgaggtcaggagttggagaccaacctggccaagatggtgaagccccatctctactaaaaatacaaaaattagcgaggcctggtggcgggcacctgtaatcccagctacttgggaggctgaggcaggagaatcacttgacccrggaggcggagatttcggtgagccaagatcatgccactgcactctagcctgagtgacagagcaagactccatctccaaagaaaaaaaaaaaaaaaagtagagaggcaggcagtggctcaagcctgtaatcccagcactttgggaggccgagccaggcagatcacctgaggtcaggagttcaagaccagctggctaacatggtaaaacttcatctctaccaaaaacacgaaaattagggccgggcgtggtgactcatgcctgtaatcccagcactttgggaggccgaggcaggcagactgcc

SEQ ID NO: 120950 - DNA, 601 bp, Human
tggcacacgcctgtagtcccaactgctcaggaggctgaggcaggagaattgacttgaacccgggaggcaaaggttacagtgagccaagattgcgccactgcactccagcctggagacagagcgaggctccgtctcaaaaaaaaaaaagaaaaaaatgtttagtcccagctggatctagttaacattccttgtgattccaccactaagctcacttcccaaaacatgtctttttgtgtttccatgcttttgtatgagctgttccctctgtctggaagacctctcccttacctgcccagtgaaatattattattattattattattattattattattattttattattttttgagatggagtcttgctctgtcgctcaggctggagtgcgctggcaccatcttggctcactgcaacctccagctcctgggttcaagtgattctcctgtctcagcctcccaagtagctgggactacaggcggcctaatttttgtatttttagtagagacggggtttcaccatattggtcaggttggtcttgaactcctgacctcaggtgatccacctgcctcggcctcccaaagtgctgggattacaggtgtga

SEQ ID NO: 120951 - DNA, 601 bp, Human
tgcattgacagcattgccagttttaattttctacataggacaaagacaaagaaaggatacattccccaactcaggaaaaggggaactgctacagcaatagtagtataaagtaacaggtgctgtggaaacaggagggttatctgtcgcacactaaggatatcgggaaacttcaggaagaagggaaatgggtttaaaggatgagtaaagagttaaaggggaagaagaggtctaatcaatgtatagtcatggaattgtgggaaagtggcttactagttcattccttgcaaccctatggatatgrgagtattattaatctcatgtttcatgtgagggtgctgagccacagagcttaagtaatttgtccaaagtttccaacttagtgatagagccaggatttgccattggcttagagctcatactcaaggtaacaggctttttagtggttctcaaacttttctgtgcaaccccaaaagctggccaaattggagtgcccttggtacttttccgttagagaataactccgcttttaactgctttatatattgcattctatgtaaaattatctgggggagaaggtccacagctttagagaaaactttag

SEQ ID NO: 120952 - DNA, 601 bp, Human
gttaagataattggtagtttttaataatataaaatacttaagttgaaatacaaaagtgtggcaacaattattaaatattggctagaattctaggagagttacacaactagtggaagtccatgtttagaaaataaatggcttgtttaaggaaaagtttttgtgtccaaagctccttaaagtcagagagatttctacctggtacttaacatcatatggaaattgatgctttagtgagggtgttggctatcctattgttaatttcctgcatccttttttcttctttatttttgtatagagacarggtctcgctatgttgcccaggctggtcttgttcctgggctcaagcagtcctcccgcctcggtctcccaaagtgccgggattacaggtgtgagccactgtgcccagcttatccttttttcattacacaaaaagactgaatttggttagttctaagttggaagataaagatggtatgcacaggaggcccttgggagccctcagataactttctcattcttccaaaatcaggctgggatgcattctgtaaattttccctgcctaggatgtatacctgaggaataaggtaaggaagatgtcagc

SEQ ID NO: 120953 - DNA, 601 bp, Human
atacctctccctccatgtgcaggtttgttaagataattggtagtttttaataatataaaatacttaagttgaaatacaaaagtgtggcaacaattattaaatattggctagaattctaggagagttacacaactagtggaagtccatgtttagaaaataaatggcttgtttaaggaaaagtttttgtgtccaaagctccttaaagtcagagagatttctacctggtacttaacatcatatggaaattgatgctttagtgagggtgttggctatcctattgttaatttcctgcatccttttctcttctttatttttgtatagagacaaggtctcgctatgttgcccaggctggtcttgttcctgggctcaagcagtcctcccgcctcggtctcccaaagtgccgggattacaggtgtgagccactgtgcccagcttatccttttttcattacacaaaaagactgaatttggttagttctaagttggaagataaagatggtatgcacaggaggcccttgggagccctcagataactttctcattcttccaaaatcaggctgggatgcattctgtaaattttccctgcctaggatgtatacctg

SEQ ID NO: 120954 - DNA, 601 bp, Human
tcatatacctctccctccatgtgcaggtttgttaagataattggtagtttttaataatataaaatacttaagttgaaatacaaaagtgtggcaacaattattaaatattggctagaattctaggagagttacacaactagtggaagtccatgtttagaaaataaatggcttgtttaaggaaaagtttttgtgtccaaagctccttaaagtcagagagatttctacctggtacttaacatcatatggaaattgatgctttagtgagggtgttggctatcctattgttaatttcctgcatccttttttcttctttatttttgtatagagacaaggtctcgctatgttgcccaggctggtcttgttcctgggctcaagcagtcctcccgcctcggtctcccaaagtgccgggattacaggtgtgagccactgtgcccagcttatccttttttcattacacaaaaagactgaatttggttagttctaagttggaagataaagatggtatgcacaggaggcccttgggagccctcagataactttctcattcttccaaaatcaggctgggatgcattctgtaaattttccctgcctaggatgtata

SEQ ID NO: 120955 - DNA, 601 bp, Human
ttagtgggctgagtttcatatacctctccctccatgtgcaggtttgttaagataattggtagtttttaataatataaaatacttaagttgaaatacaaaagtgtggcaacaattattaaatattggctagaattctaggagagttacacaactagtggaagtccatgtttagaaaataaatggcttgtttaaggaaaagtttttgtgtccaaagctccttaaagtcagagagatttctacctggtacttaacatcatatggaaattgatgctttagtgagggtgttggctatcctattgtyaatttcctgcatccttttttcttctttatttttgtatagagacaaggtctcgctatgttgcccaggctggtcttgttcctgggctcaagcagtcctcccgcctcggtctcccaaagtgccgggattacaggtgtgagccactgtgcccagcttatccttttttcattacacaaaaagactgaatttggttagttctaagttggaagataaagatggtatgcacaggaggcccttgggagccctcagataactttctcattcttccaaaatcaggctgggatgcattctgtaaattttccc

SEQ ID NO: 120956 - DNA, 601 bp, Human
atttttgtatttttagtggagatggagttttgccatgttggccaggctggtcttgaactcctgactccaggtgatccaccctcctcagcctcccaaagtgctaggattacaggcgtgagccaccccgtccggcctgtttttaaggcattaattagtattgttaggaaagcagtaacaatgcaaacaccactcttctcttcacaaagatcaccttgagactgtgtctccattccacctgcctgagaagtgggagcatcagcctgttccaggctcttgggtagtagcatagccctttaaaaagagagagccattttccatgtgtttttggataagcacaatttgaaaatcatttcccaaatcctctttttgtttttgattctaaggtaaaattttccctaagccctcccaccatcccctcagccagtattagatgagatttgtatagcagcagaaactgacttataagtagagagctcttcagcaagactgagccttagctgttccatctctttgttcttctgttgctggagttgcaccccatttcttaactgcctctggcgttcttccatttcctccagctgttcctgcatgagatggccaa

SEQ ID NO: 120957 - DNA, 601 bp, Human
ggctaatttttgtatttttagtggagatggagttttgccatgttggccaggctggtcttgaactcctgactccaggtgatccaccctcctcagcctcccaaagtgctaggattacaggcgtgagccaccccgtccggcctgtttttaaggcattaattagtattgttaggaaagcagtaacaatgcaaacaccactcttctcttcacaaagatcaccttgagactgtgtctccattccacctgcctgagaagtgggagcatcagcctgttccaggctcttgggtagtagcatagccctttaaaaagagagagccattttccatgtgtttttggataagcacaatttgaaaatcatttcccaaatcctctttttgtttttgattctaaggtaaaattttccctaagccctcccaccatcccctcagccagtattagatgagatttgtatagcagcagaaactgacttataagtagagagctcttcagcaagactgagccttagctgttccatctctttgttcttctgttgctggagttgcaccccatttcttaactgcctctggcgttcttccatttcctccagctgttcctgcatgagatg

SEQ ID NO: 120958 - DNA, 601 bp, Human
aggtcaggagttcaagaccagcctggccaagatggtgaaaccccgtttctactaaaaatacaaaaactagctggccgtggtggcatgctcctgtagtcccagctactcaggaggctgaggcaggaaaatcacttgaacccaggaggtggaggttgcagtgaactgagaccgtgccactgcactccagcctgggtggcagagcgagactctgtctcaaaaaaaaaagaaagttgtgaatttgatgtaagcttaggaaatgaataaaatttataggcatctgtataatgtacaacttgacacrgactttcttttatccttagtttctttcacggactctagaacttttatcagaatatactggtaaaacattgggggagggatcctgagtaggtgattggtcagaaagatgccttcagttttgtcagtgtctaaaagttaagtctgtttaggccaagcatggtggctcacacctgaaatcccagcactttgggaggccgaggcaagtggatcacaaggtcaggagatgagaccatcttagccaacatggtgaaaccccgtctctactaaaatacaaaaaaattagccaggcgtggtggtgcgt

SEQ ID NO: 120959 - DNA, 601 bp, Human
agcaacaatagttacttgtgggccaggcgcggtggttcacgcctgtaatcccagcactttgagaggctgaggcacgtggatcacaaggtcaggagttcaagaccagcctggccaagatggtgaaaccccgtttctactaaaaatacaaaaactagctggccgtggtggcatgctcctgtagtcccagctactcaggaggctgaggcaggaaaatcacttgaacccaggaggtggaggttgcagtgaactgagaccgtgccactgcactccagcctgggtggcagagcgagactctgtctcaaaaaaaaaagaaagttgtgaatttgatgtaagcttaggaaatgaataaaatttataggcatctgtataatgtacaacttgacacggactttcttttatccttagtttctttcacggactctagaacttttatcagaatatactggtaaaacattgggggagggatcctgagtaggtgattggtcagaaagatgccttcagttttgtcagtgtctaaaagttaagtctgtttaggccaagcatggtggctcacacctgaaatcccagcactttgggaggccgaggcaagtggatcacaagg

SEQ ID NO: 120960 - DNA, 601 bp, Human
tatagtgagaaataccttgacacaattttaagagtaaactatatgggtcagcatatccttgaacaaaaagtagactttgtaaaagtattcatttaaattctaacactcgtggcacaaaagaatggaaattgtaaacccatgtaatggaaattggctatctttttgaccccacatgtgcccctcaaaaatgtttttggtttgggtcaacacaaggcaagatacattctttaaaatactcccagatgtgtccatacattcatcctttactcagtgcatatgtgagggttgttgctggaagacwggaggctcatctttcctttccttggtgcattgagatcagtatcaacagcagatgaaatagaatccagcaaagagttgacatgttctgcctccggccaactctagaatctttttaagcaggtcagccagtatttgcaacttccacaggatgaattgcttgccaagtttctggcactcttgtctggttggaagagtacatccaaagggtacttagtgatcctttgctaagaagttttttgctgtttccgggttacagatttggccatatatttctaaacagcccctgtaaagttgaaagaaa

SEQ ID NO: 120961 - DNA, 601 bp, Human
tgttctagcttcccctaaaatattgttactccggtgtttcagaatcagggctcccagaagtaatgtgaaggttttttttttttttcccattcaaacccgaatgcagtaaaactgaacttaccctctgattctgatgacaaacgccaatttgggttctgcaggtacatagaagttgccagcttttcttgccatcctcgccattcgaatttcagttctgtacatctgcctatattccttgtgatagtgctttgctttttcatagataagcttcctccttgcctttcgaagctgaaaaccaatwatcagttattcataatttttagctcaatcacaattagcaatgccaatcattaaaaagaaaactacaacatgtttcctttaaatcttttcttgccacagtatgcaattacatcccccaccaaaaaaccccactaccttcagattgtaacattagggagctaagcaattactcagtacagttaggaagtaaatcttgccaagaacattcacctcatcctcaatcccaataaggcgcctccttatgtgctagtgcctcaaaaagtttacttaccatcttttgggcaaacttctttctcaggcg

SEQ ID NO: 120962 - DNA, 601 bp, Human
agatttcgaagttcgtctcttaagttactacgtggaatgcagaggggctcaactgcagctgtgtgtgtttatttttaatgccgcgatcctaaaaacatctttaggagtttaggtttgcttcactgcctttcccaaaattcagcagctttgatttgccttttccagggagacaggaagccaataaacagggaaaaaaaagcaaacggcgacaattacaaggtcgtgaaactccacgacctcccagctgaaaacaagacctcgggtttgcactccggctctctagggcagacactgaccttakgagtctgcgaaacgcccacgctccacgtaactttctctgaaacattctctggaaagcttgtcttttcctagccgaatctggattaccaaggcttccggaactcgcaggcttccggagcgacgcaggagccggaagtggctgaaaaaaaaaagaaaaagttacaccaacgagaactgcgctttagcggcgctgcggaaggcactggatggccaaacaaccgcgaacgccgacaagccgaagagccgaagggccgaaaagccgaagcggacacccgcgcgcggtgattggccggttggccgg

SEQ ID NO: 120963 - DNA, 601 bp, Human
tgagtatagtacaaattatgaatgaatatattttctttaaaaacatgttattgacagaaatctatcaataataatgtgggtattgtcaagggcctgtcaatattaacgtaattatgattaaggggataacatggattttagctataataccatgtaacatctcctacatcgctgctatcaatatacacattattattgacctgttccaagactctcagtattagaggtattaccattaggcatatttgtcaatgcatactgtctacaaaattctgcatttaaatttacagtcctgtaaacttttgtcagcagaaacgtgattctcaagtaatctctactgtgtcatacccactcatgcaccccctgccaggctattcttttccatctccacaataataaactaagttttagaatgaaaatgtcactgccacaccatcttaaatgttctggcaatcaaagtggatgagaccacgttcattgttttctctttctgaaaatgttaaactagcatttcatattatgaggttatatgaataaaattctatgactagacatcttaagttttgaacctataacctactattttatttcctttgtgtag

SEQ ID NO: 120964 - DNA, 601 bp, Human
agttcttcctcatcacacatactcccaccccactcctctctttctggcaggtacagctattctagaatactctctttagaaaagggcagcaaaggagtagaagaaaatgatgaaatcaaaataactagaaattcaattaacccaattatggaatcttcttccctctacagcagtacaacaagatttgttataataggtatgaagcataaatgccataaacgactttatatcacataaaattattcccaatatagtgtaagcagtttgtgttttagtgaattctaattctctgacaaatggytactcaatgtaacaaatatatactggacacctatcaaatacaaggcattctcctaggtaccagagattcaatctaaatatttaactgtcagctagcttccttttattcaagcattttaaaagacataggaaatcaggactggccattgatctctgaagtgaagaatggatcccaaaacgtgaaaacattataaaagatcacaaaactttccagggagaaaagaggaaaatggtatgtaaggcaagggaacaggctgtgtgaaagcccagaaatagcaagctcctgaccatagcctagctg

SEQ ID NO: 120965 - DNA, 601 bp, Human
gctgtcatccaggctttgtttttttcatttataaagtacaggcagagtagttctagcataattcttaagggtctttgaatttttagaatggtaaataagcactggcttcaacttaagagccaccagctacattaacccacaacaggagagtcagcctgtcctttgaagctctgaagccacatattggcttctcctctctagctatcagtgttacatggcattttcttccaatataagccttttgtctatcttgaaaatatattgtctagcgtagtcaccttcatcaattatttagctaaascttctggataacttgctgcagctctgatgtcagcatttgctgcttcagctttcatgtttatatcataaatggttatttccttaaatctcacgaaccaacctctgctagcttccaccttttcttctgcagattcctcacctctttgtcttaaagaattgaagagagttaggaacttgctctggattaggctttggcttaaaggaattttgtggctggtttgatcttctatctagaccactaaaacttgtcccacatcatcagcaataaggctgttcactttctttaattcatgtgttccct

SEQ ID NO: 120966 - DNA, 601 bp, Human
gccattgttttatcaattaagtttatgggatattctaaatcctttgctatcttttcaacaatgtttacagcatttccccaggtataaactccatctcaagaaaccactttctttgcttatccataagaagcaactcactgggtgcagtggctcatgcctataattccagccctttgggaggccaagggaggatttctgggcaacacagggagacactgtctctacaaaaactaaaaaaaaaaaaaaaaaaaaaattagccaggcgtgctggcatgcacctgtagtcctagctactaagggsaggctgacgcaggagagttgcttgagtccaggagattgagaggctgcagtgagctgactgtgctgttgttcaccagcctgagtgccagagcatgaccttcgtttcaaaaaaaaaaaaagaggggaagcaagtccttatcaattcaagttctattatgagattgtagcaaatcagtcacatctttaggctccactctaattatagctctcttactatttctatcacatctgtagttacttcctccactgaagtcttgaactcctcaaagtcatccacaatggttagaatcaacttcttaca

SEQ ID NO: 120967 - DNA, 601 bp, Human
taaaaattacttgattgctaaaaaatgctaacaaccatctgagccttcagtgagttataatctttttgatagtggagggtcctgccttgatgttgatgcctgctgactgatcagggtgatgactgctgaaggctggggtggttgtggcaatatcttataacaacaacaaagtttgctgcatggattgactcttcatctcatgaaagatttctctgtagcatgcgaagctttctgatagcattttaccaagagtaaaccttctttcaaaactggagtcaacagtctcaaaccctgccattgytttatcaattaagtttatgggatattctaaatcctttgctatcttttcaacaatgtttacagcatttccccaggtataaactccatctcaagaaaccactttctttgcttatccataagaagcaactcactgggtgcagtggctcatgcctataattccagccctttgggaggccaagggaggatttctgggcaacacagggagacactgtctctacaaaaactaaaaaaaaaaaaaaaaaaaaaattagccaggcgtgctggcatgcacctgtagtcctagctactaagggcaggctga

SEQ ID NO: 120968 - DNA, 601 bp, Human
caaataactagtaagatttacattttagactacttgttctggccaccctgagcaagaatggaatagaggctgagagaaagactggaagcatagagacgagttaacaggttgttaaaatgatctagtgagaaactaatgatggcctaaattagaaaagtatcaatggggacagagagaaaagggttatctttgacagcggtgaggtggtagaagtgacactatctggagagaaataagccaagaaaaactgacttaagtaattgagtgatagtgatccaagtccctgaaacaagaaatacaygaggcaatacaggtttgaacagaaagaaaatatatacatgcaattttaaacatctgaggatcctatgagacatctaagtggaaaagttcagtaggcagttatgtaaatatgacagaaaaaatctgggtagaattttagaagtctgatgcccctctggtaaaactaatctattttaaatctacttgatctacataagtgctaaaatcaagaaggcagtgatttaaaacaagatagatcttgtctatttgtaacacattcaactttctttgtaacaacgtaatcttattctggtagttttta

SEQ ID NO: 120969 - DNA, 601 bp, Human
ttcctaacccatctgtcactccctatcccccgcaagccttttcctgaattctggctgctctcctctctcatggattccatcaaactggtctaccttaccttctgcctccttcagtgcattctccacactgccagtgttctaaaacacaaacctccccaaatccactcccagcttgctttccttccttacgcatcacatccagtcaaaaagtacccccttctcctgttcaccagtagacttcactgtctgttccctttgtgtggaacagtccgtttccaatcttttaactgaaaactcatamtaagattttaagtactggctcagacatcacttcctgctgactccaaatttgggttgctgcccatctagttgttcccttggcactctattctttccctttcttggcctctatgtactgtacataaactacttttaaatggtttatttcctccactagaggatgagcctgttgtgaagattatttgagccttatcacagttgaatcagaacaactatctcagttcctggtacacagaaggcactctacaaacactagataaatgaataaatgaataggatgaaagtctgggatgtgtgaagg

SEQ ID NO: 120970 - DNA, 601 bp, Human
actaaaaatgtatatatcacacagtactctaagaaaactatgatataaaaatatataccacaataatgccataaatagactaaggaaacaaattggtgctaaagggaaaaaaatttaaatgaaatataagaagctgaatggttagctaggtacagcttactgattcaatacacatatattattataaatatgtattatgtgcaagctgatataattaaaacaccaagtcactgccataatccagtatatagaccagttcagatattttaaatattattaactggcaaatccacccatgacaaaaaaaaaaaaaaatgaggcttaaatttagttgctaaaatggacctcagtatgatctcatttatatgtggattctaaaaaagtcaaacttattgaaacagagagtaaaatggtggttggtaggggctgggagggtgagagaaatgggagatattagtcaaagggtgcaaattttcagttataagatgagtaagttctgaggaactcatgtccagaatagcatagttaatatgctctattgtttctttgaaatttgccaagagcaaatctgaagtgtcctcatcacacacatacacacagg

SEQ ID NO: 120971 - DNA, 601 bp, Human
agtctgtttaatgcttactggagataaatagatttataggtgaccaagacaatcgattaatgtatcagccacagacttttttaaatagaaaattttctaagtaggaaatcattcatagctctttgaaagatatagggagaggcctcaaggaaagaaagaaaggaaaaaaattgggaaaggaaacaaagatgaaaaattggggtggggagagcggtcagatggtggccatgagaaggatctgaacacagagagcggcggggccggcggggaaggagggaggaggggagagcgctgcttcccygtgggttccggcttctgcagagctgtaagagttgaatgccacacacagtcacactaaggaatgctccaggattgggaaagataaaattcaacattataatgagaacactgtgaatgctattgaattaactactcccctctctccctatttcttgtaagtcttagtgtcagtaaactaattataaatttacattttatgttctaaaagcatgcacctttttctcattgtaggatgattttcttatatcaagtggtacatttcattttatttacttcagtttctggtggtaagtagagtgtt

SEQ ID NO: 120972 - DNA, 601 bp, Human
ttttttaaaaaattgtatctgtactcaacgtgtgcagagtttttttccaaaattgttttccaaaaatttttaaatgtttatatgtttagggggtgtaagtgcagatttcttacatacatatattatgcggcggtgaagtgccggcttttggtgtacccatcacccaagtagtgaacacagcctccaacaggtaatttttcaacgctcaccccactcccatcctcccatctagtggcatattgaaaatcaatttgtcttgtaaaattaaataatccaattaggagggggatatattctaagraaattagtgcatgatgcacacacacacacacacacacagaacacgtgtgtgcgcatgtgcacatgagagagagtgagagagaaactgggtcttgctctgtcgcccaggctggattgcagtggtaaaatcacagctcactgcagcctcaaactcccaggctcaggagatcctcctacctcagcctcccgagtagctgggattacaggtggaaacaaccatgcccagctagtattttttttttttttttgtattttttatagagacagggtcttgccatgttgcccaggctggtcttgaact

SEQ ID NO: 120973 - DNA, 601 bp, Human
tggcatattgaaaatcaatttgtcttgtaaaattaaataatccaattaggagggggatatattctaagaaaattagtgcatgatgcacacacacacacacacacacagaacacgtgtgtgcgcatgtgcacatgagagagagtgagagagaaactgggtcttgctctgtcgcccaggctggattgcagtggtaaaatcacagctcactgcagcctcaaactcccaggctcaggagatcctcctacctcagcctcccgagtagctgggattacaggtggaaacaaccatgcccagctagtattttttttttttttttgtattttttatagagacagggtcttgccatgttgcccaggctggtcttgaactcctcagctcaagcaatctacctaccttagcctcccaaagtgctgggattacacgcatgagccactgcgcccactccgcattattaaatatagaacatttatttgattcatcagttaatattcttcttaaaagtactattttaatgtagcaagattgctttccaccaaaaggtggggtttccacggtggggtttccaaattattctcaatggggtgaggatgtgtgttatcac

SEQ ID NO: 120974 - DNA, 601 bp, Human
aattcaggcgtatttcctggtaagtagagctacttgccttgcctttatgagattaccacctaactagatgtatgcccagtaaaatccaacataacgcatgccatgtactacatcacagaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtaaatgcttatgtttctayatcgaggagacagatttttaaagggagattgctattcttaacacatttccatctaacattttataaaatttaacattaacaactggaagataaattgtctttcagttgaaatattgttacagaaagaagtgatggtgtttacgcaatttagaaaagaataaatatgcctccaagtgtagactttccagcctctcctatagtctcatattaatggtatgtttcttctgtttgtctcaatttttacacttcttaaacatttcacactttgcttttctatcgattattaatttttgtcgtgct

SEQ ID NO: 120975 - DNA, 601 bp, Human
ataaaatttaacattaacaactggaagataaattgtctttcagttgaaatattgttacagaaagaagtgatggtgtttacgcaatttagaaaagaataaatatgcctccaagtgtagactttccagcctctcctatagtctcatattaatggtatgtttcttctgtttgtctcaatttttacacttcttaaacatttcacactttgcttttctatcgattattaatttttgtcgtgcttctcaacaaactggaacttctcccaactattttattagaaaaaaataaaatatttaaaaagawaatttgaaaaaaagtacagtacagtgatccccctgccaccaccaaaaccgcaatgtttgctatatttgtacagcaatatacaatatacaatacctatatttgtatacatgtttaaccgtttgaaataattttaaaacatgacactttacccctaaatacttcagcatgcactatcctacacaaaagacatacgaaatttaacaagaattcctttatattatttcagttttccctcaaatataatttatagtaattaaccagaatcttaccaagagtcactcactgcattgggtggtttgt

SEQ ID NO: 120976 - DNA, 601 bp, Human
gtaattaaccagaatcttaccaagagtcactcactgcattgggtggtttgtcaggtttaaaacattttaaacagtccaccaaccatttgtattcccatcctgagcttgaaaatttaataataagcctttctgtagaattaagttttcaacatctttattattgctacattcacaggcatttatgtagcacccagaacttataaaatttactattccagaacctagagcagggattggcaaatgtcttcttaataacgcagagtaaatatgttaggctttgtgggcaaaacccacagtaaarccaaggatattatttaagtatttatgtcaccacttaaaatgtaacaatttgaaaatataaaaatcattttgtatagctaacaggctaaacagaaacacacagatttttggttgcattttaccaacaggtcctagttgacacattcctgtttgttcctattagaaaggagtattacatgcagtctcttaagtgtagggatattgaagtaaaaaacaaactcagaatcttgctaagaaaatatttgttttggcatgagataaagtagtttgtttccttctttttggctttctgtgtgctgac

SEQ ID NO: 120977 - DNA, 601 bp, Human
tgttctgaaggctggggataccatttagtgaactaaatcgacaaaaactttgcctattggaccagagtggagatgagagagaagtgaccagatcgatctgtgttatcagcagacagccaataagatttgctgataggttggaccacggattgtgaaggagtcagtgatagcaccaagacttttggcccaaggaactggaaagatggaaatgtcaatgacagaatgtggaggatttcgcaagcagcagagtgtaggagaagcaatgcccttggctcatctagggcaaagggttgaattggcractggaaatagaagtcaaattcagaagagaggtttatgtggacatctgtgtttaggtgtcaccaatatacagctgatactttttaaaaatctagtgaaattatcaaagggttaaatgcagagagggaagaaagtaggtccaaagatcaagccttgggacattggaagtttagaaataagaaagatgtcattgtcacttgtaattttgtgctagtcactgctctttttctttgtcttattaccttactgaccaattcctagaataggaataacacatttgatctttaatacagtatgtgat

SEQ ID NO: 120978 - DNA, 601 bp, Human
actgacaatagagcaagctcagaaaatttttatggaggtgatttagttagaaaatttgtctgcaacctaagggccatggagtgtgactccgtggtttatgggtgtaactccgtggtttatgaagagtactttcaaaataggaaaatcttcacaactaagtgctagcatgagctgactttactttctctaggtgctgtaaaaatgtttttatgtgtttgatatgatatatttctacttcccttttgtttttgttagaaatctttgtctccttaaaacatctgagagtggattgcccagtacrcgcattaaaaagagcaaagctctttctggtttcagtctacaaagctgcaggcacagcatcccaggtaaactgagagttctgcattctggctgagagtgaccagccccgaggaggctgatacatgctgagggagggtctcactctgacatgtggtctgctgtctagtgttctgccattcttcattttaccatgacactgatttcttgggagaagaactggatattgttgctgcaaaaagtcacgaggcctgccagaaactgtgcaccaatgccgtccgctgccagttttttacctataccc

SEQ ID NO: 120979 - DNA, 601 bp, Human
tctgagcatagtcacgagagatgctttgtaggcaaacagaattgttctaagggacaaaatccccaacaggaaagaacacaccacaaacactcctgcttaaattaccatagtaacttaggatggctttactatatattgatttacataaagctgcatgttcttatactgtttattgccaaatgtccaatattacaatacactataaggtgcaactgagatttaatgaataaaatggaagtaacaatcctgcctcgtgatagttttagaagcacaaaaacattctgtgtcagattatctgctrtaccgagaaggcgaatcaatccttaatttctgagaacttgttttgtagaacataaagacgttatattgcctccaacactggtatcctaactaacagactatgccttcctagagcttagaggcgctccgatgaaaatctctggatggctcaagacttcttaaaaagcaagtcaattacgtcgtatctcatacattctgttttcctcacaataaatttccctaagacaagaaggagcattcggcaccattctgttgtctttcttctacttctaagcgttagaagggacacttagcaaatgtt

SEQ ID NO: 120980 - DNA, 601 bp, Human
taacttagactcctcccttagctcaggacgcggagccttctgagcacctgagcctggttattctaaatgtgatctgggcacagcacattgacatcacctgggagcttgttagaaagaatttcaggacccacacagatgttactgagtcagaatctgcattttgaaagctacacaggcaacccacaggcacataaattttgagtcgcataggtgtgtgcgtgtgtgtgcgcatgtatgtgtgcgtgtgtttgtgtgcacgtgtgtgtgtgtgtgtgtctagaatactgctgtctacgaacaycctattcccatccatctgtgttccatggctccaaccgggagggtgggttcttgtgtcgggcatccagtaagtagaaatagagggcactgtcctgtctaggcagccccaagagaaaagaaacagagggatgagcctgagtcaaagtccctgaaaagtaccaaggaccccagagaatcccaaactgtcaacaaggccaaaggtcagaggaagttcatagcagatcagtcttactttggacgtgggtggagcaggagtgactgggatcatggtcagcagagtcactgggacagggcaggaact

SEQ ID NO: 120981 - DNA, 601 bp, Human
cacagcacattgacatcacctgggagcttgttagaaagaatttcaggacccacacagatgttactgagtcagaatctgcattttgaaagctacacaggcaacccacaggcacataaattttgagtcgcataggtgtgtgcgtgtgtgtgcgcatgtatgtgtgcgtgtgtttgtgtgcacgtgtgtgtgtgtgtgtgtctagaatactgctgtctacgaacaccctattcccatccatctgtgttccatggctccaaccgggagggtgggttcttgtgtcgggcatccagtaagtagaaawagagggcactgtcctgtctaggcagccccaagagaaaagaaacagagggatgagcctgagtcaaagtccctgaaaagtaccaaggaccccagagaatcccaaactgtcaacaaggccaaaggtcagaggaagttcatagcagatcagtcttactttggacgtgggtggagcaggagtgactgggatcatggtcagcagagtcactgggacagggcaggaactggacaatggctgcagcctgcgggcaaggtgcttgccttttctttctaagagcagttctcaaacgccagcagggctggt

SEQ ID NO: 120982 - DNA, 601 bp, Human
aaggccaaaggtcagaggaagttcatagcagatcagtcttactttggacgtgggtggagcaggagtgactgggatcatggtcagcagagtcactgggacagggcaggaactggacaatggctgcagcctgcgggcaaggtgcttgccttttctttctaagagcagttctcaaacgccagcagggctggttcaaacacagatggctgagcttccaggctggagtttctcattcactggatctgaggttgggctgaagaatgtgcatttctaacacgttcccaggtgacgctgttggtctggrgactgcacttgacaaccactggtttaaaaacaccattcacgttatcatttgaaggagggtaagacagccttgtagtaccacacaagggagggctacattcttaggggtgtgtaattacaagatgacttagtcaattccatttttcatgtgcatgttttgctttggcagcttgattataaagtctctgtaactcagggtcatgataaactattgacttgaggaaaggttttcttcttgttcctgaaggagcataattactgatggaaaggaagatgtaggaagctgctcatcacaatgctt

SEQ ID NO: 120983 - DNA, 601 bp, Human
cagccttgtagtaccacacaagggagggctacattcttaggggtgtgtaattacaagatgacttagtcaattccatttttcatgtgcatgttttgctttggcagcttgattataaagtctctgtaactcagggtcatgataaactattgacttgaggaaaggttttcttcttgttcctgaaggagcataattactgatggaaaggaagatgtaggaagctgctcatcacaatgcttctgttgcagagtgtaccaccaaaatcaagcccaggatcgttggaggaactgcgtctgttcgtggygagtggccgtggcaggtgaccctgcacacaacctcacccactcagagacacctgtgtggaggctccatcattggaaaccagtggatattaacagccgctcactgtttctatgggtcagtaccacggctgtttttattagttcatcttcttcacacatttataaaaaatattactagcatgttaggaaataaatactttaaccaattagattgtcttatttgcaaaattaattaattgcttcagtggtaaaaaacgcaaaaaggaagagctcatggtctcccagcatcagaacaggtgcag

SEQ ID NO: 120984 - DNA, 601 bp, Human
aagggagagggcctggaatgctagtcattcactctgctaaggctgacacactttcctggctattgaaacttattttgggaatgtgggtaaagagatacgttttcctgagtcttcttcaggtgcatagaatgacataatttcataatactttggaatagtaaagataatttagtctaaagataatttattaaagataatttagggatgaaggattgaaggttagaacaattaagcaacttgtgcaggatcaaagtgagttggatgaggagttagcggtgagggtgaggcttgtctctctctygccctctcatcctggcacatgtgcgatatcgtgctgaacctgagggaggaaaatacacgacaacaaggcaaaaaatgaatatagtaaacaaagaaaacacagataatgtacagtggaagaagagtctcttctggaaaagaggatatattttgcgtctcatatttaaaccacgattttttaaatttagattctcaacgacccatatgcctgccttccaaaggagatagaaatgtaatatacactgattgctgggtgactggatgggggtacagaaaactaagaggtaaaaatgatgttgtt

SEQ ID NO: 120985 - DNA, 601 bp, Human
cccataagatgatctgtgccggctacagggaaggagggaaggacgcttgcaaggtaacagagtgttcttagccaatggaatatatgcaaattggaatgcttaatgcgttggggtttttttgtttgttttgttttttttgtttgtttttttttgagacagagtctcgctctgttgcccaggctggagtgcagtggctcgatctcagctcactgcaagctctgcctcccaggttcacgccattctcctgcctcagcctcccaaatagctgggactacaggcgccagctaccaagcccagctarcgtcttttttttttttagttttagtagagacggggtttcaccatgttggccaggatggtctcgatctcctgacctcatgatctgcctgcctgggcctcccaaagtgctgggattacaggcgtgagccaccgcgccgggccgcttaatgcattttaaaaagcagtcttctgccaatgagcagggaacacagtgtatttgtttgacttagactgaaatcaaaagcaaggagattgactggatgaacgcaagcacccaggttctctgcagtatattaaggggccaagacaacattttaggcaa

SEQ ID NO: 120986 - DNA, 601 bp, Human; identical to SEQ ID NO: 120971

SEQ ID NO: 120987 - DNA, 601 bp, Human; identical to SEQ ID NO: 120972

SEQ ID NO: 120988 - DNA, 601 bp, Human; identical to SEQ ID NO: 120973

SEQ ID NO: 120989 - DNA, 601 bp, Human; identical to SEQ ID NO: 120974

SEQ ID NO: 120990 - DNA, 601 bp, Human; identical to SEQ ID NO: 120975

SEQ ID NO: 120991 - DNA, 601 bp, Human; identical to SEQ ID NO: 120976

SEQ ID NO: 120992 - DNA, 601 bp, Human; identical to SEQ ID NO: 120977

SEQ ID NO: 120993 - DNA, 601 bp, Human; identical to SEQ ID NO: 120978

SEQ ID NO: 120994 - DNA, 601 bp, Human; identical to SEQ ID NO: 120979

SEQ ID NO: 120995 - DNA, 601 bp, Human; identical to SEQ ID NO: 120980

SEQ ID NO: 120996 - DNA, 601 bp, Human; identical to SEQ ID NO: 120981

SEQ ID NO: 120997 - DNA, 601 bp, Human; identical to SEQ ID NO: 120982

SEQ ID NO: 120998 - DNA, 601 bp, Human; identical to SEQ ID NO: 120983

SEQ ID NO: 120999 - DNA, 601 bp, Human; identical to SEQ ID NO: 120984

SEQ ID NO: 121000 - DNA, 601 bp, Human; identical to SEQ ID NO: 120985

SEQ ID NO: 121001 - DNA, 601 bp, Human
ttcatccacttaattctgttgctaaatagagatgaaaaaagaaatgacttgggattttaccatttggtttgtaccatgttagagtattaaagtcaacattagaaaatctttataaaagagttttgtttttgccagtaatttatcgaactctgcctaaatttcacatgattgtatgttaaacgtaagagaaaaatttttagacagtttgtttcccactgacaagttcatatgataatgaaatccaataatagacaaatgtcaaacaaatgaaaacgcaggtgagtataagggttttttttttgtacattaacaaccttaacatctagtatattaagttacaagatgtgttggcaaaagcataaacgtttcaattaaaataaggtattattttgtaaaaacaaaccatttaacataggatagataaaaatgacaatcaaatgagtttcagcagccacatttctacagtgaactacagtatcaggatgaaaacaatcagaaacaaatgaaaggacattattgaacaatatgaatatgtgatgcatttttagctgctaaaatagtaaactctaagttcatagagttacaagttgtcgaatttaac

SEQ ID NO: 121002 - DNA, 601 bp, Human
catattaaaacatcttagtcagttcctcctgacagcattaacacagacaaatacacaagacttcaaacatgctttaaaatgacattcagcaaagtacttaaaatttaataaatagcaaatcacacacagatacatttttcataatcattaaactactaaaacagacagttaaagaataaataaaccgcaactgacagtaaaaaaaatatgttgggttttgcaattcacactacttaaaaaggggggatgatctgaatgatttcttaattttcttttgagagtgtagcatgatcccccccargaataaaatatattgaaaaaatcactcttacaacaatgtattttttaaatacaacaaataaatatgaaaccagcaaagcaatttcaagttgtaataaaaatgtcccccgcccccagccaaaagctatggaaatatatagttgctgtggtagcaaataatagtatttaaagtgatagtgcttgtgcactaagctcatctgagaccttgatataattttagtgcaaatccctagggtccaatgcaagcgcaaccctgtattagggaaagacattaccaggtggaacttatcttgtacaattt

SEQ ID NO: 121003 - DNA, 601 bp, Human
aataataataataaaatagtagggtgcagtggtgcatgcctgtagtgtcccaactacccaggaggctgaggcaagagaggcacttgatcccaggagttcaaggctgtggcaagctacgattacactactgcgctcactccagtctgggagacagagcaagaccgcacctcttaaaaaagataaataattataataatattaatttgagatggcttaatacagttccactcagttacattaaatttcttctgcacaaaattggtctaattccatacatatttttgttatataccgttcacckgttctgtagtttgtcaggcaaggtccacctcatcatttgatatccagctgtagcaattcctttccttaaagcccttcacccactgaagtcatcctttatgccagggtggtaggaagtatgttaaccgttgttacagtactcatcacactatatagctgctatttgtttttctttctgcctgccagacaaggagctccctaagaactgaacctcgtgcagaagacaaagcttatctgggagtcagctttagcacagtactgattgaagactacccctagtacatatgcttgtactctctct

SEQ ID NO: 121004 - DNA, 601 bp, Human
aaaagttacttagcttttcctttcatcctcaggaaaaactgattactttttttgggggggggcagtaagggcacagagtcttgcgctgtcactcagactggaatgcagtggtgtgatgatagcttactgcagcctgggctcaggcgatcctcccgcctcagtcccgagtagctgggactacagatggatgccatcatacctagctaattttttttttaatttttaatggagacaaggtctcactatgttgctcaggctggtcttgaactcctgggctcaaacgattctcttggctctgcckccccaagtactgggattatatgtgtgagccactgtgcccgacctgatgacttataattgctttttttcccctccttgtcctaatgtcatttaacattctgtatagtgagaataccagactaagcttttcagtcaacatttttctaatgtaaagatctatcgactggacgcagtggctcacacctgtaaacccagcactttgggaggatgaggcgggcacatcacctgaggtcaggagtttgagaccagcctggccaacatagtgaaaccctgtctctactaaaaatacaaaaatttgctg

SEQ ID NO: 121005 - DNA, 601 bp, Human
gcaacatagagctagctaagaagtggctgaagtggccgggtgcggtggctgaagcggccgaatgtggtggctcacgcctgtaatcccagcactttgggaggccgaggctggtggatcacgaggtcaggagatcgagaccatcctggccaacgtggtgaaacctcgtctctagtaaaaatacaaaaactagttgggcctggtggcacgcgctggtagtcccagctgctcaggaggctgaggcaagagaatcacttgaacctgggaggcagaggttgcagtgagccgaggtcgtgccactgcrctccagcctgggcaacagaacgagaatctgtctcaaagaaaaataagtggctgaagcaagaggaggaagaactgatccatgccccctaaggatacaggcctctggggtctctgtgttggagcctaggcccttgcatcctcacactcaccattcagcaggggcagagaagcattaagatgccagttttccttccttttagcccctcatccccgattgcctggattgttcttcctcagtctggaggaacctcctgttcatcatctacacagaagttgactgaataataaaatttttttatct

SEQ ID NO: 121006 - DNA, 601 bp, Human
gatggattggagctgctagtgtcgggagaggcagctagaagcgcagtccccagggagtggggagaatgacctggtccagcctattggttacttattgattcagaggagagactcccatcgtctggaaagaaagtaaaaggagagatccactgcttgatggaatgcactaaggggtgtgtgtgtgtgtgtgtgtgtgtgtgtgtgtgtgttttgttttgttttttaagacagagtctcactctgtcaccgtgtgtgtgtgtgtgtgtgtgtgtgtgtgtgtgtgtgtgtgtgttttgttttgtttttttttaagacggagtctcactctgtcacccagcctggagtgcagtggcgtgatctcggctcactgcaagctccacctctcgggttcatgccattctcccacctcagccttcccagtagctgggactacaggcgcctgccaccacgcccagctaattttgtttttgtatttctagtcgagatggggtttcaccatgttagccaggatggtctcgatctcctgacctcggggatgctctgagattctgagcagtgtattgagaggctgatggcttgctactttgtgtctgatttttct

SEQ ID NO: 121007 - DNA, 601 bp, Human
ggttaagtaaaatagattactaaaattaatttccccagggttttttttttttttgttttttggtttttttttttactttttaatatgaattttttttacttaaaattacatataatgtggcttatgtttgtggcttgcattatatttctattgaacagtgccagcctagagaatttatattctaaagataatctgtctgaacagtactgagtatataaaattaattatagttaggattatgcttagtcttttacaatcagaggtataaatgggattttttttttttttttttttttttttwtgagacagtctcgctctgtctcccaggctggagtgcagtggcgcaatctcggctcatggcaagcttcgccttccgggttcacgccattctcctgcctcagcctcccgagtagctgggactacaggcacccgccaccactcctggctaattttttgtattttttagtagagatggtgtttcaccgtgttagccaggatggtctcggtctcctgacctcatgatccacccgccttcgcctcccaaagtgctgggattacaggcgtgagccaccacgcttggcctaaatgacatcttataata

SEQ ID NO: 121008 - DNA, 601 bp, Human
gagtagctgggactacaggcgcccgccaccatgcctggctaattttttttgtatttttagtagagacggggtttcaccgtgttagccaggatgttctcgatctcctgacctcgtgatccgcccgcctcagcctcccaaagtgctgggattacaggcgtgagccactgcacctggccagtagtggttgtttctttcatcaagaggcacatgtctgttgtgtcttttttaatattaacaaccattgatgcctaattcattcaccaaagggtctttttgttttaaaatgtatatttttatttasacatgctttgctttaaataacaatctgtgttctcccttaataaaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtg

SEQ ID NO: 121009 - DNA, 601 bp, Human
ttatgagtggggccaggcgcggtagctcacgcctgtaatcccagcactttgggaagctgaggcgggttggtcacctgagatcaagagtttgagaccagccgggccaacgtggtgaaaccccgtctctactaaaaatacagaagttagccaggcctggtggcgtgcgcctgtagtctcagctactcgggaggctgaggcaggagaattgcttgaccctgggaggcggaggttgcagtgacccacaatcgtgacagtgtactccagcctgggcaacggagcgagatttcatctcaaaaaaaamcaaaaaaaactcagagacatttatgagtacagtgtttttttgttttttgtttgtttgtttccttaaaattgggatactttttaaatttttcaaaacaaacattgaaacattagtgaatgttcaaaacgctttttggagcagggggtgcgtggcagacagggtctctcactctgtcgcccaggctggactgcagtggcgtgatcatggctcactgtagccttaaactcctgagctcaggtgatcctcccacttcagctgctcctcacgtagctgagactacaggcatgtgccatcacaccc

SEQ ID NO: 121010 - DNA, 601 bp, Human
gagatgggcggatcacaaggtcaggagatgaagaccatcctggctaacacagtgaaaccccatctctactaaaaatacaaaaattagccgggtgtggtggcacatgcctgtagtcccaggtacttgggaggctgaggcaggagaattgcttcaatccgggagggggaggttgcagtgagcggagatcgcgccacggcactccagcctgggcaagagagtgagacactgtctcaaaaaaaaaaaaaaaaattatatatgtgtgtgtgtgtgtgtgtgtgtgtgtgtgtgtgtgtgtgtgtgggtgtatgtgtgtgtatatatatgtgtgtgtgtgtatatatgtgtgtatatatatatgtattcatatatatatgtatttttatatatatgtatgtcttcaccctctaggtttaactcttctctccttcccagccagcctttatgaagagttaacatccctcacagtcttctccccctcatctttccctcttgtctggcttattccccatcactctggtataatgactgttgcttaaggtcatgaatgaccccactctctgaatgtagtgaagactcctttccactcttcttcctaagagat

SEQ ID NO: 121011 - DNA, 601 bp, Human
ctgggaccacaggtgtacgccaccatgcctagctaatttttgtatttttcagtagagacgggtttcactatatgttggccaggccaggtctcaaactcctgacctcaggtgatccacccacctttgcctcctaaagtgctgggattctttttgagatggagtctttgtcgcccaggctagagtacagtgcagtagcacaatcttggctcactgcaacctctgccccccaggttcaagccattttcttgcctcagcctcccgagtagctgggattacaggtttacaggcatacaccaccacrcccagctaatttttgtactttttagtagagacagagttttgccatgttggccaggctggtcttgaactcgtcacctcaggtgatccacctgccatggcctcccaaagtgctaggattacaggcgtgagccactgtgcctgccaactcttagacttctcaaagcatgacccattctttttattttaattctactttttgccttggtgatcttatcagctcccatgggctcaaattctaacaactctttgtggcattggtggtacagtgataagcatagctgctttcaaatcctaacaactt

SEQ ID NO: 121012 - DNA, 601 bp, Human
tagtgtggatatctaggttgctggcatccaggtgggaaggcacctctgtaactaaagacttaaggtatggatggaaaaggtggtagagagtttggttttaggaaatggacttcccagaagcaccattaaactggagagattatagatgatgcctgatagtctagggattcttcatattgtgttttgcactggttgtcagtagaaatagtggggaggggttgagatttttgaagaaggaacatattggagaactttagtgactttattgggctttttttgttctttgtttgttttttttttkttttttgttttttttttgagacagtgtctccctcttgttgcccaggctggagtgcagtagtgcgatctctgctcactgcaacctccaccttctgggttcaagcgattttcctgctcagcttcccaggtagctgggattacaggcatgccccaccacaccctattagtttttgtatttttagtagagatagggtttcaccatgttggccaggctggtccagaacccctgacctcaggtgatccatccgcctcggcctcccaaagtgctgggattacagatgtgagccactgtgcccggctg

SEQ ID NO: 121013 - DNA, 601 bp, Human
gcaaaaccctgttatctacaaaaaaatacaaaaatcagcagggggttgtggcctgcgcctgcggtcccagctacctgggaggctgaggtgggaggatggcttgagcccagtaggttgagctgcagtgaactgagatagtgtcactgcactccagcctgggtaacagagcgagaccctgtctccaaaaaaaaaaaaaaagggaaaaaaattattgcactgaactgttgggggttttcagaaatgttaggagactcccagatattaccagtgatcagataatcttaaccttggggatccctakagttgttcttagttgcaaagccgcctgctgccagactctgtcctatgtcctgctttctcctgatactgccttgttcacttctgtggttcatctccaggaagaccagcttctttccctaattgtatgtaaccagaagcatctttagtcaaaagagattattgatagcttctgatagatttctacagttctgtgttctgtctgctgctggttagtagagcatggaatttggttccaggccttatacctagtgactctttatctcccccagaaaagggacgtcagcctgggctccatgccact

SEQ ID NO: 121014 - DNA, 601 bp, Human
tttactcccactctgatggcacacgaaaaaggaaatctttggaagtcaggcgccgaacgagtctgtgagggccctaaacccagctggctccgggatggccgccgctgccgggaagtgggttctgacaaatgacaaacagcagagggagcctgaccccggggcggaggaggaagtgggcctgacagaaaaaggagaagctagacccctggacttgaaatatgaaaaataaaaagcgcagcccttggcttcgctctctagtgaggctttgggaaccctgccggagtcggaaggagtagacggggagagaaaagggcctcctcacacaccctggacccttggcccactcctgccgcgcccccgcctcccacgactggcacccccgggccgccccaatccttcagcaaccggtcccctcccctcgcctccctccttctcgggccccagcttcctctctgccttccgccgcccgcttctctcggcacacacacggtttctctctgctcttcgcaatccccgctgtctccccacaccgtggatcgaaccctcaccggcatcttggcggcgcccgggtttcaacccagaggagcaggatccaggtaca

SEQ ID NO: 121015 - DNA, 601 bp, Human
agtgttcctcctgcctcagcctcccaaagggctgggactacaggtgtgagccaccacacctggctacttcctaatttttttttttttttttgagacagagtttggctcttgttgcccaggctggagtgcaatgacatgaccttggcccactgcaacctccgcctcccgggttcaagtgattctcctgcctcagcctcctgagtagctgggattatagggataagccaccacgcccagctaattttgtatttttggtagagacgatgtttctccattttcgccaggctggtctcgaactccygacctcaggtgatctgcccgccttgccctcccaaagtgctgggattacagatgtgagccactgcactgcacttggcctacttcctaatttttttttttttttgagacggagtcttgccctgtcgcccaggatggagtgcggtggcgcgatctctgctcactgcaacctccgcctcctgggttcaagcgattctcctgccccagcctcccaagtagctgggattacaggtgcgtgccaccacgcccagctaatttttgtatttttagtagagacagggtttcaccatgttggtcaggctgg

SEQ ID NO: 121016 - DNA, 601 bp, Human
ttttcttttgaaacagagttttgctcgttgcctaggctggagtgcaatgacatgatctcggcacactgcaacctccacctcccaggttcaagcaattctcctgcctcagtctcccaagtagttgggattacaggcatgcgccaccatgcccggctgattgtttgtatttttagttgagatggggtttctccatgttggttacgctggtcttgaactcctgaactcaggtgatccacccacctcgacctctcaaagtgctgggattataggtgtgagccatcacgcctggcctttgcagtgaaaaaaaatttttttttttttttgagatgaagtctcactctgtcacccaggctggagtgcagtggtgcaatcttggctcactgcaacctccaccctctgtgttcaagcgattctcctgtctcagcctcctgagtagctgggatcacaggtgcccaccaccatgcctagctaatttttgtatttttagtagagttggggtttcgccatgtttgccaggctggtctcgaactcctgaccttaagtgatccacttgccttggccttccaaagtgctgggattacaagtgtgagccaccgcaccc

SEQ ID NO: 121017 - DNA, 601 bp, Human
attctacagatatttgttgaatataaatgaattagtgtgattaatgctgttatttagctcacagcacaggcctccattccaattcaggtttttttttttttttcttttgaaacagagttttgctcgttgcctaggctggagtgcaatgacatgatctcggcacactgcaacctccacctcccaggttcaagcaattctcctgcctcagtctcccaagtagttgggattacaggcatgcgccaccatgcccggctgattgtttgtatttttagttgagatggggtttctccatgttggttasgctggtcttgaactcctgaactcaggtgatccacccacctcgacctctcaaagtgctgggattataggtgtgagccatcacgcctggcctttgcagtgaaaaaaaatttttttttttttttgagatgaagtctcactctgtcacccaggctggagtgcagtggtgcaatcttggctcactgcaacctccaccctctgtgttcaagcgattctcctgtctcagcctcctgagtagctgggatcacaggtgcccaccaccatgcctagctaatttttgtatttttagtagagttggggtttc

SEQ ID NO: 121018 - DNA, 601 bp, Human
tcatcccagctcattgccctgtggaagaatttcaacagaactctaactctagacttgtgttccttgcaatttactttttttttttttgagatggagtctcgctctgttgcccaggctggagtgcagtggtgcaatcttggctcactgcaagctctgcctcctgggttcacgccattctcctgcctcagcctcccgagtacctgggactacaggagcccgccaccacgcttggctaattttttgtatttttagtagagatggggtttcaccgtgttagccaggatggtctcgatctcctgayctcgtgatccacccgtcttggcctcccaaagtgctaaagtactgggattacaggcgtgagccaccgcgccacgccctattttttatttatttattttttcgagatcaagtctcactttgtcgcccaggctggagtgccatggcacaatctaggcccagtgcaacctccgcctcctgagttcaagtgattctcctgtctcagcctcccatgtagctgggactacaggtgcctgccaccacagctagctaattttggtatttttggtagagacagagtttcaccatgttggccaggctggtc

SEQ ID NO: 121019 - DNA, 601 bp, Human
gactcgttactcgtagcaaaattcttaggcacacaggatctttgtctttttttaaaccttgccttggtgagcgagttttctaaagagcgattagtcccattgtggagatgcacccctaccgcccaagcctttgttgcgcgtgcgtcggaaggcgactagggacgcatgcgcttgcgatttcctagcactcccaactccagcatacggcctcccttgataggcagaagcacgtgtcttgttgcgacctgaacgaacaataagtgctaggtacacagttggtgtctagtttttcttttcctcratggaaattgtttcgtgttgtagcccatttaacacttccccctccccccactctagtctcctaaagagcccgaacagctgaggaagctcttcattggagggttgagctttgaaacaactgatgagagcctgaggagccattttgagcaatggggaacgctcacggactgtgtggtaagatttggaagggacaaagcagtaaaacagccgatttccttggcttatcttggtgcagtcttctccgaatgcttatgaaagtagttaatagcattatagttagagctttgttggcaaaggaacg

SEQ ID NO: 121020 - DNA, 601 bp, Human
gaggtgggaggcttgggcaccagcccccaaaaagccagaaatgattttttccagatggagctggaagggggctcagggctgagcgtgatggggtagagatgtttgggacctattttacgttttaaccttaagtcagagaagtgaattgagaagccaaacaaatgccaatgtgagagtttgtatctgctgatggtagcagcaataagtgaagtgctggtaaggaaaggtcaggcagaaatctggaaagagagagggaggagaggaaatgtgacatgagttagcagagcccttccatatacckttcttctccgtttaattgtaataaagcaaaagcagctcgggtagcctctcaacctcttagctcaaaagaggaatcaccagcgcaggccttggaggtgtttgggggcagttctcagcagcttaacatgcccaatctgccctcttcctcctttccccctccctgctgatccccagctcccttcaactggtcagcccgggccctgtccccaaaatattagcacccccaaatgatatccatttctgtgttaggtgtgtcaaatttcacttctctccatgcctaaactttgaaaggaggagtgta

SEQ ID NO: 121021 - DNA, 601 bp, Human
ggcttgggcaccagcccccaaaaagccagaaatgattttttccagatggagctggaagggggctcagggctgagcgtgatggggtagagatgtttgggacctattttacgttttaaccttaagtcagagaagtgaattgagaagccaaacaaatgccaatgtgagagtttgtatctgctgatggtagcagcaataagtgaagtgctggtaaggaaaggtcaggcagaaatctggaaagagagagggaggagaggaaatgtgacatgagttagcagagcccttccatatacctttcttctcygtttaattgtaataaagcaaaagcagctcgggtagcctctcaacctcttagctcaaaagaggaatcaccagcgcaggccttggaggtgtttgggggcagttctcagcagcttaacatgcccaatctgccctcttcctcctttccccctccctgctgatccccagctcccttcaactggtcagcccgggccctgtccccaaaatattagcacccccaaatgatatccatttctgtgttaggtgtgtcaaatttcacttctctccatgcctaaactttgaaaggaggagtgtacctttttgg

SEQ ID NO: 121022 - DNA, 601 bp, Human
agttagcagagcccttccatatacctttcttctccgtttaattgtaataaagcaaaagcagctcgggtagcctctcaacctcttagctcaaaagaggaatcaccagcgcaggccttggaggtgtttgggggcagttctcagcagcttaacatgcccaatctgccctcttcctcctttccccctccctgctgatccccagctcccttcaactggtcagcccgggccctgtccccaaaatattagcacccccaaatgatatccatttctgtgttaggtgtgtcaaatttcacttctctccatrcctaaactttgaaaggaggagtgtacctttttggaatgcggtgtgtgtagcgggggcaggtatgtgctcagacagcttcccccatcatatctatgggaaactggaagccccttaggtgagccatgctttggtgttcccaaacagcattccctgcattcaggttctctggcagaccaggaggctctttgcgatctgatcctttgactaggagttccatggagatcaaaggagcttatttatacacaaaacaccaggcatttggagtagaatttattttttaatttctaaataaaaaagtct

SEQ ID NO: 121023 - DNA, 601 bp, Human
gcaaaagcagctcgggtagcctctcaacctcttagctcaaaagaggaatcaccagcgcaggccttggaggtgtttgggggcagttctcagcagcttaacatgcccaatctgccctcttcctcctttccccctccctgctgatccccagctcccttcaactggtcagcccgggccctgtccccaaaatattagcacccccaaatgatatccatttctgtgttaggtgtgtcaaatttcacttctctccatgcctaaactttgaaaggaggagtgtacctttttggaatgcggtgtgtgtagsgggggcaggtatgtgctcagacagcttcccccatcatatctatgggaaactggaagccccttaggtgagccatgctttggtgttcccaaacagcattccctgcattcaggttctctggcagaccaggaggctctttgcgatctgatcctttgactaggagttccatggagatcaaaggagcttatttatacacaaaacaccaggcatttggagtagaatttattttttaatttctaaataaaaaagtctaatcatagaccaatcgggccaactgagcagtcgctccagaacagcaaagcc

SEQ ID NO: 121024 - DNA, 601 bp, Human
tggtcagcccgggccctgtccccaaaatattagcacccccaaatgatatccatttctgtgttaggtgtgtcaaatttcacttctctccatgcctaaactttgaaaggaggagtgtacctttttggaatgcggtgtgtgtagcgggggcaggtatgtgctcagacagcttcccccatcatatctatgggaaactggaagccccttaggtgagccatgctttggtgttcccaaacagcattccctgcattcaggttctctggcagaccaggaggctctttgcgatctgatcctttgactaggrgttccatggagatcaaaggagcttatttatacacaaaacaccaggcatttggagtagaatttattttttaatttctaaataaaaaagtctaatcatagaccaatcgggccaactgagcagtcgctccagaacagcaaagccttaaccaaatagtgtgattatgaggggagctgagcaattactgaaactcggctttctccgtaagagggattttagccctcgcccagtggcacaaaaggggccagcggggcaaccgttcttctcttgctcagaaaagtgagacttgggggtggtgggggc

SEQ ID NO: 121025 - DNA, 601 bp, Human
gccaactgagcagtcgctccagaacagcaaagccttaaccaaatagtgtgattatgaggggagctgagcaattactgaaactcggctttctccgtaagagggattttagccctcgcccagtggcacaaaaggggccagcggggcaaccgttcttctcttgctcagaaaagtgagacttgggggtggtgggggcagggtcgggcagctgcggtcgcgtccaggcagctgagcacccaggccaggcgctgaggctgagcactgagtcctgaggctccagtgcttgggtccccgagcagcctcmggaggcaccgagctgtagttgcagcgcggcagtcaggaatggagtatgtgtatctgtgtgcgagggttggtgagttacaaacatccgcgcagagttaggggatctggggagagagaggagacagggagaacacaactaaggaggacctctggaaaatattgtccccaaataaaaattccagatctcatccctctcacttcaaatatccctccccaggaaattaatatatttcccagagctgagtggaaagcaaaggccagcaaggtgaggcctgcccacgaacttcttcaggctgggtcc

SEQ ID NO: 121026 - DNA, 601 bp, Human
acagcaaagccttaaccaaatagtgtgattatgaggggagctgagcaattactgaaactcggctttctccgtaagagggattttagccctcgcccagtggcacaaaaggggccagcggggcaaccgttcttctcttgctcagaaaagtgagacttgggggtggtgggggcagggtcgggcagctgcggtcgcgtccaggcagctgagcacccaggccaggcgctgaggctgagcactgagtcctgaggctccagtgcttgggtccccgagcagcctcaggaggcaccgagctgtagttgcrgcgcggcagtcaggaatggagtatgtgtatctgtgtgcgagggttggtgagttacaaacatccgcgcagagttaggggatctggggagagagaggagacagggagaacacaactaaggaggacctctggaaaatattgtccccaaataaaaattccagatctcatccctctcacttcaaatatccctccccaggaaattaatatatttcccagagctgagtggaaagcaaaggccagcaaggtgaggcctgcccacgaacttcttcaggctgggtccagtcccacccaccctttccccag

SEQ ID NO: 121027 - DNA, 601 bp, Human
gtgcccaggctgcaatgccacccttatccttggggactccaggccagtgactgcaccccactcaggtccaaggcgcaggcagtaaatttctctcctataattagcgctatcaaaagcatgtgttttgcattggagaggactggagaagcaagtggcaatttttcccttgtattctttttctgtgttttttgaattctgtttttgaatccactaattaaagcttctctgaaagtgaaaatctgctcttgacaccaagccccttccgaatgcctgatttgggaggctaaggggccagagcagyagcaaggagacctgcaagcctgatggggttggggggtagtgttctctgatttctttaggctcgttttatagaaacaaagaacaagttctctcccctccttcccaagacttgtgcatatttacagagcacaactgcagttttaataaaacatctgttcttgcttctgctgatgagtttccataattgttttcagacaaatttaacaggaaaatataaatatatttagaaaaatctaagtcccagctttccccctatagacagccattcttttgccaaaaaaataaaattaacatgaaatgg

SEQ ID NO: 121028 - DNA, 601 bp, Human
aggtccaaggcgcaggcagtaaatttctctcctataattagcgctatcaaaagcatgtgttttgcattggagaggactggagaagcaagtggcaatttttcccttgtattctttttctgtgttttttgaattctgtttttgaatccactaattaaagcttctctgaaagtgaaaatctgctcttgacaccaagccccttccgaatgcctgatttgggaggctaaggggccagagcagtagcaaggagacctgcaagcctgatggggttggggggtagtgttctctgatttctttaggctcrttttatagaaacaaagaacaagttctctcccctccttcccaagacttgtgcatatttacagagcacaactgcagttttaataaaacatctgttcttgcttctgctgatgagtttccataattgttttcagacaaatttaacaggaaaatataaatatatttagaaaaatctaagtcccagctttccccctatagacagccattcttttgccaaaaaaataaaattaacatgaaatgggaaaaagaaaatataatccaatgtagggaagatcgggctcatctgacctgctctccccccttg

SEQ ID NO: 121029 - DNA, 601 bp, Human
gaaaatctgctcttgacaccaagccccttccgaatgcctgatttgggaggctaaggggccagagcagtagcaaggagacctgcaagcctgatggggttggggggtagtgttctctgatttctttaggctcgttttatagaaacaaagaacaagttctctcccctccttcccaagacttgtgcatatttacagagcacaactgcagttttaataaaacatctgttcttgcttctgctgatgagtttccataattgttttcagacaaatttaacaggaaaatataaatatatttagaaaaatstaagtcccagctttccccctatagacagccattcttttgccaaaaaaataaaattaacatgaaatgggaaaaagaaaatataatccaatgtagggaagatcgggctcatctgacctgctctccccccttggagcgaatcctttcagcaaatttcagctgcataattaaagatctaagagaaagaagagggcttcttctttcctcaggaatgaaaggtaattggggggggggggggtgttgaaaattaattttgccaaaggtctttaagcagtggaggaatttatttgtatttctgtttcc

SEQ ID NO: 121030 - DNA, 601 bp, Human
gggggtgttgaaaattaattttgccaaaggtctttaagcagtggaggaatttatttgtatttctgtttccccttctctcccccttccagcatttctgcctttttcacccagcagctggtttctgttcattataaatcggcgagacctttcagtctctgccctctgtttagggacgtcataaaacacttaactttctggggctgaggctcacattctgcctctcaggtcgccaacctccctgagcccaccgactttaggccccaatagagaatctccccaactttggggcccctttcctctscagacatggttgaggaggggctcaaggaaacctaggcatccttgctgggggctgtagtccatgctgccccagaagccccttctttcttccaaggtccttccctcccccacccagacataaaagagatttttaaatacatagaaaatcaacactcattgaaagtgaaacctcattaagacatcctatcttccatcattcaatttgttgtacattgcaacaatttaatatcttgaaggaaatatcactgacatgatttatccctctagcaatctctctctgaaattggagggggggacagag

SEQ ID NO: 121031 - DNA, 601 bp, Human
ccctttcctctccagacatggttgaggaggggctcaaggaaacctaggcatccttgctgggggctgtagtccatgctgccccagaagccccttctttcttccaaggtccttccctcccccacccagacataaaagagatttttaaatacatagaaaatcaacactcattgaaagtgaaacctcattaagacatcctatcttccatcattcaatttgttgtacattgcaacaatttaatatcttgaaggaaatatcactgacatgatttatccctctagcaatctctctctgaaattggagkgggggacagagttactctctcttccggcctcttctacttgttacaccactacccttagggcagaaaggaggctgggaactctgagagaggctacttgtgtccaggggtgcactgacttgttccctagctcagtccccagagtactcctgccttgttgtctctcccccacctcttgccctccagggggcctgaagcctcagccagctgttggaaacctctgctcaggcatgccatgaattcgaggacagctggattctagggcaaaaagcaactcacattggtgtctatgtttgtgtacct

SEQ ID NO: 121032 - DNA, 601 bp, Human
atagccattagctttatcagactgcctcaggcatggttagggaagggagcaaaagtggagattttttgaaagttctgattggtacctttcgtttgtcgaataactttgagctagttaagggttctggaaaggaatgagcacagagaattccgactttcctcactctccacattaaatagttgatggatttgtttaaaccccttcccttccattcttttaacaggatataataatagtaataataataatagactaggtgatgatcctatgtcctggccaatagccatcaaaaggtacagcyactgaaggtgtggatttcagtgtttgagtttacatggattaggccaagaacaagcaataggcgagaaactattgctgagtaagagcatctgatggcacagggagtgcacagctatgacagaaatgcttgtgtttcctgaacacttgggctgggccctgagccagtccactgctgggtccagacccaggtattctcccccagccacttctctagagctttgtttcagagtgaattttctggttgggttctcctccccttctcttcctgatctcttgccctctttgagctaaggggcaggag

SEQ ID NO: 121033 - DNA, 601 bp, Human
cccaacccctcagtcacaaaggaactaacattgacagtaaatagcctcagagcctggctgtagatatcaggactcttctgttctggggctgatctctccctgtcactctttccccaagccccaaaccccctttgacaaggtagaacttcagatgtataagacagagttcataggagctaggaataagaggagatggcagcggggcataggggaaccccatcgtgtaccgcatgaatggaggaaactctgcagtctgtcactgggtttttttgtaattaagatgggtgcaggggtgtgtgattgtgtgtgtttgtgtgtgtgtgtgtgtgtaagcccccagccttctcacatctctatgtaccaaacaaacaatatattttacctaaataactccatttcctaatgataatgagtcttcccctcctaaggatcccccaccccctggctggcaagtccctcccttgtgcctggggctacagagctgaaggaaaacaaagttaagagccctctaattcagccttagttcaagccagatcaggtcaggaagctttcaggcccaggcatcagggcttatattcattgccagcaaaatgcccctata

SEQ ID NO: 121034 - DNA, 601 bp, Human
cctcagtcacaaaggaactaacattgacagtaaatagcctcagagcctggctgtagatatcaggactcttctgttctggggctgatctctccctgtcactctttccccaagccccaaaccccctttgacaaggtagaacttcagatgtataagacagagttcataggagctaggaataagaggagatggcagcggggcataggggaaccccatcgtgtaccgcatgaatggaggaaactctgcagtctgtcactgggtttttttgtaattaagatgggtgcaggggtgtgtgagtgtgtgtgtttgtgtgtgtgtgtgtgtgtaagcccccagccttctcacatctctatgtaccaaacaaacaatatattttacctaaataactccatttcctaatgataatgagtcttcccctcctaaggatcccccaccccctggctggcaagtccctcccttgtgcctggggctacagagctgaaggaaaacaaagttaagagccctctaattcagccttagttcaagccagatcaggtcaggaagctttcaggcccaggcatcagggcttatattcattgccagcaaaatgcccctatatgctgga

SEQ ID NO: 121035 - DNA, 601 bp, Human
cagtcacaaaggaactaacattgacagtaaatagcctcagagcctggctgtagatatcaggactcttctgttctggggctgatctctccctgtcactctttccccaagccccaaaccccctttgacaaggtagaacttcagatgtataagacagagttcataggagctaggaataagaggagatggcagcggggcataggggaaccccatcgtgtaccgcatgaatggaggaaactctgcagtctgtcactgggtttttttgtaattaagatgggtgcaggggtgtgtgagtgtgtgtgtgtgtgtgtgtgtgtgtgtgtaagcccccagccttctcacatctctatgtaccaaacaaacaatatattttacctaaataactccatttcctaatgataatgagtcttcccctcctaaggatcccccaccccctggctggcaagtccctcccttgtgcctggggctacagagctgaaggaaaacaaagttaagagccctctaattcagccttagttcaagccagatcaggtcaggaagctttcaggcccaggcatcagggcttatattcattgccagcaaaatgcccctatatgctggaaat

SEQ ID NO: 121036 - DNA, 601 bp, Human
agtcacaaaggaactaacattgacagtaaatagcctcagagcctggctgtagatatcaggactcttctgttctggggctgatctctccctgtcactctttccccaagccccaaaccccctttgacaaggtagaacttcagatgtataagacagagttcataggagctaggaataagaggagatggcagcggggcataggggaaccccatcgtgtaccgcatgaatggaggaaactctgcagtctgtcactgggtttttttgtaattaagatgggtgcaggggtgtgtgagtgtgtgtgttggtgtgtgtgtgtgtgtgtaagcccccagccttctcacatctctatgtaccaaacaaacaatatattttacctaaataactccatttcctaatgataatgagtcttcccctcctaaggatcccccaccccctggctggcaagtccctcccttgtgcctggggctacagagctgaaggaaaacaaagttaagagccctctaattcagccttagttcaagccagatcaggtcaggaagctttcaggcccaggcatcagggcttatattcattgccagcaaaatgcccctatatgctggaaata

SEQ ID NO: 121037 - DNA, 601 bp, Human
tccaagattttttctgtccaactcctcggctcctttggcttccgcggctttgactaatgattgctacagatgccaacgtctccagaatcctaatagccaggcaggcggactcttatttacccggcaacattgctgtgggggagggggcctgggggacaagtattggggtgtcgtaggtcaggggacagggagaaggttgtggccaactcaagtgtcactgaacttcttcccagtcagaaagacattcccaatccccttctctccttgagggaaatatatatatatatatacacagttaatrgtaactcattgctgcctcgttagaaaagatcaaagaatgaacacaacgtggtagaataagcagagcaatgtttatttgttgtaaataaatgagagaataagtggaaaaccagcagtttggggaggaaaaagagaaagggaaagaagtcagccacagtgggagaaggggctccttttcttcatttcttgtcttcccctttctctccccaccctaagtctacccttctcatcaatttctcccctctttcccttccttcgcctcaccttcaatcccttgggtggaggggctgaacagcgtgtt

SEQ ID NO: 121038 - DNA, 601 bp, Human
caggcaggcggactcttatttacccggcaacattgctgtgggggagggggcctgggggacaagtattggggtgtcgtaggtcaggggacagggagaaggttgtggccaactcaagtgtcactgaacttcttcccagtcagaaagacattcccaatccccttctctccttgagggaaatatatatatatatatacacagttaatggtaactcattgctgcctcgttagaaaagatcaaagaatgaacacaacgtggtagaataagcagagcaatgtttatttgttgtaaataaatgagagawtaagtggaaaaccagcagtttggggaggaaaaagagaaagggaaagaagtcagccacagtgggagaaggggctccttttcttcatttcttgtcttcccctttctctccccaccctaagtctacccttctcatcaatttctcccctctttcccttccttcgcctcaccttcaatcccttgggtggaggggctgaacagcgtgttcccgggcggaggtgcgcgcagccaccccaggctgctgccaggtgcccgctggggctgccagggcgaggaggcctctgggctgtggagcgaaagtcag

SEQ ID NO: 121039 - DNA, 601 bp, Human
ggcgaggccgaagcccgccccggacccaggccgcgaggtgcgcgccggccgccgaggggccgcctgtaaattacagcccgccgggaggactcggaaatacacaaaaggagccgaaagatttaaacagtcggaggcagaggcgtcccgaggcggccaaagcggaaatcaatcacgtaattaaaacagggaggggacgaagcccaaggctgggggtcccgggttcggaggaggcggccaaggtgcaggccgaggctggcgagcggcttagggacgtggctcgcccgccaggaccagagcgcgyggaggggcttcggggaagtttataacacatcgctattgattcccgcttggctaggaagagcagactctggtgccctctcccaggccagaccctgaagcctccgatggccccttctccgactttcccgtttttgtggggttgagacgcgcagttgcagttgaaggccgctccccagatcccactggtgccacgattttgccaaggcaagtttgcgaacccaaatggcatcaagatgctgcctttgggtttgaggggatggagggaggtgacaccccagtttcaggcactaagaaatctctc

SEQ ID NO: 121040 - DNA, 601 bp, Human
ttttagaccaattcattacttttactgacaagagatttaagaaaaaatcaattaagatttgcatattcttttgcatacattagccctggctgccggcattagaaagggacaaacacatacacacacacacacacacacacacacacacacacacacacacacacacgaaaaaaatgggctatgagccttgatttagttttgggttttcaagttgcccaaaggaaaaaaaaatcaaagtgaaatgaattgcctgattgcataccatctaaaattcaatttatatgagtgaaaggaaacagamatgttgcaatttttaatccctaaaacaacaacaacaacaacattcacacacataaaccctgcatttcaaagagtagggaaaggaatgaccctcattttccttccctttgccctccaaatcctgaattggttcacccatttatttttctcccttggaaaaatcagagaggggtacgattttaatgcagcagagaatctatggagccgctgagctctctcagccggcagcttgttactggggaggggaggaatatgggttatccaacggtcagtatggtaatccaggcacaataaggcctca

SEQ ID NO: 121041 - DNA, 601 bp, Human
gacaagagatttaagaaaaaatcaattaagatttgcatattcttttgcatacattagccctggctgccggcattagaaagggacaaacacatacacacacacacacacacacacacacacacacacacacacacacacacgaaaaaaatgggctatgagccttgatttagttttgggttttcaagttgcccaaaggaaaaaaaaatcaaagtgaaatgaattgcctgattgcataccatctaaaattcaatttatatgagtgaaaggaaacagaaatgttgcaatttttaatccctaaaacaacaacaacaacaacattcacacacataaaccctgcatttcaaagagtagggaaaggaatgaccctcattttccttccctttgccctccaaatcctgaattggttcacccatttatttttctcccttggaaaaatcagagaggggtacgattttaatgcagcagagaatctatggagccgctgagctctctcagccggcagcttgttactggggaggggaggaatatgggttatccaacggtcagtatggtaatccaggcacaataaggcctcacacacaatggacacatatttttcttc

SEQ ID NO: 121042 - DNA, 601 bp, Human; identical to SEQ ID NO: 37705

SEQ ID NO: 121043 - DNA, 601 bp, Human
gattctaatgttgcagtcatatatcatgcagtgtaaaaatgcctgtctcacacccagtaagatatctgctgagtggctgctgtgcgtcaatgttctaggtgctgggggcaatagcattaagataatcttgtgcctcttttattattatttatagataggggttttgctttagtgcccaggctggtctcaaactcttggctcagtctcccaaaatgttgggattacaggtgtgagccactgcacctggcccattcttgggccttttgttctttctgcctataccattgtacaatttccactstgaaacttggaggacagggatcaggcaaagtacctaatgtataaaaggagcttaccgagtctgtattaaaggcctgggtcacaaattctagacagtacatcttagtccagaagtcaagcaacctatagcatagagaccattttgtttaattagctctgatttatggtaaaagtatgtgcttaatatggatctgagattagcttcatggtagctgtcacccattggcccttcctacactgcctagagtggtacaggctgaggcttatcagatacctcatttgaagagtcacccccatatct

SEQ ID NO: 121044 - DNA, 601 bp, Human
cccaggctggtctcaaactcttggctcagtctcccaaaatgttgggattacaggtgtgagccactgcacctggcccattcttgggccttttgttctttctgcctataccattgtacaatttccactctgaaacttggaggacagggatcaggcaaagtacctaatgtataaaaggagcttaccgagtctgtattaaaggcctgggtcacaaattctagacagtacatcttagtccagaagtcaagcaacctatagcatagagaccattttgtttaattagctctgatttatggtaaaagtwtgtgcttaatatggatctgagattagcttcatggtagctgtcacccattggcccttcctacactgcctagagtggtacaggctgaggcttatcagatacctcatttgaagagtcacccccatatctttggctcagattttctttagcacactgcaagagtaaatagaagggagagttctcttagattgccaggagttgggtcttaccctctgttgtaagaaatattagcttttctctgtgtatgtatgggtatgcacatgtatgtatgagtatacacacacacacagggactggcactct

SEQ ID NO: 121045 - DNA, 601 bp, Human
atttccactctgaaacttggaggacagggatcaggcaaagtacctaatgtataaaaggagcttaccgagtctgtattaaaggcctgggtcacaaattctagacagtacatcttagtccagaagtcaagcaacctatagcatagagaccattttgtttaattagctctgatttatggtaaaagtatgtgcttaatatggatctgagattagcttcatggtagctgtcacccattggcccttcctacactgcctagagtggtacaggctgaggcttatcagatacctcatttgaagagtcacmcccatatctttggctcagattttctttagcacactgcaagagtaaatagaagggagagttctcttagattgccaggagttgggtcttaccctctgttgtaagaaatattagcttttctctgtgtatgtatgggtatgcacatgtatgtatgagtatacacacacacacagggactggcactctattgagtgagtcctactacaaactctgaacaaattctgatatttaatgatagattcttttattgggtcatatctaaaggatatgcaaatcctgttttaaaggttggagaaatagtgg

SEQ ID NO: 121046 - DNA, 601 bp, Human
aattagctctgatttatggtaaaagtatgtgcttaatatggatctgagattagcttcatggtagctgtcacccattggcccttcctacactgcctagagtggtacaggctgaggcttatcagatacctcatttgaagagtcacccccatatctttggctcagattttctttagcacactgcaagagtaaatagaagggagagttctcttagattgccaggagttgggtcttaccctctgttgtaagaaatattagcttttctctgtgtatgtatgggtatgcacatgtatgtatgagtatacacacacacacagggactggcactctattgagtgagtcctactacaaactctgaacaaattctgatatttaatgatagattcttttattgggtcatatctaaaggatatgcaaatcctgttttaaaggttggagaaatagtggtattttttaaaaccacattatactggatctactatctcaagtgcaggaaaactggcacatctccatttggaagcatcttggagttaattgagataaaagatgttaaggaacaaacctgtttctgcacttgctatctctctctctctctctctctctc

SEQ ID NO: 121047 - DNA, 601 bp, Human
actggcactctattgagtgagtcctactacaaactctgaacaaattctgatatttaatgatagattcttttattgggtcatatctaaaggatatgcaaatcctgttttaaaggttggagaaatagtggtattttttaaaaccacattatactggatctactatctcaagtgcaggaaaactggcacatctccatttggaagcatcttggagttaattgagataaaagatgttaaggaacaaacctgtttctgcacttgctatctctctctctctctctctctctctctctctctctctctmtatatatatatatatatatttttttttttttttttttttttttttgagccggagtctcactctgtcacccaggccggagtgcagtggcacagtctcggctcactgcagcctccgcctcccaggttcaagcgattcttctgcctcagcctcccgagtagctgggactacaggcacacaccaccacgtgtggctatttttgtatttttggtggagatggggtttcaccatttggccaggctggtcttgaactcctgacctcatgatctgcctgcctcggcctcccaaagtgctgggattaca

SEQ ID NO: 121048 - DNA, 601 bp, Human
tgatgggactagcatttcaagttagtctatgggcccagcctctttttgaaaagatggcctagttcagagggctcagggttctttttggtgctcattaagtataaatgtgtgtcttatgtaagagggaaaacttctgagaactggaagatagaaacattgtattagagagacttgggagccagagttcaacaatgtatctaaaacaggtttcaatagttatcctttttatagatcatacagagtcttggcttattacagggtttctagagtatgttctattccatttccccccctagctggrtgagactcaggatgtagcacaggtcaagcaagggtctgactggttttgagacctctccagtccaaaggtccactccatatccacttattgttgcttttttggtttctttgaggattttcacacatatttgaagaacactatttgtgacttgaataaggcattccatgacagtaagtctgccttagccacatgtacatctgaatctttgcacattcttccagtgggattttttttcttcttctttttgagacatagtttcactctgtgacctaggctggagtgcagtggcatgaacacggc

SEQ ID NO: 121049 - DNA, 601 bp, Human
tttgccgggctcggtggctcatgcctgtaatcccagcactttgggaggctgaggcgggcagatcatgaggtcaggagtttgagaccagcctgacgaacatggtgaaaccccgtctctactaaaaatacaaaaattagccgggcgtggtggcacatgcctgtaatctcagctactctggaggctgagatttacttgagaattgcttgaacccgggaggcggaggttgcagtgagccaagattgccccactgcactccagcctggacgacagggcgagactgtgtctcaaaaaaaaaaaaaaagaaagaaaattgagaaaatttaaaaatattaattcatcaaaataacaataatccactgtatgttaacagatttctgtgaaaattaactattttccaaaatgaaatctaatgagaaaagtactgttatttttgcacatttgcaaatctttctggcctaatagaagaaaactttattgtcatatctggttcttcattcagtctttggtgctatgttgttttggttaaagtatttgaagaacatctggctttatacacatgtaattaaaggggaactcatggacccctgaaaaggtctcatgg

SEQ ID NO: 121050 - DNA, 601 bp, Human
aattgggcttcaagctgttaactataaattcacccattctgaaaggcatgttgaattacctgttcccttcaaaatctaccaagtaaattgttaaatggtattatattatgctagtctgctctttaacaatctgtattggtgcatattgtgagaaggtttaaggagttggaaattttgtaagttttttagatgatgtactttcacaatggacaatgaatcagatatttcaaccatgtattttcctttagcaaactagattttttttttctttgaggcggagcctcagtctgttgcccaggcygaagtgcagtggtgtgatcttggctcactgcaacctctgcctcctgggttcaagcgattcttgtgcctcagcctcccgagtagctgggactacaggctcctgccaccatgacctgctaaattttttttttgcatttttagtggagacggggtttcaccatgttcgccaggctggtcttgaactcctgacctcaggtgatccacctgcctaggcctcccaaagtgctgggattacaggtgtgagccactgcacccggcccaaactagattttttttaaaaaagcatgagtagataatagag

SEQ ID NO: 121051 - DNA, 601 bp, Human
tctacaaaaaataaacagagttagccagagtggtggcgcatgcctgtaatcccagctacttgggagactgaggtgggaggattgcctgagtccaggaggctacagtgagtctatagtgaggctacagtgagctgtgtttgagccactgcaccccagtctgggcaacagagcgaaaaccttctcaaaaagaaaaaaagttggccgggcgtggtggctcatgcctgtaatcccagcactttgggaggcccaggcaggtggatcacaaggtcaggaattcgagaccagcctggccaatatggtraaaccccgtctctactaaaaatacaaaaattagctgggcatggtggtgtgcgcctgtagtcccagctactcgagaggctgaggtacaagaatcgcttgaacccaggaggcggaggttgtagtgagccaagatcgtgccactgcattccagcctgggcaacagcgccgagactatgtctccaaaaaaaaaaaaaaaaaaaaagttgagtgacaaatatgtggcttcagaaaggttgagtaacttgtcctaagtcaaacagctagttaaagagaaactagcgttcaaacctggggctccata

SEQ ID NO: 121052 - DNA, 601 bp, Human
ccgggcgtggtggctcatgcctgtaatcccagcactttgggaggcccaggcaggtggatcacaaggtcaggaattcgagaccagcctggccaatatggtgaaaccccgtctctactaaaaatacaaaaattagctgggcatggtggtgtgcgcctgtagtcccagctactcgagaggctgaggtacaagaatcgcttgaacccaggaggcggaggttgtagtgagccaagatcgtgccactgcattccagcctgggcaacagcgccgagactatgtctccaaaaaaaaaaaaaaaaaaaaagttgagtgacaaatatgtggcttcagaaaggttgagtaacttgtcctaagtcaaacagctagttaaagagaaactagcgttcaaacctggggctccatagctaggattaaacttcttcccattatgtcgtgctgacatctgagtactctagaaactagtgaaatactcatgtcttataaatgccatgtagggacagtgtgtcttagtctgtttgtgtggctataacaaaatacctgagatcaagtaatttataaacaacagaaatgtatttctcactgttctggaggctgggaattccaa

SEQ ID NO: 121053 - DNA, 601 bp, Human
accagcctggccaatatggtgaaaccccgtctctactaaaaatacaaaaattagctgggcatggtggtgtgcgcctgtagtcccagctactcgagaggctgaggtacaagaatcgcttgaacccaggaggcggaggttgtagtgagccaagatcgtgccactgcattccagcctgggcaacagcgccgagactatgtctccaaaaaaaaaaaaaaaaaaaaagttgagtgacaaatatgtggcttcagaaaggttgagtaacttgtcctaagtcaaacagctagttaaagagaaactagcrttcaaacctggggctccatagctaggattaaacttcttcccattatgtcgtgctgacatctgagtactctagaaactagtgaaatactcatgtcttataaatgccatgtagggacagtgtgtcttagtctgtttgtgtggctataacaaaatacctgagatcaagtaatttataaacaacagaaatgtatttctcactgttctggaggctgggaattccaagatgaaggtgctggcaggtttggtgtctaataaggcctgttgactgcttccaaggttgcaccttgaactttgtattctc

SEQ ID NO: 121054 - DNA, 601 bp, Human
tgcctgtgaatagccactgcgttccagtctaggcaacacagggagatcccatgtctggaaaaaaaaaaaaaaaggaaccttcattgaaatctagagttggaggaattatatgtagagttggagcttacatgtaattccagattgagttcctcaaactccttttggtggctgttactcgtagcagagtatgatgtggattgtagtgggggaaaactggagcacagccaagatggtgccacaacagtttagatgcggtctagggtaacagtaatggataaaaggggaagtgagaggagtgggkgtagtgatggcagtgtctgataggactgtaggagaatggtgggcggggcagagccaagtgctgccctttgaaggggtgaacttgaatgactgtgccaggaaagtagtcccatttaacacaaggagggcagtccaggcatgaagaggataatgagcttaacatacctgtgagaagtttcaggtggaggtatctggtggccttcggcacagcaagtggtaggcacagggagttggctatatgctgtagagaaaatataggtgggctttagaggcaggcataactctgcctccaccttttact

SEQ ID NO: 121055 - DNA, 601 bp, Human
tagagaaaatataggtgggctttagaggcaggcataactctgcctccaccttttactggctttgtaaactttgggggaagttaattaaacttgattcctgagggtcagatggggtcgtctgtgtaaaatgcctggcaagtaggaggcttttctctattgtttgttcccttcttttctggagtcctaatgctttgatttcatttataatcttccttagtgaatgtggtgctttgaatggaagcacaatccagtgggatttaagctgtgtgtgtgtgtgtgtgtgtgtgtgtgtgtgtgtgtttttaccacccagcagaggctacacttgctcactgtttgtaaaccccctattagttgtgctgtccttctattttcccttggacttctcttgtgttcagtcttgtccaaacaaaaatatttgcattaaagttatgtgtgttcctcatttggaagactccttgaatccataattgctttttaaattttttttgaaatagtcttgctttatctcccaggctggaggagtacagtggtgtgatcaaggctcaccgcagcttcaacctcccagactctagcaatcctcccacctccgtttcccatg

SEQ ID NO: 121056 - DNA, 601 bp, Human
aagatcaaggatctagcttggagcacaaaaaaaatgcaagatctcctttccgtggagctcagttctgttttggttttctagggttcttagagactaaacactatgcataacaatgaatgtgttaattttaatgatttgttccatttcttaatgtcttagaattggaagggatttttagtcattctatccaagtggccattctgtgctggatccattctatagcagctgacagctaactcgccttctctggaaacaggctctttcattgctggacaggtctaattgttggaagatttttttyccccttatactgagatgaaagccagccccttgaaactgtcatccataaactgtcatccatttgtccaacttcagtcttttgttgtcacataaattaaatccgctagctcttcagataattgaaaatagttgctaggcagcacttctctgacttaagttgtctttttttccccaagaaaaatagccccagttctctctaccattcttcccatatcatttctaattctttttcagcctttcaccatgacccttttaaactgcaatgaccaccactaacaactggttaagtgtggtagaacca

SEQ ID NO: 121057 - DNA, 601 bp, Human
ctgtcatccatttgtccaacttcagtcttttgttgtcacataaattaaatccgctagctcttcagataattgaaaatagttgctaggcagcacttctctgacttaagttgtctttttttccccaagaaaaatagccccagttctctctaccattcttcccatatcatttctaattctttttcagcctttcaccatgacccttttaaactgcaatgaccaccactaacaactggttaagtgtggtagaaccactgtagctttagtaggttactctgcatattctttttttttttttttttttgagacagagttttgctcttgttgcccaggctggagtgcaatggtgcgacctcagcttattgcaactccgcctcccgggttcaagctattctcctgcctcagcctcccaagtagctgggcttgcaagcatgtgtcaccatgcccagctaattttgtatttttagtagagacgaggtttcaccatgttggtaagtctggtcttgaactcctgacctcaggtgatttacccgccttggcctcccaaagtgctgggattacaggtgtgagccactgtgcctggccctgcatattctttttgttt

SEQ ID NO: 121058 - DNA, 601 bp, Human
ataagcttacgaatggaaatcaggggcctgatgcactacaggcggtttgatttatgacggaaacatcctcagatatccaggaactcatatattggaatagagacaactgtgggaatagattgtcctacccagaaagcaaaatctggcagagtttgaggtttcttattgggtaattttatcagctcgttcttagattaattagtagaataagacttccagagttgcaagatgaaatgcgatgctttcttctcttcttcttcgctatttctacttctgggccatcttggccagcaagagattwttttttttttttttttttttttgatacgaactctcgctctgttgcccaggctggagtgcaatgacatgatctgtgctcactgcaacctccactttccgagttcaagcgattctcctgtctcaacctctcaggtagctgggattgcaggcatgtgccaccaagcctggctaattttctgcatttttagtggagacagggtttcaccacgttggctaggctggtcttgaatgcctgacctcaagtgatccacctgacttggcctcccaaagtgctgggattgcaggcgtgagtcactgcgcc

SEQ ID NO: 121059 - DNA, 601 bp, Human
atcaccttctttttcagtaatgccagcccctcccctacccaaagtcatggctgttgtccatgcatctttttatcttggctattatagaagcatacccactgccaacacatttctggaccctgggtacaaaattagactaagtgaatataaatatccagtctggctagagagaaaagagtgaagaggcctcatgaagcattggcccttattctcaggaagcgttctagggaaagtatggtagaaagaacactaaatgatgattcaggcctgagttcccatcccgactccacctctcacgttyagaacgggcataatgatcagttgatttcgctgcccgtgaatgccgggagactctccttagtctgtaaagtcccctcctcaccacagagatggaacctctgtggtttaaggaaagctggtgtggggaggctagtcctctacccttcacacaaggctccaaatgcagggagttgaagtgccaccacagagatagcagaggtcgaacggtctacctctctcttgcagatgaggaaacttgaggccacgataagtgaaatacattgctgtgttgagagtcctgtgggcagtgagctgaaagcag

SEQ ID NO: 121060 - DNA, 601 bp, Human
ataccagggtgagcaaggcttctcctagttctgtcccatacatgcagtctgatacttcagggtagagtggtcttacaagggaattgagctcatttacaggaatcttactctcagcattttctgtagaacaatgaaaagaacattgagtaattatctctttctggtgacttagccaggcatcttgggaatttgctgttttgtgaacattcgttcagctctgtcttgtatatctagtttgccttcactttatagacagtcacaacaaaaagaggatacagatgtgtgggtgtgtgggtgctasaaacgataacaattttgtatctcccacccagcctaagaaacagagtgttatcagtaccccatagctcctttttccatctctctcctccagcactatcctgcatcttgtaatgattctcttgctttaccatatacttttgtatatgcatgtagccatcaacattatattgtataattgtgtctgtgttagactttttcataaaccagcaggctcctaagctgtagaattaagccttttttttttttttgagacagagtctcgctctgttgcccagactggaatgcaatggcgctatctcag

SEQ ID NO: 121061 - DNA, 601 bp, Human
agggtgagcaaggcttctcctagttctgtcccatacatgcagtctgatacttcagggtagagtggtcttacaagggaattgagctcatttacaggaatcttactctcagcattttctgtagaacaatgaaaagaacattgagtaattatctctttctggtgacttagccaggcatcttgggaatttgctgttttgtgaacattcgttcagctctgtcttgtatatctagtttgccttcactttatagacagtcacaacaaaaagaggatacagatgtgtgggtgtgtgggtgctacaaacrataacaattttgtatctcccacccagcctaagaaacagagtgttatcagtaccccatagctcctttttccatctctctcctccagcactatcctgcatcttgtaatgattctcttgctttaccatatacttttgtatatgcatgtagccatcaacattatattgtataattgtgtctgtgttagactttttcataaaccagcaggctcctaagctgtagaattaagccttttttttttttttgagacagagtctcgctctgttgcccagactggaatgcaatggcgctatctcagctcac

SEQ ID NO: 121062 - DNA, 601 bp, Human
tgtatctcccacccagcctaagaaacagagtgttatcagtaccccatagctcctttttccatctctctcctccagcactatcctgcatcttgtaatgattctcttgctttaccatatacttttgtatatgcatgtagccatcaacattatattgtataattgtgtctgtgttagactttttcataaaccagcaggctcctaagctgtagaattaagccttttttttttttttgagacagagtctcgctctgttgcccagactggaatgcaatggcgctatctcagctcactgctacctccrcctcccaggttcaaggcctcagcctcccaagtagctgggactacaggcatgtgccaccatgcccggctaattttggtatttttagcagagacggggattcgccattgttggccaggctggtctcaaactcctgacctcaagtgatctgcctgtcttggcctcccaaagtgctgggattacaagtgtgagtcacagtgcccggccagaattaagcttttattatttttatttttgggttgtgccagtaaatgataggaagccattcttataacttgacgttgttttgataggccaagttgt

SEQ ID NO: 121063 - DNA, 601 bp, Human
ctctcctccagcactatcctgcatcttgtaatgattctcttgctttaccatatacttttgtatatgcatgtagccatcaacattatattgtataattgtgtctgtgttagactttttcataaaccagcaggctcctaagctgtagaattaagccttttttttttttttgagacagagtctcgctctgttgcccagactggaatgcaatggcgctatctcagctcactgctacctccacctcccaggttcaaggcctcagcctcccaagtagctgggactacaggcatgtgccaccatgccyggctaattttggtatttttagcagagacggggattcgccattgttggccaggctggtctcaaactcctgacctcaagtgatctgcctgtcttggcctcccaaagtgctgggattacaagtgtgagtcacagtgcccggccagaattaagcttttattatttttatttttgggttgtgccagtaaatgataggaagccattcttataacttgacgttgttttgataggccaagttgtcatctgtttgatgtcacctggccaagcaatctgaagaagatcacagatgacttctgatgccccc

SEQ ID NO: 121064 - DNA, 601 bp, Human
ttggtggattagtacccaatcccagtgtttaagactctgagctctggaacaggcctcatgctagattgatatagggcctggcacatagatgcttaataaatattagctgaatgagtattttgtggatttaaagagtattcaaaccacaaaactaaccataccctatattgtcagagggaacagtgtacctttttttttcttcccatttcaggaccaaaatcagccttttgtattttggatctttacatatttatttattttttctttcctttgttttattttgttttgagtcagagtcttkctctgtcgcccaagctggagtgaagtggcgttatcttggctcattgcaacctctgcctcctgggttcaagtgattctcatgcctcagcctccagggtagctgggactgcaggtgcacaccatcacgcccagctaattttttgtatttttgggggttttgccatgttggccagtctggtcttgaactcctgagctcgggcaacccacccaaccttggcctcccaaagcgctgggattacaggcgtgagccactgttcccggccaatatttctttctttttgagagtcattcagtccctgca

SEQ ID NO: 121065 - DNA, 601 bp, Human
tttcttcccatttcaggaccaaaatcagccttttgtattttggatctttacatatttatttattttttctttcctttgttttattttgttttgagtcagagtcttgctctgtcgcccaagctggagtgaagtggcgttatcttggctcattgcaacctctgcctcctgggttcaagtgattctcatgcctcagcctccagggtagctgggactgcaggtgcacaccatcacgcccagctaattttttgtatttttgggggttttgccatgttggccagtctggtcttgaactcctgagctygggcaacccacccaaccttggcctcccaaagcgctgggattacaggcgtgagccactgttcccggccaatatttctttctttttgagagtcattcagtccctgcagtgtttatgctgactgtcctgcatatttagggttgctgtagaatggattttgtgctatataaatatccgtgtgtgtgtgtgtgtgtgtgtgtgtgtgtgtgtgtgtgtatgtatgtgtctgtgttctcatggtttttctaaagaaatgtcatctgcttattggctcttctacttacaggtcttttctttttaacc

SEQ ID NO: 121066 - DNA, 601 bp, Human
caagtgattctcatgcctcagcctccagggtagctgggactgcaggtgcacaccatcacgcccagctaattttttgtatttttgggggttttgccatgttggccagtctggtcttgaactcctgagctcgggcaacccacccaaccttggcctcccaaagcgctgggattacaggcgtgagccactgttcccggccaatatttctttctttttgagagtcattcagtccctgcagtgtttatgctgactgtcctgcatatttagggttgctgtagaatggattttgtgctatataaatatccgtgtgtgtgtgtgtgtgtgtgtgtgtgtgtgtgtgtgtgtatgtatgtgtctgtgttctcatggtttttctaaagaaatgtcatctgcttattggctcttctacttacaggtcttttctttttaaccagccttaagatgatgcagaatgtgagtccaacatcctactccttcagcagttgacagtgttttggcatatgtgctgccctgaatacagtgatctatttcagtctgttgatataaatgtggacagctttaatgtgtaggaattgaggctaacaaaatatctttccatatcctg

SEQ ID NO: 121067 - DNA, 601 bp, Human
tgttgtaagatatgtagaacattgattttcttctaatatacttaacattgtggatgataccatccatctatctttctctctatatgaacacataattttgttatatataatgtttggaatctgacacttcatctttccttttctgaagaaagattttttatatgtcgccttaatcattggtgttttgtttaatcttataaacacatgatggatttatttgttggtttgttgtgaaacttaagaaaaaggcaaagatagtggcctctttggggcaccctatatttattacatttatttgaawccttcctagtgttttctgaattatttgtgtgtgtgatgtgtgtgtgtgaacacactcaggattcagaagctgtgtgggaccatgtatgtgtgtccacagcctttctttggaatactgcttcagaaattagagcaggtaagtccatgcatgctatcatcagcatttaatgatgctgctttctcttccaagcaaactgacaagggtagatgaaggtccagttttccgaaatgggcctcagtcttctgacagggtgttttattgtagtttgctgttgtcatgaggtcttcattcagatgcgga

SEQ ID NO: 121068 - DNA, 601 bp, Human
catgttgcttgccctgcttcagagaagagccaaagctggcaggaatagctgcaaaagtatgctgcacttagatctttcaattagtaaattagagtaagatgcctctggaagtcttccacagagttattttaaacttggggtcgtactgcttgtgttgaattaactcaaggttctctctcaaggggcacatgaaggtcttcctccactgcttctgcttagttcaggccttcatcttgtgcttggattattatcgcagcctcctttgcttccaccatgccacatccaaatgtcacatttccawgggcctgcgacccatgtaggcacgtaaggccccgtgcgtagtttagtgctctgctgttgtcatcttgaaattcttcattttccaacaagaggaacaccttcaatttgtactagtccctacgatttcagtagctggtcttggctctaggaatagcatttctaaaactatctatttaaaattcctcaaagttcacgctccatatcctgcccatctagcaccatctcttagtggtgggcttttctttgactgtcagtgcttgaagaagttcttccaggtataccaaatggccccacatctctg

SEQ ID NO: 121069 - DNA, 601 bp, Human
aatgtcacatttccatgggcctgcgacccatgtaggcacgtaaggccccgtgcgtagtttagtgctctgctgttgtcatcttgaaattcttcattttccaacaagaggaacaccttcaatttgtactagtccctacgatttcagtagctggtcttggctctaggaatagcatttctaaaactatctatttaaaattcctcaaagttcacgctccatatcctgcccatctagcaccatctcttagtggtgggcttttctttgactgtcagtgcttgaagaagttcttccaggtataccaaakggccccacatctctgcaacatttgctgttgctgtttccttcttctcatttcccctacccaacctggttcacttctattcatgttttgaaatgctgaagaaataaggttgggctgtgaaaccgaatatgaccatcttttttttttttttttttgagatggagtcttgctctgtcacctaggctggcgtgatcttggctcactgtaacctccgcctcttgggctcaagctcttctgcctcagcctccccagtagctgggattacagataggcacatgccaccacacccggtaaatttttata

SEQ ID NO: 121070 - DNA, 601 bp, Human
cgatttcagtagctggtcttggctctaggaatagcatttctaaaactatctatttaaaattcctcaaagttcacgctccatatcctgcccatctagcaccatctcttagtggtgggcttttctttgactgtcagtgcttgaagaagttcttccaggtataccaaatggccccacatctctgcaacatttgctgttgctgtttccttcttctcatttcccctacccaacctggttcacttctattcatgttttgaaatgctgaagaaataaggttgggctgtgaaaccgaatatgaccatcttttttttttttttttttgagatggagtcttgctctgtcacctaggctggcgtgatcttggctcactgtaacctccgcctcttgggctcaagctcttctgcctcagcctccccagtagctgggattacagataggcacatgccaccacacccggtaaatttttatatttttagtagagacggggtttctccatgttggtcaggctggtctcaaactcctgacctcaggtgatctgcccaccttggcctcccaaagtgctgggattacaggcgtgagctactgtgtctggcctaatatgacc

SEQ ID NO: 121071 - DNA, 601 bp, Human
ctaggaatagcatttctaaaactatctatttaaaattcctcaaagttcacgctccatatcctgcccatctagcaccatctcttagtggtgggcttttctttgactgtcagtgcttgaagaagttcttccaggtataccaaatggccccacatctctgcaacatttgctgttgctgtttccttcttctcatttcccctacccaacctggttcacttctattcatgttttgaaatgctgaagaaataaggttgggctgtgaaaccgaatatgaccatcttttttttttttttttttgagatgragtcttgctctgtcacctaggctggcgtgatcttggctcactgtaacctccgcctcttgggctcaagctcttctgcctcagcctccccagtagctgggattacagataggcacatgccaccacacccggtaaatttttatatttttagtagagacggggtttctccatgttggtcaggctggtctcaaactcctgacctcaggtgatctgcccaccttggcctcccaaagtgctgggattacaggcgtgagctactgtgtctggcctaatatgaccatcttaactcatgatcacactttg

SEQ ID NO: 121072 - DNA, 601 bp, Human
tttatttattcactgctacatctccagaatatgacctgttatggagtatgtagccaataaatataatactagtcaaatgaatgtggcttgttcacattcatgttcagtcacattcaccaatgtggctgtctttcttgttccgccttttgcagcatgttagtgaatctgcatcaactgggcctgtgttttgagctacttgtctagtggtagtactcaagagatatggagcccttcacagcccatctttcagtgcttaagttggggttgggggtacagactcagtctggggaggcaaggcttytacctaaattaaaggtgaaagtggggaggccaggcatggtgtctcatgcctgtaatcccagcactttgggaggcagatgtgggcggatcacttgaggtcaggaattggtgaccagcctggccaacatggtgaaaccctgtctctactaaaaatacagaaattagttgggcgtggtggcgcacatctataatcccagctacttgggaggctggggcaggagaatcgcttgaacccgggaggcagaggttgcgatgagcagagatccactactgcatccactctcgtgacatgagactccat

SEQ ID NO: 121073 - DNA, 601 bp, Human
cacctcagcctcccaaagtgctgggattacaggcgtgagccaccgcgcccgacctacttatatatttttttgagatggagtctcgctgtcgcctgggctgaaatgcagtggcacgatcttggctcactgcaacctccgcctcccaggttcaagtgattctcctgcctcagcctcctgagtagctgggattataggtgcccgccacctaatttatttttttatttttattttttttgcgatagagtcttgctctgtcacccagtgcagtggcgcagtcttggctcactgcaacctctgcctrctggattcaagcgattctcctgtctcagcctcccaagtagctgggattagaggcacccaccaccacactcagctaatttttgtattttttagtagagatggtatttcaccatgttagccaggctggtctcgaactcttgacctcaggtgatccgcctgcctcgacctcccaaagtgctgggattacaggcgtgagccaccacacctggctctttgtgttttttaaaaaactgaattggtctgttgagaatgtgattctctctctttttttttttttttttgagatggagttgttgcccag

SEQ ID NO: 121074 - DNA, 601 bp, Human
ttcaagtgattctcatgcctcagcctcccgagtagctgggattacaggcatgcaccaccatgcctggctagttttgtatttttagtagagacagggtttctccatgttggtcaggctggtctcatactcccgatctcaggtgatctgcctgcctcggcttcccaaagtgttgggattacaggcatgagccactgcgcccagctgagaatgtgattcttagcattcattataagttccccagagagcagaggatttcatttgtggtaaaacacatacgcgtgcacacacacacacacacacmccccccacacatttagttcttagaaatgtacagatttaaactgatagtttgttctgctgaacctaactcacaatttctacatataggaaattaatgttttaaatgaagatagaagcagttttctcctgaaagtatttatgtggttttgttaaaacttcacatccttttatgaacttggcattccactaacaacactcagctgcttttacaactgtgtcagcaaggttccatctgcttatattgaggttgatgaaaagaagtaaagctgttgttgtttgtattatgtggcattctttttag

SEQ ID NO: 121075 - DNA, 601 bp, Human
caagtgattctcatgcctcagcctcccgagtagctgggattacaggcatgcaccaccatgcctggctagttttgtatttttagtagagacagggtttctccatgttggtcaggctggtctcatactcccgatctcaggtgatctgcctgcctcggcttcccaaagtgttgggattacaggcatgagccactgcgcccagctgagaatgtgattcttagcattcattataagttccccagagagcagaggatttcatttgtggtaaaacacatacgcgtgcacacacacacacacacacacmccccacacatttagttcttagaaatgtacagatttaaactgatagtttgttctgctgaacctaactcacaatttctacatataggaaattaatgttttaaatgaagatagaagcagttttctcctgaaagtatttatgtggttttgttaaaacttcacatccttttatgaacttggcattccactaacaacactcagctgcttttacaactgtgtcagcaaggttccatctgcttatattgaggttgatgaaaagaagtaaagctgttgttgtttgtattatgtggcattctttttagat

SEQ ID NO: 121076 - DNA, 601 bp, Human
attcttagcattcattataagttccccagagagcagaggatttcatttgtggtaaaacacatacgcgtgcacacacacacacacacacaccccccacacatttagttcttagaaatgtacagatttaaactgatagtttgttctgctgaacctaactcacaatttctacatataggaaattaatgttttaaatgaagatagaagcagttttctcctgaaagtatttatgtggttttgttaaaacttcacatccttttatgaacttggcattccactaacaacactcagctgcttttacaaytgtgtcagcaaggttccatctgcttatattgaggttgatgaaaagaagtaaagctgttgttgtttgtattatgtggcattctttttagatcactggaactttttttcctttggtctctgtaagaaatggttgtgcttctcatcttcctttagtcttctgtacattgtgtggttgatcatgttccttgttaccataaactgttgagaggctcagtgcccaatttgtggcctacctctaggaattatccagggcttctctttatcagcttttttatgtaccatcctgcttcttgactttatt

SEQ ID NO: 121077 - DNA, 601 bp, Human
catatttctctcagaaagactattctgttagcagcacaggagagattaggtgctggggcatggaggagagttgtgactacaaaccagagatcattggaataactggactaagggatgtcgaaggcctgaatttaagcaataatagcagtgggatggaaaggaggcaccattcataagagagtggattgaggaaaaagaattgataggagttgtggctgatgttaggtactacagccccagggttttcttttattgcctttcaggctttttgagtttctcagctttcatcaccctctctgcmcttacctaggcatgttaatttctctagactctacttttaactcacagaagttagcccttttcttagtctgttttctgctgctacaacagagtactttggactgggcaatttataaagaaaagaaatttatttctcatggttctagaggctggaaagtccaggagcatggtgtcagcatctgatgagggccttcttgctgcatcatcccatggcagaaggcatcaaatggggaagaagtgcatgcctctgagagggaatgggagccgaacttatccttttatcaggagcctattgttttat

SEQ ID NO: 121078 - DNA, 601 bp, Human
tgttaggtactacagccccagggttttcttttattgcctttcaggctttttgagtttctcagctttcatcaccctctctgcccttacctaggcatgttaatttctctagactctacttttaactcacagaagttagcccttttcttagtctgttttctgctgctacaacagagtactttggactgggcaatttataaagaaaagaaatttatttctcatggttctagaggctggaaagtccaggagcatggtgtcagcatctgatgagggccttcttgctgcatcatcccatggcagaagrcatcaaatggggaagaagtgcatgcctctgagagggaatgggagccgaacttatccttttatcaggagcctattgttttatctagaacccacttctgtgataagagcattaactcattcatgagggcagagcctttgtgacctaattacctcttaaaggctccatctcccataacatttcattgccaattaaatttcaacatgagttttggaggggacattcaaaccttagcattctgcccctacccacctccccctccaaaacaactcgtgtccttctcacatgcaaaatatattcatt

SEQ ID NO: 121079 - DNA, 601 bp, Human
ctccatctcccataacatttcattgccaattaaatttcaacatgagttttggaggggacattcaaaccttagcattctgcccctacccacctccccctccaaaacaactcgtgtccttctcacatgcaaaatatattcattctatcctattagcccccaaagtcttaacttagcatcaactcaaaagtccaagctaaatcagacatgggtgagacttataaagtacaattcatcctgagacaaattcccttcagctgtgagcctgtgaaatcaaagcaagtcatctacttccaaaatgctrtggtaggaaggtgtatgatggacattcccattccaaaggaagaaataggcaagaagaaaggggcaggtggtcaccgataagtccaaaatccaacaggggagacattaagtcttaaagatggggaataatctctgtggactccatattctgcctcctgggcacactgggatgggagttgggcttccagggcctcagaagccccaccctctgtggctttgctgggttcaatccactcagcagctctcatgggttggagttgtatactggtggatttacagttctggggtgttgacagtggcc

SEQ ID NO: 121080 - DNA, 601 bp, Human
caataggttgtttgaccacacacttaatattccctctggaacatgcttttccactctttacatggccatgccgagaattttccaaattcttctgttttgcttctcttttaactatatggttatccctcagtatctgctgacagtaaggggtgtgggaagggattggttccaggaccactccctcataccaaaatccatgcttactcaagccccacggtcggccctgtggaacccatgggtatgaaaagtcagtcctccatgtgcaagggttttgcatcctgcaaatactgtatgcatttgsttgcgaatgtggaacccagtgatatggaggcccgactgtatttattgaaaaaatccttggcccatgttgtggctcacacctgtaatcccaacactttgggaagctgaggtgggcagatcacttgaggccaggagaccagcgtgggcaacattgcaaaacctcatctcgacaaaaattagccgggtgtggtggcatgtgcctataatcccagctacttgggagctgaggtgagaggatcactttagcctgagaggttgaggcagcagtgaggcatgatcacaccattgcactccagcctgg

SEQ ID NO: 121081 - DNA, 601 bp, Human
agtaaggggtgtgggaagggattggttccaggaccactccctcataccaaaatccatgcttactcaagccccacggtcggccctgtggaacccatgggtatgaaaagtcagtcctccatgtgcaagggttttgcatcctgcaaatactgtatgcatttgcttgcgaatgtggaacccagtgatatggaggcccgactgtatttattgaaaaaatccttggcccatgttgtggctcacacctgtaatcccaacactttgggaagctgaggtgggcagatcacttgaggccaggagaccagcrtgggcaacattgcaaaacctcatctcgacaaaaattagccgggtgtggtggcatgtgcctataatcccagctacttgggagctgaggtgagaggatcactttagcctgagaggttgaggcagcagtgaggcatgatcacaccattgcactccagcctggatgacagagtgagaccctgtttcaaaagaaaagaaaaaaatgtttgtataaagtgtgccctcagagttcaaacccgtatcttcaatggtcaactgtatttgattgtctctttgctctcacattgcattttatgcaattaaa

SEQ ID NO: 121082 - DNA, 601 bp, Human
catggcctgatctcagctcactgcaacctccacctcccaggttcaagcaattctcttgcctcagcctcccaagtagctgggactataggcatgtgccaccaagcccagctaatttttgtatttttagaagagacagggtttcaccatggtggccaggctggtcttgaactcatgacctcagatgatccgcccacctcggcctcccaaagtgttgggattacaggcgtgagccacaccatgcctggcccactgagtaatttctaagaagattcagaccttccctacagctcccctcttcttytgagtcctcatcagaattgcccttgatgcatcattcatggcaatctagggtgttactagccgcttcctccaaattcttcagcctctacccattacttggttccaaagctatgaccgcatttttaggtatttgttatggaaacagccccactccttggtatccattttttgtcttagtctgttttgtgctgctataacagaacacctcaggttgggtaatttataaagaaaataaatttatttctcacagttctggaggcagggaagagtaagacgatggttctcacatttgttgggagcc

SEQ ID NO: 121083 - DNA, 601 bp, Human
agaggggcaaagtgagcaaatatatgtaaagtgcttaaaagagtgcttgccttatataagtgctgtatgagtgtttgtcattattttgtgactagtgtacaggtcctgaagttttttgggtgggggtgactatttgaagtgttcacttcaaaaatagctctaaaagtatttagccaggcagaataaaagtcagtttcagttatggaatgttttctctatcttttcagtgcttgcttttgccatgacttcctctcagggttgaataactgaagttctttgacatcataggcctgttttagtraagtacgtcatcctcccaagtgatttggttagtatttttctccttgaaaacccatctggtcactttttcagttgcgatttttctttaaagctctggaataaatccatttggcaaggtgtggagtgcgagggatgcctggttcctatgttcagctttagactccttatgttacacaggcacatgctctgcggaggacgtgcctgttgagcgtgctaaaggtgattgaatgtggaaaggtcgaaaaaggcattctgatgacagatgactcatcatcttggtccatatggctgtagagaggca

SEQ ID NO: 121084 - DNA, 601 bp, Human
tttctaaacttgcctgcttacttgtgccttgaaatagtaatctagaagttccccaaatcggttctaatttatctttgtgtaccaagatgtagtagaattatctgccatatgattttaggggtaactatcaaaatattttaaactggtatttcaaagtttggttttgtagaaaacaaccttaaattttggaattgtaaatgaaatgtaatttaatccttttcattggtaataatgataacctttagcacgagagtcatcattttgtccatagttgtatttagaacctggtttgtttgtttcrttctgtgcaatgttgaacactaacaagtgctttctgaaggtaattctgtttttagcataagtcagagttgtttgaatgtgtgcagtgtttgtgtctattttccctgagagctaaatgatttcagacttgagatgttcctggctacgcactcacttagagcccttggtgtaggtgtatgttcagaaactaaactatagatgctggagccagagtattttgccttgattttgcgaatgtgttttaccatacgaggctagtacataacaactctgaccttatcctctccacatttttccttct

SEQ ID NO: 121085 - DNA, 601 bp, Human
ctgattcagacctctgaggagtgtcacatcccactgggcgacatatgtctatagaaaaaagccaacagtatcttctgaatcacatcttttaggaaatgccaagggtaattttttttcttctgttgcccttgtgagtctagggtatctttcaagaataaagtgtataatagatttgtttagaaggttactgaagaattctgctttcataattaaaaaaacagctttttcttcctgtgtgtatgtgtttatgtgtaggagggcagtagtttatcttagtcatttatctttaaatatttagccstgaaaaatcatagccacataacccttctatctcaggttgttactaaggcagtgatgtatattctggtatcttgaatggaaagtttaaagcaattgtggtgatttctaaagaatgaagaatagttgtaaaatttgtggagctctactagggtgctgtggccatctatgcctgccaaatgtggattgcacaattaaaatgtttggttcctcactgggattgttcttcttgacataaccatgatttgcccctctcattgtagctctgttcattcagtaagcattattatatctaatgggtcct

SEQ ID NO: 121086 - DNA, 601 bp, Human
ctagggtgctgtggccatctatgcctgccaaatgtggattgcacaattaaaatgtttggttcctcactgggattgttcttcttgacataaccatgatttgcccctctcattgtagctctgttcattcagtaagcattattatatctaatgggtcctgaatatttctaaagtgaataaagtgcaagtatgactaactttgcactaggctggtgacagtgaagaagaatgtgtggaaaagaaggattagaggtagactaagcttgtcagggagctcctgacataggagggttcagagacatayattcagccacacatggtacaggtgaggtgttccaagaggtaagtggaatgatttttgcaagtaaggagtggcatttttggtcaaaatgattgcatgaaaaaagatgggtgtgtgtttagattagtcttagcgctacatttttggaaactctatccatgccccaagacaatgtaaatatgcctgacagtttttttttttcatcatccaaaattctgatttgaggagacagttgggtgtggtagcttatgcttgtaatcccagcagtttgggagacagaggcaggaggatcacttgagccca

SEQ ID NO: 121087 - DNA, 601 bp, Human
agactttgtatctagctgctgattgcactgaagctattgcaactcctttgttaatgctcccaggtgatcgcatgcatttcttctggtgctaagcattcataattttcgataagtatttattgatcagcagctgtgtgccagacaccacagtagagcaacaaagagactaggtggggcctggctctcctgatactcagaatccagtggtgttttcagctgggttttgtttttttttttttgagacggagtctcgctctgtcccaggctgagtgcaatggcgcgatcttggctcactgcaacytccacctcttgggttcaagcgattctcctgcctcagcctcccaagtagctgggactacaggcagtgccaccacgcccagctaatttttgtatgtttagtagagacggggtttcgccatgttggccaggatagtctccatctcttgacctcgtgatctgcccacctcggcctcccaaagtgctgggattacaggtgtgagccaccaggcccagccagttttcagcttttttgctaccctaggcagtgagggttatctttaatttctttaatttaaatcaaaaccctgataactcacttttt

SEQ ID NO: 121088 - DNA, 601 bp, Human
tgcaggccccagaaagcacaggttatatccattttgttcatggctatattgccagtacctataacagtgcttggcatatagtaaagacttgtacatccagttgcagacaggtcatgcctgcaatctgtagctgagcctttagaaggtatacttgaattctgttacttttctggggataaaaatatgggcctatggtgaaatcatttacaaatttctttagtcttaattgagatacagtgggaccggttttcccctaatttgtgtatggggacttatattcaaagaacaagcaagcaggccrgacgcggtggcttgtgcctataatcccagcactttgagaggccaaagaggagaatcacttgagtccagcctggttaacaaagccagaccccatctgcgtgtgcgtgtgtgcacgtgcgtgcgcacacacacaaacacacacacacaaaaccaatgtccaggtgtggcgatgtttgcttgtagtccagctacttgggtggggggtggctgaggcaagaggaacccttaagcccaggagttagagattgcagtgagctatgatcgcatcactgccctccttcctgggtgacagcgagaccct

SEQ ID NO: 121089 - DNA, 601 bp, Human
tttatgaattaggtattactattttcataggcacagagaggttaagcaaccagggtcacaagtaagtggcttagctggacctcaaacataggcagcttgcctctggatctatattcctgtgaatcaacttttccttagtcatgtgtttcaggtcatgtgcaaagatgctcattgcagtatgactggaaacaacttggatgtccaccattaggggattggttaaattatgctctatctaaaccatgctgtactctgcagttattaaagagaatgattcccagcactttgggaagctgaggcracaggattgtttgaggccaggagttcaagaccagcctagggcacaaaccaagaccctgtctctgcagaagagaatgagacagtaatatgtaatatgaagaaaaaaatctccaaagagaaaaagcaagatgcagaacatttgttgtgtgtatgtggggagaaaatctggtctgtgcgtgtagcactggatcaggcggttcctgaagccatacaagatttagatttctcaagtcgttttgtaagctgcctgtcagagacatcaggatcaggcatttctccctgtctgagaatttgcttctca

SEQ ID NO: 121090 - DNA, 601 bp, Human
atattttcattcggcacttactgtgtgcaaagcacgcttacagcactaaggttatagcagtaaacaagaacttaaaatgttctactctaatttagtttacttctggtaggaatagaaacacttaaaaaataaggtaaatcatatatggcaaatggtgatgaatattctgaaggaaaacaaaaagaaaataaagggtgaataggagtgttggcgtgtggtagaggtgcagtttaacaggacagttagaaaagtcttaacaaggcaccactggagccaagatttggaagagctgaggatacamatgggtatctggagcaaaagcagagggaatatgaactgtgaatgtccagggtgggcacctgcttgagagctgcaaggatgccggtatggctggcacggagacgtggacagagaaatgaggtgagagaggtggcaggacaggggcccagatgggtaggcctttgcaagcctgtacaattttggcttttcctctgcatgtaatatatctggcacataagggatgctctacaaatggtaactgtgttataaggatgccaccatgatgccctgctttttaggtaggtagaagaaagatagacag

SEQ ID NO: 121091 - DNA, 601 bp, Human
agccactgtgctcagcctaggatccacccatgctcacccacccaactttttattttattttattttattttgagacaggatcttggtctgtcacctaggctgtagtgcagtggcacagtcacagctcactgcagcctcaacctgctgggcttatgcaatccttctacctcagcctcccaagtagctgggactacagacgggcactaccacgcccacctaatttttgtactttttgtagagatgaggtctcactatgttgcccaggctggaggattctttttaacaattactttttatatgsctgatacagcagcatcgttgcatagaaagagagagcactttagcagaaatctaaggaccagatgtcatatgcattgtgctgttggctttcactgaatccaagcttaattaaactgaggctaataacttctctatccacctcatagggttaatgagaagagtaagaggtaagtaaatttatagaaatgctttgtgaacagtttagtatatgtgaagcataaaggctatgtttgctgagttgcagacttggaagccatgtagtccagctccttccaaggcacagttgtcttgtctttgtgaa

SEQ ID NO: 121092 - DNA, 601 bp, Human
acccacccaactttttattttattttattttattttgagacaggatcttggtctgtcacctaggctgtagtgcagtggcacagtcacagctcactgcagcctcaacctgctgggcttatgcaatccttctacctcagcctcccaagtagctgggactacagacgggcactaccacgcccacctaatttttgtactttttgtagagatgaggtctcactatgttgcccaggctggaggattctttttaacaattactttttatatgcctgatacagcagcatcgttgcatagaaagagagarcactttagcagaaatctaaggaccagatgtcatatgcattgtgctgttggctttcactgaatccaagcttaattaaactgaggctaataacttctctatccacctcatagggttaatgagaagagtaagaggtaagtaaatttatagaaatgctttgtgaacagtttagtatatgtgaagcataaaggctatgtttgctgagttgcagacttggaagccatgtagtccagctccttccaaggcacagttgtcttgtctttgtgaatgcttctagaaaagggcactcactacagaaaatac

SEQ ID NO: 121093 - DNA, 601 bp, Human
cttgtattatcaacagcttaagagtgagtctttgtgttgaatttatccatctgtaacccaaatgaaacctcaccgtgataaggtattgaaccagatcaggaaagtagattaaggagctttactattaaagagtcaggtaggtgatgaaaggggcaaactgaaaaccagtggaaggaggcttatggaagtagtggctgtgttgtgcccaggttctgtgctgtgctggggttgagctccctgtgactcatgactacctgtgctgagctgtaactgccacagagagcaccagggactccccaakctcttagaaaaaacccagaaaaggaattaaatgtgggtggatgagggcctttctttcctgctgctgcgtttttattgaattgggaaatgagctgagctcctaggtgagctctaccaagagcagcagcaaccgtttattaatcagcacactctccatgtgcccagcactttgcatcttatacatttgacagggattgtcacttttaatcctcaaactgccctgtgcagtaggcattaccctttgtcatgggctgagttgtgggtgtgtcctctgaccccgaattcctgtgttgaagcccta

SEQ ID NO: 121094 - DNA, 601 bp, Human
ctcaccgtgataaggtattgaaccagatcaggaaagtagattaaggagctttactattaaagagtcaggtaggtgatgaaaggggcaaactgaaaaccagtggaaggaggcttatggaagtagtggctgtgttgtgcccaggttctgtgctgtgctggggttgagctccctgtgactcatgactacctgtgctgagctgtaactgccacagagagcaccagggactccccaagctcttagaaaaaacccagaaaaggaattaaatgtgggtggatgagggcctttctttcctgctgctgcrtttttattgaattgggaaatgagctgagctcctaggtgagctctaccaagagcagcagcaaccgtttattaatcagcacactctccatgtgcccagcactttgcatcttatacatttgacagggattgtcacttttaatcctcaaactgccctgtgcagtaggcattaccctttgtcatgggctgagttgtgggtgtgtcctctgaccccgaattcctgtgttgaagccctaactgcccccccagtacctcagattgtgactatatttagagagaaggtctgtaaagaggtgattaactt

SEQ ID NO: 121095 - DNA, 601 bp, Human
ttcccagctcacttctgatgaagtgagatagaggcgacttgttcttcaaagtggtttgttacctagttagaagtagagttaagcctgacagaaaaatggggcagataagtgtttagtgtcatacttgcactgttgctgtcactgagaagtttggtggttcgtcatgaatcggggtaaatattagaaatacccaagtcctgctctcactcctagatgttctactctaggaaagtctgggacaggatctgagcatccatcatcattgattttttttcttttcttttcttttctttctttcttctttttttttgtttgaggcggagtcttgctctgtcaccaggctggagtgcagtggcacgatctctactcactgcaatctccgcctcccgggtttcattgattctcctgccttagcctcctgattagctgggattacaggcgcctgccaccatgcccggctaatttttatatttttagtagagatggggtttcaccaagttggccaggatggtcttgatctcttgatctcaggtcattcacccgcctcggcctcccaaagtgctgggattacaggcgtgagccaccatgtccgaccctgatt

SEQ ID NO: 121096 - DNA, 601 bp, Human
cacttctgatgaagtgagatagaggcgacttgttcttcaaagtggtttgttacctagttagaagtagagttaagcctgacagaaaaatggggcagataagtgtttagtgtcatacttgcactgttgctgtcactgagaagtttggtggttcgtcatgaatcggggtaaatattagaaatacccaagtcctgctctcactcctagatgttctactctaggaaagtctgggacaggatctgagcatccatcatcattgattttttttcttttcttttcttttctttctttcttttttttttttgtttgaggcggagtcttgctctgtcaccaggctggagtgcagtggcacgatctctactcactgcaatctccgcctcccgggtttcattgattctcctgccttagcctcctgattagctgggattacaggcgcctgccaccatgcccggctaatttttatatttttagtagagatggggtttcaccaagttggccaggatggtcttgatctcttgatctcaggtcattcacccgcctcggcctcccaaagtgctgggattacaggcgtgagccaccatgtccgaccctgattttttctttt

SEQ ID NO: 121097 - DNA, 601 bp, Human
agttgttccttctaaaccagctttaggtacctgttgcttgtagtctaaatcactggaattaattatcatctgtggtctttagcaggtctgaatgtgagagtccagtaggtagcaggtgctatccaacatgtttttgaaatttttcttgctgagttcagcctattttgtacactttgcattttactcctccagagggctctagagctcagctgagcagactggcttgttaccctcattagacaaagaaactagccaataagatttgagcttttatttgttggaggaactaatgttatgttaycttttagagcttcctgttcttttcttttctagtgcttcccccgctcccagctctcaacctctatccgatataaagactgttttcttgtcaaggtcacagttagtgatgctagaacacaaggcagagactgtggctaagctttcaggtcttagaagagggatctctaaaattctttgtttacatttatcagtgagaaggttgaatttacatcttcaatatatggataattatgtataaattatttatttacccatgcagtttcactaatgtgattgcagtgcttttttttttttagacagt

SEQ ID NO: 121098 - DNA, 601 bp, Human
tagcaggtctgaatgtgagagtccagtaggtagcaggtgctatccaacatgtttttgaaatttttcttgctgagttcagcctattttgtacactttgcattttactcctccagagggctctagagctcagctgagcagactggcttgttaccctcattagacaaagaaactagccaataagatttgagcttttatttgttggaggaactaatgttatgttatcttttagagcttcctgttcttttcttttctagtgcttcccccgctcccagctctcaacctctatccgatataaagactkttttcttgtcaaggtcacagttagtgatgctagaacacaaggcagagactgtggctaagctttcaggtcttagaagagggatctctaaaattctttgtttacatttatcagtgagaaggttgaatttacatcttcaatatatggataattatgtataaattatttatttacccatgcagtttcactaatgtgattgcagtgcttttttttttttagacagtcttactctgtcacccaggctggagtgcagtggtacaatctcagctcactgtaacctctgcctcccaggttcaagcaatt

SEQ ID NO: 121099 - DNA, 601 bp, Human
ctggagtgatttgtttaggaaaaagttaccactgtgtagccccaccagagccaaacctggagttacatttaaacaggtcaatctctgaagaaaagtgtaatttggggtcatatgacctaactcctgaggtcacccagagcttatacttaaatcagaaaaggaagagatgcccatgagcccaaattttaattttgttatttccacacatttagaaaagtaggaagaataagttttgcattatcccaatagatttaaaaactctagttccttttaaaatctttaaatagacttaaaacaattycaaattttttccagctttatcgcggtatacttgacaagtaagtgtatatatttaaggtgtacaatgtgatgctttgatacatacagtgtgaaatgattaccacagttaggtttaataattaacatatccatcatctcacataggtatgatttcttatgtgtgtggcgagaatcctgaaaatcaactctgagcacatttcaagtgtacaatacagtatttatgatagtcaccatgctgttaatcagattgcctaccttggttaaagtgcagactcaggtgaaggtctggatggaggatcat

SEQ ID NO: 121100 - DNA, 601 bp, Human
gttaccactgtgtagccccaccagagccaaacctggagttacatttaaacaggtcaatctctgaagaaaagtgtaatttggggtcatatgacctaactcctgaggtcacccagagcttatacttaaatcagaaaaggaagagatgcccatgagcccaaattttaattttgttatttccacacatttagaaaagtaggaagaataagttttgcattatcccaatagatttaaaaactctagttccttttaaaatctttaaatagacttaaaacaatttcaaattttttccagctttatcgcrgtatacttgacaagtaagtgtatatatttaaggtgtacaatgtgatgctttgatacatacagtgtgaaatgattaccacagttaggtttaataattaacatatccatcatctcacataggtatgatttcttatgtgtgtggcgagaatcctgaaaatcaactctgagcacatttcaagtgtacaatacagtatttatgatagtcaccatgctgttaatcagattgcctaccttggttaaagtgcagactcaggtgaaggtctggatggaggatcatactttaattgatttagactctaaa

SEQ ID NO: 121101 - DNA, 601 bp, Human
taggtttaataattaacatatccatcatctcacataggtatgatttcttatgtgtgtggcgagaatcctgaaaatcaactctgagcacatttcaagtgtacaatacagtatttatgatagtcaccatgctgttaatcagattgcctaccttggttaaagtgcagactcaggtgaaggtctggatggaggatcatactttaattgatttagactctaaaataaatgtatatagttatttttgctaacctaagaacctactcataaatggctagtgttaaaatgatgtaagataaaatgctttcccttcacttttttaacagaagtggaaatggaggtgatgtaacttgcctgaggtgacacaggtagttaagagcagagaaaggactagagccaggactggtttagtgatttttagtttagcgcattttaaatttttatcatatgattccttaatctttgagtcttccaaatgcagaagctaggttatagaatagcatattttattttaatattacatttatggaggtagatattcttggttaaagctcatttttaaaaaataatttcaacttttagattcagaggatacatgtgcaggttt

SEQ ID NO: 121102 - DNA, 601 bp, Human
tgcagaagctaggttatagaatagcatattttattttaatattacatttatggaggtagatattcttggttaaagctcatttttaaaaaataatttcaacttttagattcagaggatacatgtgcaggtttgtgacatggatttattatgtggtgctaaggtttgggatgcaaatgatcccatcacccagatagtgtaaagctccttttagaatggtatatgcagatttaattctgtcactgaaaatgtttcaagaactaattggaactgggcaatagcttgcatttcacttgttttgttytttgcatttaggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatgtaagaatatacaaagtgctttcacaacctgacaagaaaaagacaaacaatttccattgaaaagtggagaaaaggatatgagtagaccattcaaaaaagaacaaatctacatgacc

SEQ ID NO: 121103 - DNA, 601 bp, Human
agataagctttaggtttacataaaaattaaatggaaaatcccctccctcaccctagcttcttcattattagcattttgcattagtgtagtacatttgttacagttaataaactaatatagaaaagttattaactaaaattcatagtttgcattgacgttttcgttttttatagtctatggattttcacaaatgcacaatgacatgacatttttccatcattactgcattatacagaatagtttcatggtcttataatttatatttcctgtgctctacctattaattcctccctgattttcsccaaacttctgaaaactacagatctttttactgtccttataattttgccttctatagaatgtcatatcgttggaatcatatagtatatctacttatcagacttggctcctttcacttagtgatatgcactacacattctgtgttttttggaggcttggtagctcatttatttttgtaagtgaataatgttccattgtatggatgtaccacagtttattcgttttgaagaacatcttggttccatgtcttggcatttatgaataaagctgctccaaatattcacgtgcagagttttgtgca

SEQ ID NO: 121104 - DNA, 601 bp, Human
cttggctcctttcacttagtgatatgcactacacattctgtgttttttggaggcttggtagctcatttatttttgtaagtgaataatgttccattgtatggatgtaccacagtttattcgttttgaagaacatcttggttccatgtcttggcatttatgaataaagctgctccaaatattcacgtgcagagttttgtgcaaaatgtaagttttcaactattttgggtaaagaccaaggagtgtaattgctggattgtaagtgtatattttagctttgtgagtaactggcaaattgtcttcyaaactggttatttgattttgcatttccaccagcaataaatgtttctatttctccatatcatcaccagtatttagtgtagtaagtgttttagatttcagccgttctgctaggtgagcattatagttttttgacatggagaaatcttctgaaagtgtttttcttttttattttcttttctgagatggagtctcgctccatcacccaggctggagtgcagtggcgtgatctcagctcactgcaacgtccgcctcctgggttcaagtgatttttctgcctcagcctcctgagtagctgggatta

SEQ ID NO: 121105 - DNA, 601 bp, Human
gtcatgagggctgtatcctgggctggaactggatgagggaaaggaatcatagttgatgtgcagagtgggtagttaagtgactagggaaggctaaaggaataaaaagattacccttaaacagttcaaagtataacattgatacagttacctaaaattagacatgtgtaaaggtatatgtgtaaagatattttaacaaattttcttaaagaattattgtttttttgataaagactatttggtttatgataaagactatctgataaagacagattgagctgtctttatcatataatagtgaackccagttttgggtggtagatagtattacttgttattcaaatgtggaatacatgccttactaggttagtctttatggaaacattacacttggatatagatggagtcagtaattactatagaaaatttcttcgaggggctaagaatggcttcccaactcctgggtgccattgtgtcagtaaagtcccagtgagactttttcactaagcactccttttgaagtcttcttttaaaaatgtaaaagcaggccaggcttgttggcctgggaggtcaaggctgtagtgagctgtgattgtgccactgc

SEQ ID NO: 121106 - DNA, 601 bp, Human
aagagaaaagccttactgaggattcccatgcccttaccatctgcctaagtgatttcttcttaactcctgtgtcagtggtagccggattccctgggaaggagggacgctgttgctctagcatcattctgctttttggaaacagggttgtatttgctgatgctctgaaattctggaaatgactttctgagccttgtggctgtaagtaaaataaagaaggtggcaatagaggtaatatattctcccatccccatctctcttgtcatgttgggttaacaaccatagaatacacatgtgataattmcatggcttactcataaatcataagaataagtcatatacccaaggccctgagctgtaatggaattttagtgcatttcaaatttatagccagtttctgattatccagttgagttgcctgtgcctctcagttctgttctggcctaccttttgacaggtttatttcttgtgactatctcccctggtgagtaatagtcatggatgtgggaggcaaaattcaaaacgtgtccattttgcaattttaaggaggcatgattcctggggagattaaaacaaattgaaaatcaaggtgttttttttttaa

SEQ ID NO: 121107 - DNA, 601 bp, Human
cagtggtagccggattccctgggaaggagggacgctgttgctctagcatcattctgctttttggaaacagggttgtatttgctgatgctctgaaattctggaaatgactttctgagccttgtggctgtaagtaaaataaagaaggtggcaatagaggtaatatattctcccatccccatctctcttgtcatgttgggttaacaaccatagaatacacatgtgataattacatggcttactcataaatcataagaataagtcatatacccaaggccctgagctgtaatggaattttagtgcrtttcaaatttatagccagtttctgattatccagttgagttgcctgtgcctctcagttctgttctggcctaccttttgacaggtttatttcttgtgactatctcccctggtgagtaatagtcatggatgtgggaggcaaaattcaaaacgtgtccattttgcaattttaaggaggcatgattcctggggagattaaaacaaattgaaaatcaaggtgttttttttttaattataatttttcagttctcagaatgtttgtccctgattgtcatgggtaatttaataatttctattttaatac

SEQ ID NO: 121108 - DNA, 601 bp, Human
ttgaaagtaccatttatcaacagcactggaacatgtttgaaaagatctgaactgttaataaagatttaatgtcagctcccaggaaataaggttaacatactgttaagtgtgctatttctttttctactactcttaaaattaccactgtcaccaaggcctaattcatcatgtggtaggagttaaagatgaatacatggttttgcacagaaaagtttttaacctatgaaatggcccaactgttgtctatattaattggtttatttggtatttgtagggtattgatgacgtcactggtgaaccrttagtccagcaggaggatgataaacccgaagcagttgctgccaggctaagacagtacaaagacgtggcaaagccagtcattgaattatacaagtgagtgtgcttcaatattttcatgacaaaggacagactggaaaggtgtggagcctgctgggaggaacacggggctgaggcagagtagtgtttctttaagacagataaacactagcgatccaaaaccttcccagaagtcagatgaaatgctggagctgtacatgaaagataaggttcaatacttttatcctgaaactgttagaacata

SEQ ID NO: 121109 - DNA, 601 bp, Human
aggagtttaacaaaaaaaggctaaaaccgtaaaccagagattaaaaattcaaatggctgcaggggctagggcaggtattggaaatgagtctcaaacatggtgggggatgtgtcaagctagacagttgagtgacaggtcttgggctgttccggccagttatcattctagggcacgcaggccaatgattcccatttttcaggaatagcagaaatctggttttctgtgtgtatgtgtgtgagggggaatctcagttttcatattggcaacatatttaaattttttaaataacatgcaagtcaarcaaaactttatgctgagtgcattcaaaacagcagtttatactctgttacaatcactttctggccttgtagtcccccccaaaatttagcaaaccttaagatcagagttttatgatcatattattatgatacatcaattatgtattccatgattgactaagtaatataggttttagtaaagcttttcagtggttcgcttttgaaaattatatattggggcacatttggaatggcccctataatgctattctttgatatgttttaaagggggagaaaaaaggtggcatcatgacaagcatacc

SEQ ID NO: 121110 - DNA, 601 bp, Human
gtttcgccttctggccccgctgctggtaccccatgagagtaggaagcttcctagacccgggttcctgtactgcgaggtgggggctcttccctctggggctgtgccttctctccagggtaaggaccctttcttggtgtcacctcccccagggataaggttcttgccatccttggtattggtatggctgcttttctggatttgaggtgtccacgcctctgcatgtgtccccaccgtaaggctgaggacccctctcggatgcaggtgcccccggctaatgcttccaaaaccccctcttgatttktcactgtatggggtaaggcatagtttcctggctgtgtggatgtaagatacctgagtctcaagcgggagactccactgtagaccctgtccctgggaccagagacttctctggtgtagactttccaaggtgggagattccagccccccacccttggcatggggcatctcagtggagatgactacctctaccccaggccctaacgcatccttcttctggagtctcagagcctctgtgtggccacgtcagcagccacctgggttaaggatcacccttcaacatcacttctcagagctccttgct

SEQ ID NO: 121111 - DNA, 601 bp, Human
ttccctctggggctgtgccttctctccagggtaaggaccctttcttggtgtcacctcccccagggataaggttcttgccatccttggtattggtatggctgcttttctggatttgaggtgtccacgcctctgcatgtgtccccaccgtaaggctgaggacccctctcggatgcaggtgcccccggctaatgcttccaaaaccccctcttgatttgtcactgtatggggtaaggcatagtttcctggctgtgtggatgtaagatacctgagtctcaagcgggagactccactgtagaccctrtccctgggaccagagacttctctggtgtagactttccaaggtgggagattccagccccccacccttggcatggggcatctcagtggagatgactacctctaccccaggccctaacgcatccttcttctggagtctcagagcctctgtgtggccacgtcagcagccacctgggttaaggatcacccttcaacatcacttctcagagctccttgctgcagaggcggaagctctcccagatcaaaggtgcctcatgacaaagaccactctgtgggcacatgacggcccccaaggttaaggacc

SEQ ID NO: 121112 - DNA, 601 bp, Human
caggccctaacgcatccttcttctggagtctcagagcctctgtgtggccacgtcagcagccacctgggttaaggatcacccttcaacatcacttctcagagctccttgctgcagaggcggaagctctcccagatcaaaggtgcctcatgacaaagaccactctgtgggcacatgacggcccccaaggttaaggaccacccggtgttagtttcccagggctgacctcctgcccctccctcctcgagtctttgtgtggtggtatcatcttccctgagatgaagtctggggggctcttctttactggttttggctctgattttagcgtgttggctcctgtgaggctggtgtcctgctcacctccccccgccccgccacccgccttgtgggtcccttccctgtggggatgtgtgttcctcttgggtaagtctcctcctgggccgaggttcccagattcctcagtgctcttggagagcctttgctgctggagcacaggttcttcacgcctgagagtggacctgcgatcaccaccttccttggaggatcttggtggatgcccccctgactacagcaaatggggctctttcttctctggcggcgtctc

SEQ ID NO: 121113 - DNA, 601 bp, Human
gggttaaggatcacccttcaacatcacttctcagagctccttgctgcagaggcggaagctctcccagatcaaaggtgcctcatgacaaagaccactctgtgggcacatgacggcccccaaggttaaggaccacccggtgttagtttcccagggctgacctcctgcccctccctcctcgagtctttgtgtggtggtatcatcttccctgagatgaagtctggggggctcttctttactggttttggctctgattttagcgtgttggctcctgtgaggctggtgtcctgctcacctccccccrccccgccacccgccttgtgggtcccttccctgtggggatgtgtgttcctcttgggtaagtctcctcctgggccgaggttcccagattcctcagtgctcttggagagcctttgctgctggagcacaggttcttcacgcctgagagtggacctgcgatcaccaccttccttggaggatcttggtggatgcccccctgactacagcaaatggggctctttcttctctggcggcgtctctgcttcgagactcaggctccagcttcccttctctctggtcctttgctggggggaccagaggtaca

SEQ ID NO: 121114 - DNA, 601 bp, Human
tgggtcccttccctgtggggatgtgtgttcctcttgggtaagtctcctcctgggccgaggttcccagattcctcagtgctcttggagagcctttgctgctggagcacaggttcttcacgcctgagagtggacctgcgatcaccaccttccttggaggatcttggtggatgcccccctgactacagcaaatggggctctttcttctctggcggcgtctctgcttcgagactcaggctccagcttcccttctctctggtcctttgctggggggaccagaggtacagataccctcatgatatarggattttcttagcggggaaggtgttgtctctactgtggctaaggctccagcctctctaggggacaagtaccctgggcctctggcacttgccccttctctgtggaggagctgcctcctcactgggtctcagctgtagccgacttcgatgtcacactgttctgtctgaaacatcacctccctgggttagcgctcttgttcccctccttctggcttgtgacccctccaggacttccttctcttgctgccacagtgtggtctcctgtctgtgggtattcttcctctgcactaggataccagtcc

SEQ ID NO: 121115 - DNA, 601 bp, Human
tggcggcgtctctgcttcgagactcaggctccagcttcccttctctctggtcctttgctggggggaccagaggtacagataccctcatgatataaggattttcttagcggggaaggtgttgtctctactgtggctaaggctccagcctctctaggggacaagtaccctgggcctctggcacttgccccttctctgtggaggagctgcctcctcactgggtctcagctgtagccgacttcgatgtcacactgttctgtctgaaacatcacctccctgggttagcgctcttgttcccctcctyctggcttgtgacccctccaggacttccttctcttgctgccacagtgtggtctcctgtctgtgggtattcttcctctgcactaggataccagtcctttccgtgtggagacacagggagggcgtcacctgcctaaggtgttgattgccttgtttaggggtgtagaccatgagacctcttctctctctgggctggagcacctgcccatgaccctctgttgggttcttgggatggaaagagggagtgtaaactctcgtttcacattcttgttccccctatgcagtaagaggcttttctgtgttg

SEQ ID NO: 121116 - DNA, 601 bp, Human
gctggggggaccagaggtacagataccctcatgatataaggattttcttagcggggaaggtgttgtctctactgtggctaaggctccagcctctctaggggacaagtaccctgggcctctggcacttgccccttctctgtggaggagctgcctcctcactgggtctcagctgtagccgacttcgatgtcacactgttctgtctgaaacatcacctccctgggttagcgctcttgttcccctccttctggcttgtgacccctccaggacttccttctcttgctgccacagtgtggtctcctstctgtgggtattcttcctctgcactaggataccagtcctttccgtgtggagacacagggagggcgtcacctgcctaaggtgttgattgccttgtttaggggtgtagaccatgagacctcttctctctctgggctggagcacctgcccatgaccctctgttgggttcttgggatggaaagagggagtgtaaactctcgtttcacattcttgttccccctatgcagtaagaggcttttctgtgttggggtgttggactttggtgaggatccctgcacacctgagctctggtgtccaggccct

SEQ ID NO: 121117 - DNA, 601 bp, Human
ataccagtcctttccgtgtggagacacagggagggcgtcacctgcctaaggtgttgattgccttgtttaggggtgtagaccatgagacctcttctctctctgggctggagcacctgcccatgaccctctgttgggttcttgggatggaaagagggagtgtaaactctcgtttcacattcttgttccccctatgcagtaagaggcttttctgtgttggggtgttggactttggtgaggatccctgcacacctgagctctggtgtccaggcccttgccttgtgtgagctccctgggtcaaagrggctttcccctcctcagcctgaatccccactgtggcaccttctcctgggtccttttgttggttgctttgccttcttagagattccccaggtagggcgtgatagctgacctgggcgggggctgctgcggctttctttaggttgggccttttactgaggagatttaaattccctcaagtgtaaggtagcacccctacctattatcacccagaatgggtccctgcggtgttgggaaaattctccctgggggtaaggtaccagccctgtcctttatgggcttcttgttctaaagcatatccgtc

SEQ ID NO: 121118 - DNA, 601 bp, Human
ttgccttgtgtgagctccctgggtcaaagaggctttcccctcctcagcctgaatccccactgtggcaccttctcctgggtccttttgttggttgctttgccttcttagagattccccaggtagggcgtgatagctgacctgggcgggggctgctgcggctttctttaggttgggccttttactgaggagatttaaattccctcaagtgtaaggtagcacccctacctattatcacccagaatgggtccctgcggtgttgggaaaattctccctgggggtaaggtaccagccctgtcctttrtgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtga

SEQ ID NO: 121119 - DNA, 601 bp, Human
aaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttacacacacacacacacacacacacacacacacacacacgcccttctctgtgagctgccagtttcatttgtctcctgacttgtctgagggatgacctctcctagccacctctgcccagcccctctgagtaggaagtgtgatytccagggctaatgcctccatcccagtcatcagctgtgtgcagcatgactgtcctgctctgaaaaacctttttgagtgtattctggggagaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgc

SEQ ID NO: 121120 - DNA, 601 bp, Human
tcagtgtttggttgaaaaaaaaaattcaggtataagtgaacctacacagttcaaacccatgctgttcaaaggtcaactgtatatgcaatatagcaggggctcaataatgtaattccctgtcttcctacttggagcatttcagtgagaataagaagggagttgggcaaatgtggacctcatcctcctttaagccatactctacttttctaattcaatctgtctttagaccattccccactgctgacccatcaccaccttctcattgttttcccaggtctcctagagccacagaaacaatatyacaatagctaccatttattgagcacctactaaatgtctagcattctacaagatgctttcaaagcattccatcttgcaccaacagatgcttgatattcatttccttcctcctccagattggaaagagatagccatgggtgtgtccactgacaaaacaggaacacctgcagaataacatcagtggcctctctctttgtacattgttttacagtttacaaagttcttttcacccacattatcctatttgattctcacaacaattcttgggaatggatgaagaaattgaggcaggagcaccaat

SEQ ID NO: 121121 - DNA, 601 bp, Human
ccatctgggaagtcgtccctgtcccaggctgggggaaagaaatgactcctcaaagggtggctgtgaaaaacaaccctttcagtctgataggcggcagaaataagcacctaaggaagaagccaacttcagccaggaaagagcggggaggaggaggagagagccctaaaatccagcgagaagagatcagctcaataaatggagtgaagaagtgaatgaaggaacttaccttttgttgcaaagaacatgagactgagtccaagagacctggcatttgaaagataagccctggctctttcagtgrtcctgtaaacttaggcaaatcacacccctggcctcagtttccttatctataaaaggagctcataaaatggcttcctggcaaaactgttgcaagaattaaaacctgtatatgggagggtgttttattaaccccttattttgtttgtttgtttgtctctgtgcttcatggtttcttctagcaagtcatcctgtgtagtggaaatagtttggagctccaaatcaaacaaactagattcagtttccaggtctatcatttattacctatgagaccttggcaagaaatgttacatgattaagacag

SEQ ID NO: 121122 - DNA, 601 bp, Human
ctgttacctaatggcttccaggtttgacgggattaaggaaaacgaaaaccacaacaattttagggtgaataaagaagcatcctggctgggcatggtggctcatgcctgtaatcccaacactttgggatgccaaaatgggaaaatcacttgaggccaggagttcaaaaccagcctgggaaacatagtgagattccatttctacgaatttttttttttttttttttttgaggcagagtctcactctgtcgcccaggctggagggcagtggcgcgatctcagctcactgcaagctccgcctccmgggttcacgccattctcctgcctcagcctcccgagtagctgggactacagacacccgccaccatacccggctaattttttgtatttttactagagatggggtttcaccgtgttagccaggatggtctcggtctcctgaccttgtgatccgcctgcctcggcctcccaaagtgctgggattacaggcgtgagccaccgcgcccagccaaaaaaagtttaaattagtcggatgtggtggtgtgcacctgtagtcctcggtacttgggaggctgaggctggaaaatcacttgagtccagaggt

SEQ ID NO: 121123 - DNA, 601 bp, Human
aaatgtcagattactggttttcacttttctgatgtagcccagcttcacactcttaaactgctagaattagaggggactttggagtagcagctttttattgtaacaaaaagcctggctactgggcccagctttcccagtaactcagtgtgtaaacttggcctagttacttaaattctatgcctcagtgtcctcatctgacaataatacttacttcacgaggtgctgtgaattttaaataagagaacgtatataagtatgtttcatacactgtgctgagaaaaatacatgtagcctcgtgtakaatcagtgagaaatttgcctgcctttattagctgtgactgccacagataggagactaggaagtgatggcaagagtaaaaaattgtttcagttcctgatctacctccgtttatcttacaggtaaaaaaaaaaaaaaaaaattgaggctctgcaaagacaagtgatttgtccaagctcacacagcaagtcagttggagggtcatgaatggaacttctgttacctaatggcttccaggtttgacgggattaaggaaaacgaaaaccacaacaattttagggtgaataaagaagcatcctggct

SEQ ID NO: 121124 - DNA, 601 bp, Human
caggagatagagaccagcctggccaacatgatgaaactccatccctattaaaatacaaaaaattagccaggcatggtggcagatacctgtaatcccagctactcgggaggctgaggttgcagtgagctgagattgcaccactgcattccagcttgggtgatagagccagacttggtctcaaaaaaaaaaaccatcatatttttactgtaccttttctatgtttagatgtgtttagctacacaaatacttaccactgtgttacaattgcctgctacattcaatacagtaacatgctgtacargtttgcagcctaggagcaataggctatctattccatatagactatgtgtatagtaagctataccatataccatataggtttgtgtaagtatactctatgatgttcatacaactatgaaatcggctaatgacacatccctcagaacatatccttgtcattagcaatgcaagactgtacttaaatactacaaaaatttagtagtaccaaaagtactacaaaaatatgagattttgaggccaggtgccgtggctcaggcccataatcccaggactttgtgaggccgaggcagggcggatcatt

SEQ ID NO: 121125 - DNA, 601 bp, Human
aaggtgggaggatcgctcaagccaaggagtttgaggctgcagtgacccatgattgcaccactgcattccaatccaggtgacacactgagccttcatctcaaaaaaggccatacggtgtatttgtgctttaagttaagtgttgttataaaagagtctatggctgggcatggtggctcagacctgtaaccccagactttgggaggccgaggcaggcagatcacttaaggtcaggagttcaagaccagcctagccaacatggtgaaacctcatctctactaaaaatacaaaaattagccaggcrtggtggtgcgcacctgtaatcccagctactcaggaggctgaggcacaagaattgcttgaactcgggaggtggaggttgcagtgagcagagatccactgcactccagcctgggtgacagagcaagactcaatctcaaaaaaataataataataataataaataaaaaataaaagagtctaagaagttttaaaaattttttaagtttataaggtttaaaagttatagtaagccaaagttaatttattattggagaaacatatttttaaataaatttagtgtagcctaagtgtagagtgttta

SEQ ID NO: 121126 - DNA, 601 bp, Human
tagacctgtaggtgctgccccacgacccccaccaaagcccatgtaaggagctgagtccttaaagactgaagatggactatttcctggagaaaaataaaatggaaattgtactttaaaaaaaagccatctattttaatactatgttttatttgttaatttaaaaggtaatacatacttacggaaaataattcaagcatatcctatttgcaagtattaccttttttaccagctgtagctcaattattattatttttattttattttattttattttgagacagggtctctctctgtcgcccargctggagtgcaatggcactatcttggctcactacagtcttgatctcctgggctcaagcaatcctcttacctcagcctcccgagtagctgggactacaggcatgtgccaccatgctcagctaatttttgtactttttgtagagatggggtttcaccatgttgtccaggctggtcttaaaccgggatcaagtgatctgccctccgtggcctcccaaagtgctagaattacaggcgagagccaccacacccagctgcattattttcttaattcctagcataaaatacaagtaatatgaaacct

SEQ ID NO: 121127 - DNA, 601 bp, Human
tgttcccagctctcaatccttatctgagactgtaagttccatccctgtatcaatctgccccatgacaagactcactaggcaagtgtggaacatgcccaggacacttggagactgaggcatagcacttacatggaggaagaaagtgaggttggaagggagggtgccattggctgcttaaactgtctcacagccttaacttttcagcttttcatggtactaggtgcaaaggctgttgcaagaacttgccatgtaaaggcattatgctttttttttttttttttctgagatggagtcttgctcttttcgcccaggctggagtgcagtggtgcagccttggctcactgcaacctctgccccctgagttcaagcgattctcctgccttagcctcccaagtagctgggattacaggcatctgccaccatgcctagttaatttctgtatttttagtagagacggggttttgccatgttggccaggctggtctcgaactcctgacctcaggtgatccacctgcctcagcctcccaaagtgctaggattacaggcgtgagccaccacacctggccacattatgctttttctacataaaaacaagggaagc

SEQ ID NO: 121128 - DNA, 601 bp, Human
acagtcacttcatcactctggggctcaatctcctcatctggaaaatggggagaacaatttccaccctgctcttctcacagggctatcacaggactcaaatgagataacaatggatgaaaccattatcaactggtaaattccacacagatgtgaacatatgtccttattattccaaagccttcaaagcctaggtcctttatttgttcactcattcactcagcaaatatttaatacatgccaggcctttcctgagaccccagccttctcagttctgtcaccatctgctttcctagaacacccraatctgaactccataattcagcacttggtcacatggtcttatttaagtctttaattgcttctcctatgtcttggaagcctcaggtaccctgcttctccacctgaaatctccccttcttctcagcacaagggtacccagatggctggatgagtggtcagaggagggtgggaggacagcattcaagtgtgatggtgtctgggttttcattctttttaggaattcctgtttttttccccaagggcaaagaaagggcatgaggctggtgggtgtggctctttgggcctctcagatgagctgtaa

SEQ ID NO: 121129 - DNA, 601 bp, Human
cggtgctaacgaaggctggggtgaacgtgtcatcagcatagcggaagaggaaggaggtcttgccaacactgctgttgccaatgataagcagtttaaacatgtagtcaaaattctggtcagaggcatctttgactccagttttaccatctgtcactgaagccatctgcaagagagacctagagtcactcaggaacagaccttcggtgtcaccctgagtcaccatccttctaatggtcaccccaccattcacacactcactccttactccagcaccactgaggaaatgcacactactcagaatcaccccatcactacacctgccccaaatgttgtctcagcactgaggtggaacccagctcctcccattcattccttcagcaaatatttactgagcacattgatctggggcaagccctgtgctgggcatggggcttacaaacatgagtcagacatggtgcctgacctctaggtggacaaaaactagaataaaaggtgggtcaacacagagtaacaaagcagtagataagtgataagacagaggagtcctggctgaggaagtccatgagaagcatctcattcagcctggaggcccggtgatcaa

SEQ ID NO: 121130 - DNA, 601 bp, Human
gtccccagtgatactttcctcccaatatccacacttttgtgtagtttcctcccatgctgaatcagtgaccaacagaacgctgtaaggctaaggctaactcataagagacattgccacttcctctggccttttacatctctcactctgggaaaagccagctgctatgcaaataaagacacttcagcagctctgtgaagacactctaagaggccaaatgggaaagaagtaaggccttctgccaacagctagcaccagacatgtgagtgtgcagtcttaagatcctccagccccaggctaagcrcggtggctcacacctgtaatcccagcactttgggaggccgaggtgggcggatcacaaggtcaggagttcgagaccagcctggccaacatggtgaaacaccatctctactaaaaatacaaaaattaactgggcatggtggcgggcacctgtagtcccagctactcgggaggctgaggcaggagaatcgcttgaacccgggaggcggaagttgcagtgagctgagatcatgtcactgcactccaacctgggcaacaggacaagactccgtcttaaaaaaaaaaaaaagatcctccagctcca

SEQ ID NO: 121131 - DNA, 601 bp, Human
taccactgcactccagcctcggacaccctgtctcaacattaaatacatgaataaaatgataatttaaaaaagagctgttggaggagggaccctcctttctctgtctatgaggaaggctgtccatggagacagaggcttctcctacagacctgagtggaatgctttaggccttaaatattagtaaatctgggccacatggactttgactttgagtgaatggtgtacgggctaattatagccagcggcccacgttggcctatgactgggtttgtgtgtctttctgactccagagtaaagtatkagcaagctgcacttgccggaagactttagccatggcttcatcctcgctttaatgagtaataaggctttttttttccattacgccccatctctctgactcctgcatctatttctcaatgggtttaggtggggaagaaaaggaatgctatttatcaatctccctagaaccttaataaaaactacgatttgttgagtgtttactctgtgccatgcactatgttagtgctttatgcacattatctatgtatgtctttagttacactaagagcttttaaatcatcaccaacacagcaatagatcc

SEQ ID NO: 121132 - DNA, 601 bp, Human
gaagtggaggttgcagtgagccaagattatgccatggcactccagcctgggcaacaaaagcaaaactccacctcaaaaaataaattaattaattaaattaaataaaatgagagactgagatgtgatgtgctctaaattcacaggcttgttgacacctaacaaggtaacaggaaatcttaatcagcagtgtgaacttaaaacatggacattacctgcttcagagtcttaaaggatgagggaatttatatcaggtattttcctttttcttttcttttcttttctttttctttttttttttttctttttttttttttttttttttgagataggatcttgctctgtcacccaggctggagtgcagtggtgtggttatagctcaaggcagccttgacctcccaggctcaagtgatcctctggcctcagcctcatgagtagctgggactacaggcacatgccaccacacacacagcttatttttaaattttttgtagagacaaggtctcagtatgttgctggtctcactcctgagctcaagtgatcctcctgccttggcctcccaaagtgctaggattataggcatgagccaccacgcccaaccagg

SEQ ID NO: 121133 - DNA, 601 bp, Human
ggtggatcacgaggtcaggagttcgagaccagcctggccaacacggcaaaaccccgtctctactaaaagtacaaaaattagccgggtgcggtggggggcacgtgtaatcccagctactcgggaggctgaggcaggagaatcgcttgaacccgggaagcggaggttgcagtgagccgagaatgtaccactgcactccagcctgggcaacagagcaaggctccatctcaaaaaaaaaaaaaaggtgaattttatggtatataaggtatatgtcaattgaaaaaatattattaaatgcaatacrgtatcttggattggatcctgcaatggtaatagaatatttgtggaaaaaaaactagtgaaattcaaataaagacggtagtttaatcgtattgtaccaatgtcaatttcttagttttgacaaatgtatcatggttatataaaatgttaacattagggcaactgggcaaaggacacatgggaactctacactatcactgcaacttttctataaacctaaaattacccaaagatttaaaaatttattaaaacaatgtaagacagagcatgtcattccactgctcaatgtctgcaatgcatttca

SEQ ID NO: 121134 - DNA, 601 bp, Human
agatgtaagtcactaaaatgttaaaatgttctggaattagtgatgatagttgcataagtctgtaaatatactaaaaatcactgaactatactgtttaaaagggtgaattttggctggcccggtggcttacgcctgtaatccaagcactttaggaggctgaggtgggtggatcacgaggtcaggagttcgagaccagcctggccaacacggcaaaaccccgtctctactaaaagtacaaaaattagccgggtgcggtggggggcacgtgtaatcccagctactcgggaggctgaggcaggasaatcgcttgaacccgggaagcggaggttgcagtgagccgagaatgtaccactgcactccagcctgggcaacagagcaaggctccatctcaaaaaaaaaaaaaaggtgaattttatggtatataaggtatatgtcaattgaaaaaatattattaaatgcaatacagtatcttggattggatcctgcaatggtaatagaatatttgtggaaaaaaaactagtgaaattcaaataaagacggtagtttaatcgtattgtaccaatgtcaatttcttagttttgacaaatgtatcatggttata

SEQ ID NO: 121135 - DNA, 601 bp, Human
gagccgagattgcgccactgcacttccaacctgggtgacagagtgaaattctgtctcaaaaaaaaaaaagaaacgaaaaaaagaaagaaagaaagatgtaagtcactaaaatgttaaaatgttctggaattagtgatgatagttgcataagtctgtaaatatactaaaaatcactgaactatactgtttaaaagggtgaattttggctggcccggtggcttacgcctgtaatccaagcactttaggaggctgaggtgggtggatcacgaggtcaggagttcgagaccagcctggccaacayggcaaaaccccgtctctactaaaagtacaaaaattagccgggtgcggtggggggcacgtgtaatcccagctactcgggaggctgaggcaggagaatcgcttgaacccgggaagcggaggttgcagtgagccgagaatgtaccactgcactccagcctgggcaacagagcaaggctccatctcaaaaaaaaaaaaaaggtgaattttatggtatataaggtatatgtcaattgaaaaaatattattaaatgcaatacagtatcttggattggatcctgcaatggtaatagaatatttgtgg

SEQ ID NO: 121136 - DNA, 601 bp, Human
ggtcaagtcccttaacttctctgagtctcagtttcctcatctgttctgggcaccatcactgtgataattataagggaaaaactgcaagtaaagcacctgtaaagtatgtaattgctgcccaaaaattgtaattattaacaatttcaccatttacagagtgctttacctatgtgaagatataacaaggggttcaaaactccatacatgggttttgaagacagtcagacctttatttttatttttattttttttgagacagtctcgctctgtcacccaggctggagtgaagtggggcgatctyggctcactgcaacctccgcctcctgaacttaagtgattctcctgcctcagcctcccaagtggctgggactacaggtgtcagccaccaagccccgctaaatttttgtatttttagtagagacagggtttcaccatgttggcaaggccggtctcaaacacctgacctcaaatgatccacttgccttggcctcccaaagtgctgggattacaggcatgaaccactgcacccagactgaagccagatagaccctgattcaaatctggactctgccacttactatttgtgtgaacttgagacagc

SEQ ID NO: 121137 - DNA, 601 bp, Human
agcacagacaggataagagtttccagctgtcgcctggcaacccaaggtgtggggcaatggtgttgggcaacggtgtgggggaaggaggattctgcagaaggaagggattataaatcctcagttgaatggcctcccccatcccacccctgtccttagcaacacatcaggcaggttccaagcaggctaggagaatctccagccttagatggcaactggacgtcttcaggggcagagcactgctgctctctccatccattgaaaatgggagtaaaagggccacaactcacaactaatttctctrttgatgactccgccttgtaagtcctgtggctcgcaatcttaaagtggtggtaaccctaagatcagtcacagtagtacagcataatagaaacctcatgagctaatcctggctctccccttcactgtatgactttgggtaagtttatttagcacctaatatgttacaggctccatgctagatcctttccctatatgatctcattcaatctttactacaacactaagaagtaggcattaatattcttctattttacagctgaggaaacagaggttcagagacattacttatcacactgctggt

SEQ ID NO: 121138 - DNA, 601 bp, Human
gtggtgctgagaggaaagccggtaagaaagtggcatactcggccgggcgcggtggctcatgcctgtaatcctagcactttgggaggccgaggtgggcagatcacctgaggtcaggagttcgagaccagcctgaccaacatggagaaaccctgtctctactaaaaatacaaaattagccgggcgtggaggcgcatgcctgtaatcccagttactcgggaggctgaggcaggagaatcacttgaacccgggaggcggaggttgcggtgagccgagattgcgccattgcactccagcctgggcracaagagcaaaaactcagtctcaaaaaaaaaaaaaagaaaagaaagtggcctactcattctagagaggctaacccaagaggagcctcagacctcccagccactgaggggcagaactgataggggtgggggtggcacaaaacttgatctgaggccaagagagagatcaggcactgcaagtgcagagagaagagatagcctcaactttgagaggtatacagccttagcttgagcactcactttcattttgccagtctttgttaaacccttactattggcaaggccctgtgcctggtgctgga

SEQ ID NO: 121139 - DNA, 601 bp, Human
gttgactgaggttaggtgtcactttttatatgcagaagtagggtccagtaggaagatcccaggcaagggaatgagtcccaaaagcctgcattcagggcccacttagtccatttgtcaactttaataaagtacaaccctttaccctctgggcctcagtttcctcaagtgtataatgaggatgacaagacctcctcttgtgatcaaatgagatctcatatgtatcagatgatcagactggactggtgtccacagtggtgctgagaggaaagccggtaagaaagtggcatactcggccgggcgyggtggctcatgcctgtaatcctagcactttgggaggccgaggtgggcagatcacctgaggtcaggagttcgagaccagcctgaccaacatggagaaaccctgtctctactaaaaatacaaaattagccgggcgtggaggcgcatgcctgtaatcccagttactcgggaggctgaggcaggagaatcacttgaacccgggaggcggaggttgcggtgagccgagattgcgccattgcactccagcctgggcgacaagagcaaaaactcagtctcaaaaaaaaaaaaaagaaaagaaagtgg

SEQ ID NO: 121140 - DNA, 601 bp, Human
tgttgactgaggttaggtgtcactttttatatgcagaagtagggtccagtaggaagatcccaggcaagggaatgagtcccaaaagcctgcattcagggcccacttagtccatttgtcaactttaataaagtacaaccctttaccctctgggcctcagtttcctcaagtgtataatgaggatgacaagacctcctcttgtgatcaaatgagatctcatatgtatcagatgatcagactggactggtgtccacagtggtgctgagaggaaagccggtaagaaagtggcatactcggccgggcrcggtggctcatgcctgtaatcctagcactttgggaggccgaggtgggcagatcacctgaggtcaggagttcgagaccagcctgaccaacatggagaaaccctgtctctactaaaaatacaaaattagccgggcgtggaggcgcatgcctgtaatcccagttactcgggaggctgaggcaggagaatcacttgaacccgggaggcggaggttgcggtgagccgagattgcgccattgcactccagcctgggcgacaagagcaaaaactcagtctcaaaaaaaaaaaaaagaaaagaaagtg

SEQ ID NO: 121141 - DNA, 601 bp, Human
gcagggctaggaaccacctgagcaaacttccgctggaaggaaattaaagggctaattaagcctccgttggtggtaaatttccaagccagcctttgggctcaatcagttgacacggcaacacaccggtgggggaggccggtatcctgagaggacatattctctcctcacaaaatggcacctcgtggcagcctgaacacagggtccaacctcagaattgccaccaattttctctatcttccctttctcttctctcttaccttccttatctcttcctccccatgttctagctgaagaacctgargggttcagccaggcacagaggaggctgggatgtcctgggatggctctagtacagcatttaattgttgactgaggttaggtgtcactttttatatgcagaagtagggtccagtaggaagatcccaggcaagggaatgagtcccaaaagcctgcattcagggcccacttagtccatttgtcaactttaataaagtacaaccctttaccctctgggcctcagtttcctcaagtgtataatgaggatgacaagacctcctcttgtgatcaaatgagatctcatatgtatcagatgatcagactg

SEQ ID NO: 121142 - DNA, 601 bp, Human
gcaggccctcactctgtcgatcttttcctgccactttaaatccctatgggaacaagacaaaaatatattttaacaatattccctgcactttggcacccacttctgtccttatcacatcctccaagaagcctcttaaaattaccctcattctcatcctccccccttaattttagtgtcccttcagcacttatgtgtcatttcattaaacactgtaagcacttaatgaacagacagtgtgaagggcagcagaaagagtatggattttggggtcaagcaaattctagctttgccacttcttggyatgtgaccttggaccagttgctgtctttgactttctgagctgcagatctgttaactgcaaaacaggtttcataataatatccttttcttggtattgttgggaggataaagtaagataagtgttgtgacagtgtgttggtaaagttctgtataaacagtcgtgttcatttaatttactgtttgccctcagtaatctgctgctcttccccctggtgtcaacacccagaatgggcctcagattcctggtgagctagagctgtaggaaagtgagaggagggaggagcccaagaaagcagggcta

SEQ ID NO: 121143 - DNA, 601 bp, Human
tcaggaccaaaccaggaggaagaaaaaaatggtgcaggccctcactctgtcgatcttttcctgccactttaaatccctatgggaacaagacaaaaatatattttaacaatattccctgcactttggcacccacttctgtccttatcacatcctccaagaagcctcttaaaattaccctcattctcatcctccccccttaattttagtgtcccttcagcacttatgtgtcatttcattaaacactgtaagcacttaatgaacagacagtgtgaagggcagcagaaagagtatggattttggrgtcaagcaaattctagctttgccacttcttggcatgtgaccttggaccagttgctgtctttgactttctgagctgcagatctgttaactgcaaaacaggtttcataataatatccttttcttggtattgttgggaggataaagtaagataagtgttgtgacagtgtgttggtaaagttctgtataaacagtcgtgttcatttaatttactgtttgccctcagtaatctgctgctcttccccctggtgtcaacacccagaatgggcctcagattcctggtgagctagagctgtaggaaagt

SEQ ID NO: 121144 - DNA, 601 bp, Human
tcatggttttgtctgtttgttcttgagtgatcaaattaactgctgggagataatctgtagcagcacaactggtggaaaacttaggctagagtcaggaccaaaccaggaggaagaaaaaaatggtgcaggccctcactctgtcgatcttttcctgccactttaaatccctatgggaacaagacaaaaatatattttaacaatattccctgcactttggcacccacttctgtccttatcacatcctccaagaagcctcttaaaattaccctcattctcatcctccccccttaattttagtgtyccttcagcacttatgtgtcatttcattaaacactgtaagcacttaatgaacagacagtgtgaagggcagcagaaagagtatggattttggggtcaagcaaattctagctttgccacttcttggcatgtgaccttggaccagttgctgtctttgactttctgagctgcagatctgttaactgcaaaacaggtttcataataatatccttttcttggtattgttgggaggataaagtaagataagtgttgtgacagtgtgttggtaaagttctgtataaacagtcgtgttcatttaatttac

SEQ ID NO: 121145 - DNA, 601 bp, Human
tgtgtatatgaattgccaacgtgcttgtctttccaccagactataaaatcttctagtggtttttatgtaaagtctatataaactcttttcatggttttgtctgtttgttcttgagtgatcaaattaactgctgggagataatctgtagcagcacaactggtggaaaacttaggctagagtcaggaccaaaccaggaggaagaaaaaaatggtgcaggccctcactctgtcgatcttttcctgccactttaaatccctatgggaacaagacaaaaatatattttaacaatattccctgcacyttggcacccacttctgtccttatcacatcctccaagaagcctcttaaaattaccctcattctcatcctccccccttaattttagtgtcccttcagcacttatgtgtcatttcattaaacactgtaagcacttaatgaacagacagtgtgaagggcagcagaaagagtatggattttggggtcaagcaaattctagctttgccacttcttggcatgtgaccttggaccagttgctgtctttgactttctgagctgcagatctgttaactgcaaaacaggtttcataataatatccttttct

SEQ ID NO: 121146 - DNA, 601 bp, Human
taattcttacaactttctgagcgaggtcccattttcatacttattttacagataaagtaatgagattcagagattaaacaccttgcctgaagccatacagctggtaaaagacccaagccagaaagtcaaacttcacagccttcctaacttctcttctatcctctctccaatgaaactgtgtatatgaattgccaacgtgcttgtctttccaccagactataaaatcttctagtggtttttatgtaaagtctatataaactcttttcatggttttgtctgtttgttcttgagtgatcaaatkaactgctgggagataatctgtagcagcacaactggtggaaaacttaggctagagtcaggaccaaaccaggaggaagaaaaaaatggtgcaggccctcactctgtcgatcttttcctgccactttaaatccctatgggaacaagacaaaaatatattttaacaatattccctgcactttggcacccacttctgtccttatcacatcctccaagaagcctcttaaaattaccctcattctcatcctccccccttaattttagtgtcccttcagcacttatgtgtcatttcattaaacactgt

SEQ ID NO: 121147 - DNA, 601 bp, Human
ctttgctcatgctgcaccctctgcctggatcagccttttccccttccctgccaaggcagtcgctaattaccattccaattcagctcaaatgcttcctcctgtatgactcgcatttcctcccatacccacaggcagaaataatgactggctgccatttgtttagacgggctgtgccaggcactgtgctaattcttacaactttctgagcgaggtcccattttcatacttattttacagataaagtaatgagattcagagattaaacaccttgcctgaagccatacagctggtaaaagacccragccagaaagtcaaacttcacagccttcctaacttctcttctatcctctctccaatgaaactgtgtatatgaattgccaacgtgcttgtctttccaccagactataaaatcttctagtggtttttatgtaaagtctatataaactcttttcatggttttgtctgtttgttcttgagtgatcaaattaactgctgggagataatctgtagcagcacaactggtggaaaacttaggctagagtcaggaccaaaccaggaggaagaaaaaaatggtgcaggccctcactctgtcgatcttttc

SEQ ID NO: 121148 - DNA, 601 bp, Human
cccctgttctctcccttcagctctgccggttcctgctgtgtctcctacactggctccttatcctcccctgggccctcactttcaagtttcagatggaaatttccaactgtctgctgggcatctccacttagcctgaaaccatccaacatgtatatggttgactattaattatgacctatttcatttgtgtcttctccagctattaagcccttatgagtaccccacacgcatctgggcatatagcagtattctaaagatgcctgcagaatgaaccatcattcataatatcccagtgctttgrcatggacaaatttagcatcagagttgccaatccatttcctcatcactctttttgcctccaaattgacatcagcaccattcacagcattctgagaagtctctctggggaatttacttcatatgccacctgctgtaccctttatgtgactcacccaactcccctttgagacaggaaaatgtggggagagaagtgaggtggaagagagccaggaggaaaaaaagaagcatgaaacatgattatacttaatacatccccagatcacagcaagcaaaaggaaatgaacagagtcaggccttgtgc

SEQ ID NO: 121149 - DNA, 601 bp, Human
tagtgggaaagttagacacatgtgaatcctatgagaggtgtacatacccatttcacagatgggaaacaggaccccagagagatgaatgccctgtattcttatttttggcattggtctctcacacaaagccctcaaatactctaaactcaaaaacactcatggatatagctattgatttccatgatttccaccaagataaaggcactactttttacttcaagtggattagctgaaggtcatagggcttccttgcatttttcctcaatgtatgtggcgtatcttaggtattcaataaatattyttaatgaatagatcatagcacctatatcaggaatttgcttccactctcacctatatctctcatttagactggaggaggggctgtgccttattgtttctgtaccctcagtgtctaatgcaatacttggcacctggaaggtactccataaatactgaatgaacaaaggaatgaataaatgaataaaggaatgaacaaaggaatgaataaatgaagaaaaaagataaaaatgaagaaaaatgaaaataaaagaaggatgggtaatataacctttttgttgccctaaattaaaaacatgacatc

SEQ ID NO: 121150 - DNA, 601 bp, Human
tcagaacactcacagtctagtgggaaagttagacacatgtgaatcctatgagaggtgtacatacccatttcacagatgggaaacaggaccccagagagatgaatgccctgtattcttatttttggcattggtctctcacacaaagccctcaaatactctaaactcaaaaacactcatggatatagctattgatttccatgatttccaccaagataaaggcactactttttacttcaagtggattagctgaaggtcatagggcttccttgcatttttcctcaatgtatgtggcgtatcttargtattcaataaatattcttaatgaatagatcatagcacctatatcaggaatttgcttccactctcacctatatctctcatttagactggaggaggggctgtgccttattgtttctgtaccctcagtgtctaatgcaatacttggcacctggaaggtactccataaatactgaatgaacaaaggaatgaataaatgaataaaggaatgaacaaaggaatgaataaatgaagaaaaaagataaaaatgaagaaaaatgaaaataaaagaaggatgggtaatataacctttttgttgccctaa

SEQ ID NO: 121151 - DNA, 601 bp, Human
ccctatcctcagaacactcacagtctagtgggaaagttagacacatgtgaatcctatgagaggtgtacatacccatttcacagatgggaaacaggaccccagagagatgaatgccctgtattcttatttttggcattggtctctcacacaaagccctcaaatactctaaactcaaaaacactcatggatatagctattgatttccatgatttccaccaagataaaggcactactttttacttcaagtggattagctgaaggtcatagggcttccttgcatttttcctcaatgtatgtggcrtatcttaggtattcaataaatattcttaatgaatagatcatagcacctatatcaggaatttgcttccactctcacctatatctctcatttagactggaggaggggctgtgccttattgtttctgtaccctcagtgtctaatgcaatacttggcacctggaaggtactccataaatactgaatgaacaaaggaatgaataaatgaataaaggaatgaacaaaggaatgaataaatgaagaaaaaagataaaaatgaagaaaaatgaaaataaaagaaggatgggtaatataacctttttgt

SEQ ID NO: 121152 - DNA, 601 bp, Human
agcctgtgccatgtgtgatccctatcctcagaacactcacagtctagtgggaaagttagacacatgtgaatcctatgagaggtgtacatacccatttcacagatgggaaacaggaccccagagagatgaatgccctgtattcttatttttggcattggtctctcacacaaagccctcaaatactctaaactcaaaaacactcatggatatagctattgatttccatgatttccaccaagataaaggcactactttttacttcaagtggattagctgaaggtcatagggcttccttgcattkttcctcaatgtatgtggcgtatcttaggtattcaataaatattcttaatgaatagatcatagcacctatatcaggaatttgcttccactctcacctatatctctcatttagactggaggaggggctgtgccttattgtttctgtaccctcagtgtctaatgcaatacttggcacctggaaggtactccataaatactgaatgaacaaaggaatgaataaatgaataaaggaatgaacaaaggaatgaataaatgaagaaaaaagataaaaatgaagaaaaatgaaaataaaagaaggatg

SEQ ID NO: 121153 - DNA, 601 bp, Human
ttaaggattctaaagcgcctccctgccctctgtaatcctatctaatctttgaggtccaggtcaaagtgcaccttttttgggaagtccttcaggaccctgtctaaattcatcaccattgcttctggccttccacagaatgtacttggacctttattttagtgacagcagagcacaggccattaaagacagaaagcccttatgagagtaattaattccacatatattcactgatcttagcctgtgccatgtgtgatccctatcctcagaacactcacagtctagtgggaaagttagacacatrtgaatcctatgagaggtgtacatacccatttcacagatgggaaacaggaccccagagagatgaatgccctgtattcttatttttggcattggtctctcacacaaagccctcaaatactctaaactcaaaaacactcatggatatagctattgatttccatgatttccaccaagataaaggcactactttttacttcaagtggattagctgaaggtcatagggcttccttgcatttttcctcaatgtatgtggcgtatcttaggtattcaataaatattcttaatgaatagatcatagcac

SEQ ID NO: 121154 - DNA, 601 bp, Human
ccacagctgctcagctccaagtgctttgtttttctgcagcagctgagagctgagacattatgtcccatgggaatggaaggaaactggaaggggagagctctttaggaaggaaagagcagttcaatagagcttgggagacacagaggactgaaagtggtaaaaatggtcctttggagctagcttaatattatacctatccgtcctcagccatatagaccacattatagagcaccctacagtttacaagtacttttattacatcatcttacaggagcctgacaatgattctgtgatgcagacttttttttttttttttaacaatttcaacttttgttttaggttcaggaggtaaatgtataggtttgttacatgggtatactgcatgatgctgaggtttggggtatgactgatcccattacccaggtaatgagcatagtacccaatgggcagttttgcagcccttgtccccaatgcagacattttagaaccagaagaaatcaatcttaaagttcatccagtctgactcctttcttttacagatagaaaaactgagacctagacactcagtgactttcccaaggccacatagctctttattttt

SEQ ID NO: 121155 - DNA, 601 bp, Human
ggaaaaggcaacatttaattggttaaaaagcattattcaaaaagaaccaaccaggaaagggtgggcaaacaggaacacaagttctcactctgggtcatgggtttcatccagaaccagcagcagtccaggctgtttttggcttgaaggtggggtttcatcagggacctgtccctatctgcctaggcatttgtctgcctcctgctgctatcaatatcactgtacacatcacatttgttatagttaccagtttgtttttctgtctcctctttcaggctatgagcaccctaaaatcaagtcatayttagctaactattaggccctcaactatagcacctgccacatactaggaacttaaaagaatgctagcaaaagaaactcaagggctgactgtgctgaaaagggaaagctcatttagaacttcaggattggttggaatagggtctgtgagctcatacatatcacctcctttttctgggcactttccatgtcatagacaaagaaagggaggcccagagcagtgacaacttgagaggtcacacaaaaagtgagaggttatctctggggtcttcatccctgggtcgtgccctgttgcctgtgcatt

SEQ ID NO: 121156 - DNA, 601 bp, Human
cagacagaatccaaattctggccaggcacggtggctcatgccagtaatcccagcactttgggaggccgaggcagacggatcatttgagctcaggaattcaagaccagcctgggcaatatggtgaaaccttgtctcttcaaaaaatacaaaaattagctgggcatggtggcatgctcctgtagtcccagctagttgggaggctaatgtgggaggatcacttgaggccaggaggtggaggttgcagtgagctgagattgcacactgcacatcagcctgggtgacagagtgggaccttgcctcaaaaaaaaaaaaaattcaaattctgtcttgaccaaagcctgtgcattttcaacacagcctaaagtccaacctgatttgtattcttgattctctttagcccccaagatcctctgcagcctcccaatacaggaagtcctctaaccatgtctaaggcttccagggaccaacaatctcccctccaccagagcataagattggaaatcacctagaaagcttaaatgaaatcacatgtgatccaacacacactcttcatttcttcgtaaagttttccacacggtcgtcacacatgccacattcattt

SEQ ID NO: 121157 - DNA, 601 bp, Human
tttccaacagtatgtgctcacttcatgtctctgtgtcacattttggtatttctcacaatatttcaagtcttttcattattattatatctgtcatgtttatctgtgatcagtgatctttgatgttactattgtaattgctttggggtgccatgaaccacacccatattaaggcagtgaacttaatgttgtgtgtgttctgaatgctccaccaaccagccattcccccatctctccctctcttcaggactccctatgccttgagacacaacagtattaaaattaggccaattaataaccctayaatgggcccagcgtggtggctcatgcctgtaatcatagcactttgggaggccgaggcaggtggaccacttgaggtcaggaggttgagaccagcctggtcaacatggcgaaatcctgtctctactaaaaatacaaaaattagccaggcatggtggcagatgcctataatcccagttactcaggaggctgaggcaggagaatcacttgaacccaggaggcggaggctgcagtgagtcaagatcacaccactgcactccagcctgggtgacagagcaagactccatctcaaaataataacaac

SEQ ID NO: 121158 - DNA, 601 bp, Human
tacactttgcagatattgcattttttacagattgaatgtttgtggtgaccctatctcaagcaggtctatcagagctatttttccaacagtatgtgctcacttcatgtctctgtgtcacattttggtatttctcacaatatttcaagtcttttcattattattatatctgtcatgtttatctgtgatcagtgatctttgatgttactattgtaattgctttggggtgccatgaaccacacccatattaaggcagtgaacttaatgttgtgtgtgttctgaatgctccaccaaccagccattyccccatctctccctctcttcaggactccctatgccttgagacacaacagtattaaaattaggccaattaataaccctacaatgggcccagcgtggtggctcatgcctgtaatcatagcactttgggaggccgaggcaggtggaccacttgaggtcaggaggttgagaccagcctggtcaacatggcgaaatcctgtctctactaaaaatacaaaaattagccaggcatggtggcagatgcctataatcccagttactcaggaggctgaggcaggagaatcacttgaacccaggaggcgga

SEQ ID NO: 121159 - DNA, 601 bp, Human
agtgaatgaataaatgaggttctgaacatttaacactggaaatcttagacattattgagagaaatctgccatatccacatcaaagctctgtgtgtttgtgactaagaaacattgacgcagtatttgatccactcctcctatgcccttgcctctgcttcctgagctcctcagagccaactccaaagaatagacctcccactgatctgtaggttcagtccctaaatcctgtcctgcaggatttggaattaagccactcttcctggtctagaagcccaggcaggatttctgagcgcctgcactrccatcaggcctgagctctcctcagtctccctaaactatgccctgttattctgtgagagtgtcgagtcttccatctctgcctggagcctagccctgtgcccaagctctccaagagtcttgtcacccaactgaatcccaactaattagaaattctggtatataccccataaatgagtttggacatggagtcagttttatctcagtactaccagtacgtagcacagggctgtgcacacagtagcaatttaaccactgtttgttaaacaaaaaggccatatagtcttgaggttaagactgtgat

SEQ ID NO: 121160 - DNA, 601 bp, Human
acagcagttctccctatgagttctggaagatattttctccagctcatgagtgagtgggaggataaatgaatagatgaatggataaatgagtgaatgaataaatgaggttctgaacatttaacactggaaatcttagacattattgagagaaatctgccatatccacatcaaagctctgtgtgtttgtgactaagaaacattgacgcagtatttgatccactcctcctatgcccttgcctctgcttcctgagctcctcagagccaactccaaagaatagacctcccactgatctgtaggttyagtccctaaatcctgtcctgcaggatttggaattaagccactcttcctggtctagaagcccaggcaggatttctgagcgcctgcactgccatcaggcctgagctctcctcagtctccctaaactatgccctgttattctgtgagagtgtcgagtcttccatctctgcctggagcctagccctgtgcccaagctctccaagagtcttgtcacccaactgaatcccaactaattagaaattctggtatataccccataaatgagtttggacatggagtcagttttatctcagtactaccagt

SEQ ID NO: 121161 - DNA, 601 bp, Human
catacagcagttctccctatgagttctggaagatattttctccagctcatgagtgagtgggaggataaatgaatagatgaatggataaatgagtgaatgaataaatgaggttctgaacatttaacactggaaatcttagacattattgagagaaatctgccatatccacatcaaagctctgtgtgtttgtgactaagaaacattgacgcagtatttgatccactcctcctatgcccttgcctctgcttcctgagctcctcagagccaactccaaagaatagacctcccactgatctgtagsttcagtccctaaatcctgtcctgcaggatttggaattaagccactcttcctggtctagaagcccaggcaggatttctgagcgcctgcactgccatcaggcctgagctctcctcagtctccctaaactatgccctgttattctgtgagagtgtcgagtcttccatctctgcctggagcctagccctgtgcccaagctctccaagagtcttgtcacccaactgaatcccaactaattagaaattctggtatataccccataaatgagtttggacatggagtcagttttatctcagtactacc

SEQ ID NO: 121162 - DNA, 601 bp, Human
ctccataaaacaaaacctgcatctaacatactcaccctccttggagagcatatgaatcaccatcttcttttcattgagcaatgtctttaagcatcttactctccacctcaatcagcttatcaaagtattccttctgaccacatacagcagttctccctatgagttctggaagatattttctccagctcatgagtgagtgggaggataaatgaatagatgaatggataaatgagtgaatgaataaatgaggttctgaacatttaacactggaaatcttagacattattgagagaaatctgcyatatccacatcaaagctctgtgtgtttgtgactaagaaacattgacgcagtatttgatccactcctcctatgcccttgcctctgcttcctgagctcctcagagccaactccaaagaatagacctcccactgatctgtaggttcagtccctaaatcctgtcctgcaggatttggaattaagccactcttcctggtctagaagcccaggcaggatttctgagcgcctgcactgccatcaggcctgagctctcctcagtctccctaaactatgccctgttattctgtgagagtgtcgagtctt

SEQ ID NO: 121163 - DNA, 601 bp, Human
atagggaatggtgatagattagatgtgaagagaagaaaaacaaagatagcagttgtttctgtcagggcttggcttctccatgtcctcagcaattcagctctggcccagacttgcataaccttactccataaaacaaaacctgcatctaacatactcaccctccttggagagcatatgaatcaccatcttcttttcattgagcaatgtctttaagcatcttactctccacctcaatcagcttatcaaagtattccttctgaccacatacagcagttctccctatgagttctggaagatattktctccagctcatgagtgagtgggaggataaatgaatagatgaatggataaatgagtgaatgaataaatgaggttctgaacatttaacactggaaatcttagacattattgagagaaatctgccatatccacatcaaagctctgtgtgtttgtgactaagaaacattgacgcagtatttgatccactcctcctatgcccttgcctctgcttcctgagctcctcagagccaactccaaagaatagacctcccactgatctgtaggttcagtccctaaatcctgtcctgcaggatttggaatt

SEQ ID NO: 121164 - DNA, 601 bp, Human
aggtcagactaaataagaatctgagctagagtggtaacaacaggcatagagtaagaacagattcattgaggtatttaagaggtaaaattatagggaatggtgatagattagatgtgaagagaagaaaaacaaagatagcagttgtttctgtcagggcttggcttctccatgtcctcagcaattcagctctggcccagacttgcataaccttactccataaaacaaaacctgcatctaacatactcaccctccttggagagcatatgaatcaccatcttcttttcattgagcaatgtctttragcatcttactctccacctcaatcagcttatcaaagtattccttctgaccacatacagcagttctccctatgagttctggaagatattttctccagctcatgagtgagtgggaggataaatgaatagatgaatggataaatgagtgaatgaataaatgaggttctgaacatttaacactggaaatcttagacattattgagagaaatctgccatatccacatcaaagctctgtgtgtttgtgactaagaaacattgacgcagtatttgatccactcctcctatgcccttgcctctgcttc

SEQ ID NO: 121165 - DNA, 601 bp, Human
taataacatagaacaaccaccacccctgccctcaggaaacctcaatagagttgtgaaggtggctaagatataacagcaaattgataattagcaatatgaggtaatatgtcatcagcaccagataagtggtataaaaaaaaatgagttggctgggcatggtggctcatgcctgtaatcccagcactctgggaggccaaggtaggtagatcatttgaagtcaggagtttgaggccagcctggccaatatggtgaaatcctgtctgtattaaaaatacaaaagttagccaggtgtagtggtgtwcacctgtaatcccagctacttgggaggctgaggcacgagaatcacttgaacccaggaggcagggtcgcagggagctgagatggcatcatcgcattccagcctgggtgaaagagtgagactgtctcaaaaggaaaaaaaaaaagagtcacacaagttcaggtaaagtagaaacatggtggtttggggtagttatggaagatgtcaaagtggagataatatatcctttaggataggctgggttcttcaggaacaagcaatcccaaatgtcagtagcttaaacaacaaggttttattttttat

SEQ ID NO: 121166 - DNA, 601 bp, Human
ccatgcctggctaattttttttacttttgtagagacaaggtcttactatgtagccatggctggtctggaacacctgaactcaagtgatcctcctgcctcagcctcccaaagtgctgggattaaaggcatgagcctgtaaagcccagccaaatccaggacttctgattccatgtctaatgcaggtaccaccacaactccatcaatgaaagattgatttattcacaagcatctactgaacaccatctatagttataataaaaataaataaggagaaaaataatttcagtatgccactattttwatacaggttgcacctgttatccacaaatactagaaaaccctggagaatatatgttgttactctcatcttacaggtgaggaaactaagattcattcagaactaatctgtctctctcctgcacccattacaacatattgccttagccatgaactatacttagtgtgataataacatagaacaaccaccacccctgccctcaggaaacctcaatagagttgtgaaggtggctaagatataacagcaaattgataattagcaatatgaggtaatatgtcatcagcaccagataagtggtataaa

SEQ ID NO: 121167 - DNA, 601 bp, Human
tatttttaataataattcccatgattgataagcatgcagtgaaatatacaaattcacatcttgcttgtgggagtggaacttggtttagcctttctgggaatcaatttggaagtcttaagagcattaaaaatgttcatactctttgacccagaaatattccttctgggaatttttcccacaaaattagaaaaattttccctataaaaatagaaaatcagacaaatatgtatgtacaaaaacacatttgttaaaactttatctagacagtgaaaacatatcatcaacttatatattcaacaayaggagaatggttaaaatgtaagaatttttatgtaagttcatgtatgtaagaataacgatatgagacaatacttgtatgtgtgatgtattagttttataactatatgtgcacagaaaaaaatagaagaaacacatcaaaaggttaatagagattttctctgaataagagacaagaattactgagattttgattttcttcatgtaatttttttttttttttttgagacagggtctcactgtgtggcccaggctggagtgcagtggagcaatcttggctcactgcaatctccaccccctgggc

SEQ ID NO: 121168 - DNA, 601 bp, Human
ctaggttcaagtgattctcctgcctcagcttcccgagtggctgggattacaagcatgcaccaccatgcccagctaattttgtatttttagtagagacagggtttctccatgttggtcaggcaggtctcgaactcctgacctcaggtgatccacccgcctcggcctcccaaagtgctgggattacaggagtgagccaccgcgcccaacccaaggcatatttaaggagcatctattatgtgtcttgtattgtgcttgctgactagattaaaatgattttttaaatctcatagaatttaataaraataattaaaatcctaaaggaaaagtggacaagaggcatgaacaagcacataagaaatgttgagtgggtaattattacataaaaagttttaaccttatttttgtttcttttttttttttttttttttttttaagacaaagccttactctgttgcccaggctgagagccctggcacaatcatagctcactgcaagtttgaatttctgggctgaagcaatgctcccacctcagtctccgagtagctgggattaaggttttgtgccactgtgcccagccccttatttttaataataattccca

SEQ ID NO: 121169 - DNA, 601 bp, Human
cagcattgaaggactcttcattggtgatgtcatacatcagaatgaagcccatggccccacggtaataggctgttgtgatggtccggtaccgctcctgcccagctgtgtcctgggcaggaaaagaaaagaaacaatctcttagaaagtctgctttggttcctaaaaagtccccaggacaattaactaataacccaagacattttttttttttgagatggagttttgctcttgttgcccaggctggagtgccatggcgcgatctcagctcactgcaacctctgcctcctaggttcaagtgatwctcctgcctcagcttcccgagtggctgggattacaagcatgcaccaccatgcccagctaattttgtatttttagtagagacagggtttctccatgttggtcaggcaggtctcgaactcctgacctcaggtgatccacccgcctcggcctcccaaagtgctgggattacaggagtgagccaccgcgcccaacccaaggcatatttaaggagcatctattatgtgtcttgtattgtgcttgctgactagattaaaatgattttttaaatctcatagaatttaataagaataattaaaatcct

SEQ ID NO: 121170 - DNA, 601 bp, Human
tcctgttcatcttacaaaatgcagcatatgtgtcagcaactccagggcactttctctgactccctaaactgggtcagagagccctctgctgggttcccacagccctgatgcctcgcttcatcactgcacctagcacacattttcttttcttttctttctttttttttttttaagatagagtctcactctgttgcccaggctggagtgcagtggtgtgatctcagctcactgcaacctccgcctcccaggttcaagcaattctcctgccttagcctcctgagtagctgggattataggcacrtgccaccacgcctggctaatttttgtatttttagtagagacggggtttcaccatgttggctaggctggtctcaaactcctgacctcgggtgatctggctgcctcggcctcccaaagtgctgggattacaggcgtgagccactgcacccggcctatcacatgatattttcattcctgcttatggatctgtcttctgctctcgtctgtaaactcctgaggccaggaaccatgtctgattcatctgggcttccccagcacacaatacaggacctagcacatgttaggttttaatgaacagttt

SEQ ID NO: 121171 - DNA, 601 bp, Human
tcccaccttcccccatcctcatctgagcagggacactgggtcctggccctccctctcatgtgtccttcccctcaggctcccttctcctgggaatcgtgccccaggaagaaagctataagttgctcagaggttgcaactctggggtgctgtactgatttccattgcatattgagccttgatgaacttggactgtatgtgctcctggacacctggctcagcccagggataaactttaagtgctatgtggattcactctccactggagctacagtaatcttcctgaaacacaaatgtgaacctrttggtttctaattcatacgtcatcacctatgggacagaatccaaactccttatagcagcacacaaaacccttcatgacctatgcccttcaacactcgcacctaccttctcacctttgcacatctgtactcattttctggaacatccttattcatttgtccctcgggctaactcctgttcatcttacaaaatgcagcatatgtgtcagcaactccagggcactttctctgactccctaaactgggtcagagagccctctgctgggttcccacagccctgatgcctcgcttcatcactgcac

SEQ ID NO: 121172 - DNA, 601 bp, Human
gtgtgcctggtctgctcagcctctccgattctgaaggacagccaccacacagatgtcccaccttcccccatcctcatctgagcagggacactgggtcctggccctccctctcatgtgtccttcccctcaggctcccttctcctgggaatcgtgccccaggaagaaagctataagttgctcagaggttgcaactctggggtgctgtactgatttccattgcatattgagccttgatgaacttggactgtatgtgctcctggacacctggctcagcccagggataaactttaagtgctatgtrgattcactctccactggagctacagtaatcttcctgaaacacaaatgtgaacctattggtttctaattcatacgtcatcacctatgggacagaatccaaactccttatagcagcacacaaaacccttcatgacctatgcccttcaacactcgcacctaccttctcacctttgcacatctgtactcattttctggaacatccttattcatttgtccctcgggctaactcctgttcatcttacaaaatgcagcatatgtgtcagcaactccagggcactttctctgactccctaaactgggt

SEQ ID NO: 121173 - DNA, 601 bp, Human
agaagcgaagtcctcgaaggtcaccattaggcaaaagggagaaggagacaagcccagcactggccagcactgctgctgtgtgcctggtctgctcagcctctccgattctgaaggacagccaccacacagatgtcccaccttcccccatcctcatctgagcagggacactgggtcctggccctccctctcatgtgtccttcccctcaggctcccttctcctgggaatcgtgccccaggaagaaagctataagttgctcagaggttgcaactctggggtgctgtactgatttccattgcataytgagccttgatgaacttggactgtatgtgctcctggacacctggctcagcccagggataaactttaagtgctatgtggattcactctccactggagctacagtaatcttcctgaaacacaaatgtgaacctattggtttctaattcatacgtcatcacctatgggacagaatccaaactccttatagcagcacacaaaacccttcatgacctatgcccttcaacactcgcacctaccttctcacctttgcacatctgtactcattttctggaacatccttattcatttgtccctcgggct

SEQ ID NO: 121174 - DNA, 601 bp, Human
aaagagttatttaaaaggaagggacagaaaggaggaagaagaggataaccaggaggcagaaaaggagaacacagacccccaggaatgacagacatgctgatgacaccctgaactgctggtcagaacaggggagtgcagcaggcagcccacaaggtcactctcagctcaagctgtgtatgtgaagccaacacaattatgacaactgctccctgggagaagcgaagtcctcgaaggtcaccattaggcaaaagggagaaggagacaagcccagcactggccagcactgctgctgtgtgcctgrtctgctcagcctctccgattctgaaggacagccaccacacagatgtcccaccttcccccatcctcatctgagcagggacactgggtcctggccctccctctcatgtgtccttcccctcaggctcccttctcctgggaatcgtgccccaggaagaaagctataagttgctcagaggttgcaactctggggtgctgtactgatttccattgcatattgagccttgatgaacttggactgtatgtgctcctggacacctggctcagcccagggataaactttaagtgctatgtggattcactc

SEQ ID NO: 121175 - DNA, 601 bp, Human
aaaaaatactttttggccgggtgcgctggcccacgcctgtaatcccagcactttgtgaggccgaggtgggcggaccacgaggtcaggagatcgagaccatcctagctaacatggtgaaaccccgtctccactaaaaattaaaaaaaaaaaattagctgggcatggtggcaggcgtctgtagtcccagctactcaggaagctgaggcaggagaatggcgtgaacccgggaggtggagcttgcagtgagccaagatcgcatcactacactccagcctgggtgacagagcgagactccatctcaaaaaaaaaaaaaaaaaaaaaaccttttcaaatttctgtacttttcacatttttaaaagtgagcatgtattacttctttaattaaaaacaaaattttaagaggaaataaaaaaggactctcttatattatgaagacatctttttgtggagatgggcctaacattccccaaagaccccatcaggtagaaatgattacttcctcttttggtctcctgcacgttcaccatgacacctattacacttggctgaatttgtctctctccctgagggcaaggaccggcctattcatctttgggatgcc

SEQ ID NO: 121176 - DNA, 601 bp, Human
cctcggattatgattatttgcaggaaccaaaatgtcagcagtggttaccttcatataagatgattataagacttttaaaaaatactttttggccgggtgcgctggcccacgcctgtaatcccagcactttgtgaggccgaggtgggcggaccacgaggtcaggagatcgagaccatcctagctaacatggtgaaaccccgtctccactaaaaattaaaaaaaaaaaattagctgggcatggtggcaggcgtctgtagtcccagctactcaggaagctgaggcaggagaatggcgtgaaccygggaggtggagcttgcagtgagccaagatcgcatcactacactccagcctgggtgacagagcgagactccatctcaaaaaaaaaaaaaaaaaaaaaaccttttcaaatttctgtacttttcacatttttaaaagtgagcatgtattacttctttaattaaaaacaaaattttaagaggaaataaaaaaggactctcttatattatgaagacatctttttgtggagatgggcctaacattccccaaagaccccatcaggtagaaatgattacttcctcttttggtctcctgcacgttcacc

SEQ ID NO: 121177 - DNA, 601 bp, Human
cgccccactgcactccagcctgggtgacaagagtgaaactccatctcaaaaaaaaaaatcttagtgagaagggcttggcatgctggtatatttttttctaatacatatccaaatatgtattagaaaataaatacagaaaatcatcctgcacaattccagtggcgtgagtcccctctttgggcaacactactccagactcacaccatccagtgatttatggttccctgacccacaaggcagctccttgcctctgccagggttatgcccctgcctggaatgcccttaactttcttcttcactkgactggtcctacttatcttcaagactccacttgggcatcatgttctctgatcccaggagaatgacgttcctcctctatgctcccccaacatccctctgtcacagccctgaccaattggactatgactgttactgtaggctttctcactggatcgagcttattcagaccaggaaatgtagcctatttcacagctcagggcctagaacagagtaggcactcaggaagtcttcactggacaataaaatgaagtacccaaatacttaacatcataaaattaaccaaaacatatttttgcatcct

SEQ ID NO: 121178 - DNA, 601 bp, Human
taaatgagataattaatgctaaacatttcacatagtgccttgttcaatatatatcagctatgattaccacatttgctgtgtagtaaagttaagtggttaggagcacaggctctgggagccagactaccacctgagttgaaatactggttctaccctcttactagctgtgtgactttggcaagttactcaacttctctgtgcctcacttttctcatctgttaaaaaaaacacacacacacaaaatgtggagataaggaaagaacatatcttggagggttttagagggattaaattagatgcrtaatactttgaaacacttagaataaatagtgcctgacacatggtaagcacctaataaatgtttaaccaattcacctttaaaaaatcttagaatggccatacaaggtggctcatgcctataatcccagcactttgggaggctgaggtgggcagatcacctgaggtcaggagttcgagaccagcctggccaacatgatgaaaccccgtctctactgaaaatacaaaaaattagccaggcatggtggtgggtgcctataatcccagctactcaggaagctgaggcaggagaatcacttgaacc

SEQ ID NO: 121179 - DNA, 601 bp, Human
gtggggcaatctcagctcactgtaacctctgcctcttggattcaaaggattctcctgcttcagcctcccgagtagctgggactacatgctcggctaatttttgtatttttagtagagatggggtttcaccatgttgaccaggttggtatcaaaccaggctgacctcaagtgatccacccacctcagcctcccaaagtgctgggattacaagtgtgagccactgcgcccagccaattctattttttttattaaagctagtttgatttgcaattttatcacttgcaataacaagagtcctaaytcaagtagaacttatcacaattttaacagctgtattgagccataattcacataccatacaattcacccatttatttgcacaatttttaattaatatttgtgtaagtatttatttaatgtctctttccccattagttccatgacagtaaggattgcagctgtttgttcatcattcattatatcctaagtgccagggcagaacttggctcagcgtgctcaataaatgtttttcactgaataagtaaaatgtattaatgaatatctaccctatgctgggtccttaggataatgaaacaaatca

SEQ ID NO: 121180 - DNA, 601 bp, Human
cctccctgggttctggtcagatctccagtcagatccaggaaagggacaagaagcccctttccgaggagcacatggaggcagaaccctaaaaggtcatgcttcttgaaataaaagtccctaaaactcctctactgttccaaacacccacctgcctcagcatctatatgatctcaaccaagtcccaggaactttgaggatatggaaggccaatcacaacacacagcttttttttttctttttttagatggagttttgctcttgttgcccaggctggagtgcaatggtgcgatctctgctcacygcaacctccgcctccccggttcaggcgattctcctgcctcagcctctcgagtagctgggattacaggcatgcaccaccacgcctggctaatttttgtatttttagtagagatgaggtttctccatgttggtcaggctggtctcgaactcccgacctcaggtgatccacctgcctcggcctcccagagtgctgggattacaggcgtgagccaccaagcccagcctcacagctttaataaacacgaattgttggccatatcaatagtcttgactgagagagctgagaaaagctacaagaaag

SEQ ID NO: 121181 - DNA, 601 bp, Human
cccatagactgcatccacactgcctgcttctgaatacgacctcagaattctattcagaaacttgcaaccagctaaactcacctctcctcatcccaacactgctccagaacatgtctcctccacggttcagatcccttctccatcctgctctgacaccacctcatctctgtcatttatcaaccttcaactcacatcctctggtcactgatgatttgggctcagtgggactcactgtcttcctttctactcaaggcttgttttcattctctggaactttgagtgtcatgtggacaatccatcyggcaccttggatggaccttctcttccattttgcttcagctattcacctgtccctataacttgagctattttgacttggatttgtgtcactggaattgaaagaggtctgatcaattcaatatccagcctcactggctgaacacccaagacctggcatggcctggtctctactcccccagcttcatcttcctggctcacactatgctccagaaacatcagtgcttcctgattttgtgccattgctcatgttattaatctctagctactactcctaatcatcttcattattcatctgtggaat

SEQ ID NO: 121182 - DNA, 601 bp, Human
tcctatatgttcctggcccaccttactcccagcttccttgcacctctactgtctccagggcctttggggaaatctctttgtcttcatcacttagggtcaatcaataagccaggtctttttttttttaatttcatttttatttatttattttttgagagacagagtcttgctctgtcgcccaggctggagtgcagtggcacaatctcggctcactgcaacctctgcctcccgggttcaagcgattttcctgcctcagcctcctgagtagctgggattacaggtacccaccaccacacccggmtaatttttgtatttgtagtagagacagggtttcaccatgttggccaggctagtctggaactcccaacctcaggtgatctgcccgcctcggtctcccaaagtgctgggattacaggcatgagccacagtgactggcccaccaagtctttattgagcattgaccttgtgccatgtcttgtgttgagtgttagagatacagacacagggagatcaattatagttgtagaaaagacatgctaataaaggcatcagtctctcccatctgcagttcacattaacagttcacaaatacgaaaacaac

SEQ ID NO: 121183 - DNA, 601 bp, Human
cagacactatgctaggagctttactgatatcatcttctttaatcctcacaataaccagttgggtaaataacatcatctccaatttataaatgagaatatgagagactgcataactcacacaaagtcatgtggctgtattagcggaaactggatttagacctgggtttggctgtctccaaagtccacacacagctctgcctctcatttcttcccccttttctctttcactttgcatttttttttcctgattatacctttttcttcctttacaagtctctttggcctcctctgctttaatccractaacagtatctgagtctgggcaagtcacttcacctctctgctcacttaacctctccaattctcagactccctgttgtcaaataagacaaacaacagtgtcttcctaccaagaacaggtgggaggagtgtgtgagatgatgaatacattgctgtaaaaaagtggcctgttataaagacagtttccttctgttctttcaacttgttcctcccacctcctctccatctttctaacatcctcttttatcatcttctctaacaaaggagggatctctttcccccctccctctttctccctatt

SEQ ID NO: 121184 - DNA, 601 bp, Human
ggaggcctccctcaaggtggtacccttcaccttgacctcttgggactctaccctctgatctcggggcctagacacccacttgccctttcctctccttacctgtgcaccacctccagctctctgctggaaagtcacttcctgtgggcaatctgtgagccccaacacttgggagttaggagtcccagagtcatgctgcctcaccctcttgtcattacattgtaaccagcagtttcatgcctgcccttccccccattaaacttagaggtgagggctgcattttgggagacgtagctggagctggatagagagttgactgttctggtgactaggtctggctcataggggagggttgtggtggagccttcctgggctgggtgtggataggcccagggcctgcaaggaaacgggaagctttgattggctgagggcaggcaactcttatggaagaagcactgaggaggagtcctacctcagggctcagtgtggacctgttggcacttttactgggtctcagtcccttttcctccacatgggatgcagagacctcctgcccagcttgaaacctaccttgctgggtgagccacataaaacaacttgtgct

SEQ ID NO: 121185 - DNA, 601 bp, Human
cttaccttccaaaaaacaaaaaaaaagagaaaaatctagcccaagtttaagaattgagaactggactaaattttttgttgctgttgttttctgcagtggtgactgagctcttcaaatggcttgccatttctcaaaatcatttacatccgtatttaggtagtaagacatagtttagatatttatactgtgttgtgctagtggctgttaacagtggaactaattttatggaaaaccaaatgtagttgatactacctctacctgctgtacagttttataattgctcttaggtaataatggtagygtagatagtatactgatatttgttttgcttagcttttggggaaaatcttattttttaaattatagggagtttgggtgttatggagagattgtatcaaaagctcttctggtattcatttaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggtgagttct

SEQ ID NO: 121186 - DNA, 601 bp, Human; identical to SEQ ID NO: 58853

SEQ ID NO: 121187 - DNA, 601 bp, Human; identical to SEQ ID NO: 58854

SEQ ID NO: 121188 - DNA, 601 bp, Human; identical to SEQ ID NO: 58855

SEQ ID NO: 121189 - DNA, 601 bp, Human; identical to SEQ ID NO: 58853

SEQ ID NO: 121190 - DNA, 601 bp, Human; identical to SEQ ID NO: 58854

SEQ ID NO: 121191 - DNA, 601 bp, Human; identical to SEQ ID NO: 58855

SEQ ID NO: 121192 - DNA, 601 bp, Human; identical to SEQ ID NO: 118844

SEQ ID NO: 121193 - DNA, 601 bp, Human; identical to SEQ ID NO: 118845

SEQ ID NO: 121194 - DNA, 601 bp, Human; identical to SEQ ID NO: 118846

SEQ ID NO: 121195 - DNA, 601 bp, Human; identical to SEQ ID NO: 118847

SEQ ID NO: 121196 - DNA, 601 bp, Human; identical to SEQ ID NO: 118848

SEQ ID NO: 121197 - DNA, 601 bp, Human; identical to SEQ ID NO: 118849

SEQ ID NO: 121198 - DNA, 601 bp, Human; identical to SEQ ID NO: 118850

SEQ ID NO: 121199 - DNA, 601 bp, Human; identical to SEQ ID NO: 118851

SEQ ID NO: 121200 - DNA, 601 bp, Human; identical to SEQ ID NO: 118852

SEQ ID NO: 121201 - DNA, 601 bp, Human; identical to SEQ ID NO: 118853

SEQ ID NO: 121202 - DNA, 601 bp, Human; identical to SEQ ID NO: 118854

SEQ ID NO: 121203 - DNA, 601 bp, Human; identical to SEQ ID NO: 118855

SEQ ID NO: 121204 - DNA, 601 bp, Human; identical to SEQ ID NO: 118856

SEQ ID NO: 121205 - DNA, 601 bp, Human; identical to SEQ ID NO: 118857

SEQ ID NO: 121206 - DNA, 601 bp, Human; identical to SEQ ID NO: 118858

SEQ ID NO: 121207 - DNA, 601 bp, Human; identical to SEQ ID NO: 118859

SEQ ID NO: 121208 - DNA, 601 bp, Human; identical to SEQ ID NO: 118860

SEQ ID NO: 121209 - DNA, 601 bp, Human; identical to SEQ ID NO: 118861

SEQ ID NO: 121210 - DNA, 601 bp, Human; identical to SEQ ID NO: 118862

SEQ ID NO: 121211 - DNA, 601 bp, Human; identical to SEQ ID NO: 118863

SEQ ID NO: 121212 - DNA, 601 bp, Human; identical to SEQ ID NO: 118864

SEQ ID NO: 121213 - DNA, 601 bp, Human; identical to SEQ ID NO: 118865

SEQ ID NO: 121214 - DNA, 601 bp, Human; identical to SEQ ID NO: 118866

SEQ ID NO: 121215 - DNA, 601 bp, Human; identical to SEQ ID NO: 118867

SEQ ID NO: 121216 - DNA, 601 bp, Human; identical to SEQ ID NO: 118868

SEQ ID NO: 121217 - DNA, 601 bp, Human; identical to SEQ ID NO: 118869

SEQ ID NO: 121218 - DNA, 601 bp, Human; identical to SEQ ID NO: 118870

SEQ ID NO: 121219 - DNA, 601 bp, Human; identical to SEQ ID NO: 118871

SEQ ID NO: 121220 - DNA, 601 bp, Human; identical to SEQ ID NO: 118872

SEQ ID NO: 121221 - DNA, 601 bp, Human; identical to SEQ ID NO: 118873

SEQ ID NO: 121222 - DNA, 601 bp, Human; identical to SEQ ID NO: 118874

SEQ ID NO: 121223 - DNA, 601 bp, Human; identical to SEQ ID NO: 118875

SEQ ID NO: 121224 - DNA, 601 bp, Human; identical to SEQ ID NO: 118876

SEQ ID NO: 121225 - DNA, 601 bp, Human; identical to SEQ ID NO: 118877

SEQ ID NO: 121226 - DNA, 601 bp, Human; identical to SEQ ID NO: 118878

SEQ ID NO: 121227 - DNA, 601 bp, Human; identical to SEQ ID NO: 118879

SEQ ID NO: 121228 - DNA, 601 bp, Human; identical to SEQ ID NO: 118880

SEQ ID NO: 121229 - DNA, 601 bp, Human; identical to SEQ ID NO: 118881

SEQ ID NO: 121230 - DNA, 601 bp, Human; identical to SEQ ID NO: 118882

SEQ ID NO: 121231 - DNA, 601 bp, Human; identical to SEQ ID NO: 118883

SEQ ID NO: 121232 - DNA, 601 bp, Human; identical to SEQ ID NO: 118884

SEQ ID NO: 121233 - DNA, 601 bp, Human; identical to SEQ ID NO: 118885

SEQ ID NO: 121234 - DNA, 601 bp, Human; identical to SEQ ID NO: 118886

SEQ ID NO: 121235 - DNA, 601 bp, Human; identical to SEQ ID NO: 118887

SEQ ID NO: 121236 - DNA, 601 bp, Human
agactgagtctcattctgtcaccaggctggagtgcagtggcaccatctcagctcagctcgttgcaacctccgcctcatgggctcaagcaattctcctgcctcagcctcctgagtagctgggactacaggcgtgctccaccacgctcagctaatcttttgtacttttagtagagacggggtttcaccatgctggccagaatgatttcaatctcttgacctcgtgatccgcccgcctttgcctcccaaagtgctgggattacaggcatgagccacgaagcccggcctcttttttttttttaawaaaaaaaaagagaaagaaaaatgtattctaatggtaacaactttctgaggaaatagcatcacaataataatcacctagtgcatgattctgcatatcactatataagcatcttttttttagttgatgtaagcacttctttttccaattttattaacaatgcaacttaaaatgtgttttagaaagtcagtttaacatttcctacacgtgagagctgatatatactatcagaacagaatgtgatataattatgcagttatttatgtaaattgagtttttcatttccagtaacatattaccacc

SEQ ID NO: 121237 - DNA, 601 bp, Human
gagactgagtctcattctgtcaccaggctggagtgcagtggcaccatctcagctcagctcgttgcaacctccgcctcatgggctcaagcaattctcctgcctcagcctcctgagtagctgggactacaggcgtgctccaccacgctcagctaatcttttgtacttttagtagagacggggtttcaccatgctggccagaatgatttcaatctcttgacctcgtgatccgcccgcctttgcctcccaaagtgctgggattacaggcatgagccacgaagcccggcctcttttttttttttawaaaaaaaaaagagaaagaaaaatgtattctaatggtaacaactttctgaggaaatagcatcacaataataatcacctagtgcatgattctgcatatcactatataagcatcttttttttagttgatgtaagcacttctttttccaattttattaacaatgcaacttaaaatgtgttttagaaagtcagtttaacatttcctacacgtgagagctgatatatactatcagaacagaatgtgatataattatgcagttatttatgtaaattgagtttttcatttccagtaacatattaccac

SEQ ID NO: 121238 - DNA, 601 bp, Human
tgagactgagtctcattctgtcaccaggctggagtgcagtggcaccatctcagctcagctcgttgcaacctccgcctcatgggctcaagcaattctcctgcctcagcctcctgagtagctgggactacaggcgtgctccaccacgctcagctaatcttttgtacttttagtagagacggggtttcaccatgctggccagaatgatttcaatctcttgacctcgtgatccgcccgcctttgcctcccaaagtgctgggattacaggcatgagccacgaagcccggcctcttttttttttttwaaaaaaaaaaagagaaagaaaaatgtattctaatggtaacaactttctgaggaaatagcatcacaataataatcacctagtgcatgattctgcatatcactatataagcatcttttttttagttgatgtaagcacttctttttccaattttattaacaatgcaacttaaaatgtgttttagaaagtcagtttaacatttcctacacgtgagagctgatatatactatcagaacagaatgtgatataattatgcagttatttatgtaaattgagtttttcatttccagtaacatattacca

SEQ ID NO: 121239 - DNA, 601 bp, Human
tgctttcactccaatcttatcttcaattcttttgatctcatccctgccttttatacttcaaatagctctatctcctctgtaattcagatcatccctggccaaattcagtttatttgttgaatgtcaatggagtcttggcatcctcatcaaaatgactactgtcaagaggctacttacaaacctggccacaagagtaaggagtctttttttttttttttttttttttttgagactgagtctcattctgtcaccaggctggagtgcagtggcaccatctcagctcagctcgttgcaacctccrcctcatgggctcaagcaattctcctgcctcagcctcctgagtagctgggactacaggcgtgctccaccacgctcagctaatcttttgtacttttagtagagacggggtttcaccatgctggccagaatgatttcaatctcttgacctcgtgatccgcccgcctttgcctcccaaagtgctgggattacaggcatgagccacgaagcccggcctcttttttttttttaaaaaaaaaaaagagaaagaaaaatgtattctaatggtaacaactttctgaggaaatagcatcacaataataat

SEQ ID NO: 121240 - DNA, 601 bp, Human
gcaaatatctaagttttgacgctaacagaatttaaagagaatgtatctaatttctaatgaaattttagaatttagaaattttaacagggaggtaaaataagcatgggggggctgctttcagaagaaatctaagttatcagggctaaaatttccagaagtcccctaataaaggtctttttaggtttaggtctgtttgacaacctttgcatttcacaaaatatcatacaaaaatgaaaatgcctataaatgaaattgtgctgggaactgcatatcaaaaatagagtgagttactgccttttamgagttcagaatttaccaaggacaaatggaaacttaacatatttcaagtcaacattatccctaggcacaaatgagtgagcattacccatattagttactcttgatctaatagcaaattcagaaaaacagtctcaccaaaaatgcaaaagtaatttaactgccattgatttatataccttgatttaagagagcataaaaatgaaatttaaaaagaatgcatcatttgaaaaaaccactaactcaaaatactaccagttaaatcataaacaggtatataacaacaaaaacaacaataagtgcc

SEQ ID NO: 121241 - DNA, 601 bp, Human
catatatttggttttctgttcctgagttacttcacttagaataacagtctccaattccatctaggttgctgcaatgccattatttcattcctttttatggctgagtagtattccatagtgtaccacattttctttatccactcgttgattgatgggcattccggctggttccatatttttttgcaattgcaaattgtgctgctatgaacatgcatgtgaaagtatcttttttgtataatgacttattttcctctgggtagatacctagtagtgggattgctggatcaaacagtagatctasttttagttccttaagggatctccacactgttttccatagtggttgtactagtttacattcccaccaacagtgtaaaagtgttcccttttcactgcatccatgccaacatctactatttttttattatggccagaatggccattactaaaatgtcaaaaaaacaacagatgttggtgaggctgtggagaaaaggggacacttaaacactgttggtgggatgtaaattagttcagccactgtggaaagcagtttggaaatttatcagagaatttaaaacagaactaccattcaactcagcag

SEQ ID NO: 121242 - DNA, 601 bp, Human
attactaatactattctctctgattccatttctaccttttcttaaggttcatacttttaaatttaatgcatccattaatttttacttagattcctcagaatgagcaattttgaaatgtactaactgaacttattctgtattttaagttcacagaaaatgataaaattattaaagatattggcacgcagttttaagaggtaaaccatcaacttgaccaagatttattctatatccttcgttatggaaagtacgaaattaacaaagacttaataggcaatcaactgactttagaaataaatcyccaaaggcccttctaaatgcagataatactcaaaataccttaaattcaagcttaaatgttttgcttgttgtaaggtatgcaatattcaagtccaatagtgttgtttctcaatccagcaataagtaataaaataaccaccacagaattcttctggcactaaatataatataagaaagtgaagtgcattgtttgccaacactgtaaagtttggtaacattcaatattattttatggcccactcacacaatttaattaaaatttcattttagtcaaatgtacaatataacattcctttttaaa

SEQ ID NO: 121243 - DNA, 601 bp, Human
aatgaaagtcacatttttttcaccacttcttaatagttttgtaccataattttagcaataagtatgaaattactaatactattctctctgattccatttctaccttttcttaaggttcatacttttaaatttaatgcatccattaatttttacttagattcctcagaatgagcaattttgaaatgtactaactgaacttattctgtattttaagttcacagaaaatgataaaattattaaagatattggcacgcagttttaagaggtaaaccatcaacttgaccaagatttattctatatycttcgttatggaaagtacgaaattaacaaagacttaataggcaatcaactgactttagaaataaatctccaaaggcccttctaaatgcagataatactcaaaataccttaaattcaagcttaaatgttttgcttgttgtaaggtatgcaatattcaagtccaatagtgttgtttctcaatccagcaataagtaataaaataaccaccacagaattcttctggcactaaatataatataagaaagtgaagtgcattgtttgccaacactgtaaagtttggtaacattcaatattattttat

SEQ ID NO: 121244 - DNA, 601 bp, Human
ataaacctgtacctgtgcaacataaatctgcaacaataaaattatttttaaaatttaaaaaagcatcaaggttcatggaaaaacagtacacaagatcagttatattacataatcgcaattatataaaaatctatttacagatttcaattaatagatacaaaatacttaaccatatagctttaattaaaacggcttcaaattctatcactttcaatattttaaggtaaatcctaacactaaatttaataacagaaaaattaagaacataaaacatatattactcataaaatgagttcacatmaactacagttcccaaattaaatagtggttgtttctaaaacaaattagcatacaagatctaggattaaaaaaagaaacacagagaacacctaagtgactataaaaacaggttttcatacatcatggaaataaaatcttagtaaatactctaatttctgcagggtcaatggaagacaacttcaagccatgaattttgtatatatctagattttgcaatgtatgctttatttcaaaattatatgtaagggaaataaatgggtatttccccctctttttccttattaaaagaaaatcatatata

SEQ ID NO: 121245 - DNA, 601 bp, Human
tgaactttgttcctatacagtgcttgtatctctgagattttttaaaaataatgcatgatggctactgataagtcactacagtgcccttattttcttactgatatcatcttcttcttgagaagaatctttaactgccatgtaaaccatcttctcccgctgcattcggctctggtcaagcactccagctactgaatgtccactggtgtactcactctctgtgacaatttctgttccaccttaaaaattaaaacacgcattaaaatagagaagtatcatggaataaccacctaaattaataagragaatatatagaaatatttcttagaaaaaaaataaattccaaaataaatttcaaagtgccaagaacattttcatataaattatactttaaattttcagctatcactgagaaatgacaattgttaatccttacatcaagcttatatgccaagcagtatataagtcttttatacatatttacccctttaaccctcacaacagccctataggtagcttttattattatgagaattttatggatgaggaaacagacagaagggggttaagtaatttatcaaaggtcactcagctaagtgacagg

SEQ ID NO: 121246 - DNA, 601 bp, Human
ccctacattacaattacagatacactaattaagttttaggagtaattaatcacataaaacattaatgcaagaactgaagttaatttagaaacatcttatctttgtttgtcctagaaaagcatagtttctcttcagatttgtttatgttgttggaattttcttccttttagaatagacattactttccaaatcacctttagagatgcatgtcttaatttattgttccccagtattaggataaatgaatgacttgaggggtagattagagctatggactcaccaaaaatcacagctaattccrtctctggcataaagtagctggaggtggcaatgagaaaggacaaatagtaggcaataaagaggagaaggaaggaaatgacagctttcagggctctcacatgggcttctgtgctggggtctctgcaccctgtggcactgagctgcattcgcctgatatgtctccgcagggagaggatcaagaggaaaaaggacattaggcacacacaaaaggggagcagcgttgccaggttgagaaataacttggtagaagcatgttgagttttatttactctgcaactccaagttaagtttgttttcctct

SEQ ID NO: 121247 - DNA, 601 bp, Human
tgatctcggctcaccacaacctctgccacccaagttcaagcaattctcctgcctcagcctcccaagtagctgggattacaggcacgcgccaccacgcccagctaattttgtatttttagtagaggtttctccatgttggtcaggctggtctcaaactccggacctcaggtgatctgcctgctttggcctcccaaaagtgctgggattacaggcatgagccactgtgcccagccttggcaaaataaactttctaaattgactgagacctgtctcagatatttggggttcactattatatgcrcacgcacacacacacacacacatatatgtatttgtttcttgagacagggtctccctctgtcacctaggctggagtgcaatggcatgatcatgggtcacagccccctcaaccttctgggctcaagtgaccctcccacctcagcctcctgagtagctggaactacaggcatgcaccaccacatctggctaattttcagttcaaatttcttttcttttttttttttttttgagacggaatcttgctctgtcacccagactggagtgcagtggcatgatctcagctcattgcaacctacccttc

SEQ ID NO: 121248 - DNA, 601 bp, Human
caggggtgagccacgtgcccagctctgtttcttatccatgtctaaccaggaagcccctacttcctgtcttaccagactgaaccaatttacaacttatacatattgattgatgtctcatgtctccctaaaatgtataaaagcaaactgtacccctgaccactttgggcacatgtctcaggactttctgaggctgtgtcatgggtgcatcctcaaccttggcaaaataaaccttctttctgggtttttttttttttttgagatggagtttcactcttgttgcccaggctggagtgcaatggcstgatctcggctcaccacaacctctgccacccaagttcaagcaattctcctgcctcagcctcccaagtagctgggattacaggcacgcgccaccacgcccagctaattttgtatttttagtagaggtttctccatgttggtcaggctggtctcaaactccggacctcaggtgatctgcctgctttggcctcccaaaagtgctgggattacaggcatgagccactgtgcccagccttggcaaaataaactttctaaattgactgagacctgtctcagatatttggggttcactattatatgc

SEQ ID NO: 121249 - DNA, 601 bp, Human
aaactctgtcaggagttgaggcgatccacccacctcagcctcccaaagtgctgggatcacaggggtgagccacgtgcccagctctgtttcttatccatgtctaaccaggaagcccctacttcctgtcttaccagactgaaccaatttacaacttatacatattgattgatgtctcatgtctccctaaaatgtataaaagcaaactgtacccctgaccactttgggcacatgtctcaggactttctgaggctgtgtcatgggtgcatcctcaaccttggcaaaataaaccttctttctgggtttttttttttttttgagatggagtttcactcttgttgcccaggctggagtgcaatggcgtgatctcggctcaccacaacctctgccacccaagttcaagcaattctcctgcctcagcctcccaagtagctgggattacaggcacgcgccaccacgcccagctaattttgtatttttagtagaggtttctccatgttggtcaggctggtctcaaactccggacctcaggtgatctgcctgctttggcctcccaaaagtgctgggattacaggcatgagccactgtgcccagccttggcaaa

SEQ ID NO: 121250 - DNA, 601 bp, Human
ctcagctcactgcaacctccaccttctgggttcaagtgattcctcccgggtagcgggattacaggcgcccaccaccacgattagctaatattttgtatttttagtagagacgggctttgactatgttggccaggctggtcttaaactctgtcaggagttgaggcgatccacccacctcagcctcccaaagtgctgggatcacaggggtgagccacgtgcccagctctgtttcttatccatgtctaaccaggaagcccctacttcctgtcttaccagactgaaccaatttacaacttatacrtattgattgatgtctcatgtctccctaaaatgtataaaagcaaactgtacccctgaccactttgggcacatgtctcaggactttctgaggctgtgtcatgggtgcatcctcaaccttggcaaaataaaccttctttctgggtttttttttttttttgagatggagtttcactcttgttgcccaggctggagtgcaatggcgtgatctcggctcaccacaacctctgccacccaagttcaagcaattctcctgcctcagcctcccaagtagctgggattacaggcacgcgccaccacgccc

SEQ ID NO: 121251 - DNA, 601 bp, Human
actaaattgtgtattcagtggaaagctgatcaagggctcaaagaaccttttgtctcttatctactgtttttttaatggcgcaatctcagctcactgcaacctccaccttctgggttcaagtgattcctcccgggtagcgggattacaggcgcccaccaccacgattagctaatattttgtatttttagtagagacgggctttgactatgttggccaggctggtcttaaactctgtcaggagttgaggcgatccacccacctcagcctcccaaagtgctgggatcacaggggtgagccacgygcccagctctgtttcttatccatgtctaaccaggaagcccctacttcctgtcttaccagactgaaccaatttacaacttatacatattgattgatgtctcatgtctccctaaaatgtataaaagcaaactgtacccctgaccactttgggcacatgtctcaggactttctgaggctgtgtcatgggtgcatcctcaaccttggcaaaataaaccttctttctgggtttttttttttttttgagatggagtttcactcttgttgcccaggctggagtgcaatggcgtgatctcggctcacc

SEQ ID NO: 121252 - DNA, 601 bp, Human
ctctgattgcttcctctcccctattgtttatgtaaagatgcagagtcatcgagccagactaaattgtgtattcagtggaaagctgatcaagggctcaaagaaccttttgtctcttatctactgtttttttaatggcgcaatctcagctcactgcaacctccaccttctgggttcaagtgattcctcccgggtagcgggattacaggcgcccaccaccacgattagctaatattttgtatttttagtagagacgggctttgactatgttggccaggctggtcttaaactctgtcaggagttsaggcgatccacccacctcagcctcccaaagtgctgggatcacaggggtgagccacgtgcccagctctgtttcttatccatgtctaaccaggaagcccctacttcctgtcttaccagactgaaccaatttacaacttatacatattgattgatgtctcatgtctccctaaaatgtataaaagcaaactgtacccctgaccactttgggcacatgtctcaggactttctgaggctgtgtcatgggtgcatcctcaaccttggcaaaataaaccttctttctgggtttttttttttttttgag

SEQ ID NO: 121253 - DNA, 601 bp, Human
gacaaatgcatctctgattgcttcctctcccctattgtttatgtaaagatgcagagtcatcgagccagactaaattgtgtattcagtggaaagctgatcaagggctcaaagaaccttttgtctcttatctactgtttttttaatggcgcaatctcagctcactgcaacctccaccttctgggttcaagtgattcctcccgggtagcgggattacaggcgcccaccaccacgattagctaatattttgtatttttagtagagacgggctttgactatgttggccaggctggtcttaaactcygtcaggagttgaggcgatccacccacctcagcctcccaaagtgctgggatcacaggggtgagccacgtgcccagctctgtttcttatccatgtctaaccaggaagcccctacttcctgtcttaccagactgaaccaatttacaacttatacatattgattgatgtctcatgtctccctaaaatgtataaaagcaaactgtacccctgaccactttgggcacatgtctcaggactttctgaggctgtgtcatgggtgcatcctcaaccttggcaaaataaaccttctttctgggttttttt

SEQ ID NO: 121254 - DNA, 601 bp, Human
agcttggagggggatccttccccgagcccagtggggggtggtgcctcccacacagaactgctcccacaccgacgtgactcagtttccccttagtcccccgcccgggccccatgcattagactggccccggccgcaggaagcggcgcaggcgccaatcggccccgccgcagccggcttagcggcaggaaggcgggggcgggggcggaggcaggggccagggccagcgggaggaagcacagcctggaccacgacccccagtgccctttgtggtcctcagcaggccccgggcgcccgcctggtscagcccaagacgccccgcgcggtcgtcgatacctgcttggcccggccagggcgctgctctgcgtcgggctccagggagcctcgttgggatcggccgccagtgttctgaccccgcccccacagccaccctccactttgagcgcgcggacgggggcggggcaccaggccacgccctcgtcgcgaccacgcccactagactttctccgctggtggaaagccccacccagctcttccgtcctgcccaatcaccaagtcccgtcgggcttagagctgagaggcctcgccgacccgggccctgcaa

SEQ ID NO: 121255 - DNA, 601 bp, Human
ccctctgggcccctccaggctgggcttgccttgggcttcctgacaacagctgcctgcccacccggcgcctgggtgggtctctcggggcaggcggatataggggcaggaagtccccaccccctcctgacccccaggccagtcagagatgccagccgacaggctggcctcacccactctgggcaggcaatttgttgtgtctcacaactggaccatacagctggagctgcagcctggtgaccagctgagaggcccaccagtggggttcagggggccaggcctaggccagcccttttcagctctrcagaccgcagccactgttggccatcccagcgtggggctgcattcttgggcttataaggcaatccccctgctacagggaggagccagcctccagctccacccacaccagggcaggctcttggaagctgaagttaagcccctagaatggagccctgtcctacacttctgcttggggtcaaaggccaccacatcctgaatgggaacagtggatgtgggtccttacataggctggggagagaccccttctacccacaaaaaatgtacgccatgctgtgcctcaattccaatccctgcttcacca

SEQ ID NO: 121256 - DNA, 601 bp, Human
ggagcaggacgtcaggtaggtttcagggctgtgtgagggctatgtagtgggacgtgtgtcatagggcaaccactgcctcactaccctgctggcggggcaggttccaggagaatgccatcaaaggacccctgagaagagcactgctggcctgcccaccctaacccccacgcccagctcctacagacagactccagcttgagcccctcctcaggccacgaccctctgggcccctccaggctgggcttgccttgggcttcctgacaacagctgcctgcccacccggcgcctgggtgggtctctyggggcaggcggatataggggcaggaagtccccaccccctcctgacccccaggccagtcagagatgccagccgacaggctggcctcacccactctgggcaggcaatttgttgtgtctcacaactggaccatacagctggagctgcagcctggtgaccagctgagaggcccaccagtggggttcagggggccaggcctaggccagcccttttcagctctgcagaccgcagccactgttggccatcccagcgtggggctgcattcttgggcttataaggcaatccccctgctacagggaggag

SEQ ID NO: 121257 - DNA, 601 bp, Human
aggccctgcatggctgagcttcctgacatggccccaccccccaacctgggtcctgctggccccacgggagatgactgggggcgtggaaactgccgagttggattccaggtcccactggggtagggatgggaagggcagcttctcctagcaatgtccagttagctggtgtgcggtctctagctgggagacgaggcagggctcccgcttctgaggcagctcctggggctcccctcatgccaggaagccatctgtgatggcagggcagggcccctttgccaggtaccccctcccactgaaaacraggacggcagggcccaaacagtccgaaccacgaaacacccccacaccccaaatgcaaaccaggtccacaaagatagaagacaggcagagcaagcagggctgagaatgtttattccatgcccaaggcagcacagacctggcagacagcagtaccacagggcaaagagggaaggcagtgtcagatgaacccaggtgggcggccagggccaggccagcaggaggctcaggccaggggcacgaaagggggggtgaggtaggcagaagctggaggcactaagggggtgccctgggcaggaggaac

SEQ ID NO: 121258 - DNA, 601 bp, Human
ggggtaggtagcgtgggattaagaatgggaggacccagcccaggtccctactcctactccagctgagaactgaatccttattccccccagtcgcagctgaggcaagacaggtgggcagacaggtggggctgggctgcaggatgggaaagccagggtcggacaggaacaggccacccaccggatgaccttgtggcactggtgacacacgggagtcttgccgttgttgctgccccctcctggcacccctccggcagctgcctgcacaatggaggtgcggctctgcagcggcgtgggcgtggcyggctggctgtgccgggtcagcactgtgctcgttttgtccggggcatagcgctcggcaaacgcagggtccacagcccagggcgggcggctggtagggctgggggcggtagggcctgccggggaaagtgactctaaaggggtgcccagggaccccaaaggacgggggtggagccccaggcagctgagagaagcccaccacccccatgcccctggaggctgcccacccttgcccaggcccgagcccactccctctcaccaggccagggctcctggggtgtagatgaggctggggctggggctt

SEQ ID NO: 121259 - DNA, 601 bp, Human
tttccacataggatagaagacaggcttgggaagtgaccgtggcagccgtgaagcttacagagccagtccgccacactgaactgctggtgacaggagaggcagctttagagcagggaggaccccgggaggaagggctgacgactggagcctcataaaagctgagccgcccctgggcaaaccctggagctgccctgtcctgctggcctgcctgttctacctggcaagagctgatagagtcggctgggcacagtggctcacacctgtagtcccagcactttgggaggccaaggcaggcctgagmtcacctgaggtgaggagtttgagaccagcctggccaacatggtaaaaccccgtctctactaaaaatacaaaattagccaggcatggtggcgggtgcctgtaatcccagctactcaggaggctgaggcaggagaatctcttgaacccaggaggcagaggttgcagtgagccgagatcgcgccactgcacgccaacgtgggcaacacagtgagactctgtttcaaaaaaaaaaaaaaaagagctgacagagatgagagcaggccaggcctgcgaattaggaaggctctagaatccggcacgc

SEQ ID NO: 121260 - DNA, 601 bp, Human
cgtcatagcatggtgggcagaagatggcgcccttctcctcaaagaagccaccctcttccaggaccttcccacactggctacacacaaactcctccgggtggtacgcgtggcccagcgccaccaggtagcggcccctgcagggaggcgagagcggtcagagggagcacacgcagagaggtgggggtcttggcccccttcaggttgactgaccacccaccaggaggccttgggagggacagttcattctccccattttccacataggatagaagacaggcttgggaagtgaccgtggcagccrtgaagcttacagagccagtccgccacactgaactgctggtgacaggagaggcagctttagagcagggaggaccccgggaggaagggctgacgactggagcctcataaaagctgagccgcccctgggcaaaccctggagctgccctgtcctgctggcctgcctgttctacctggcaagagctgatagagtcggctgggcacagtggctcacacctgtagtcccagcactttgggaggccaaggcaggcctgagatcacctgaggtgaggagtttgagaccagcctggccaacatggtaaaa

SEQ ID NO: 121261 - DNA, 601 bp, Human
gctggaggccagcaggtctgacctcgttcccacccgtctccgccactgctctcccttgcgttctcaccttgcctctgcacactggcctcttgcctgaaactggcacaccaggcacactcctgtcctgggcttgacaccggctgtcccctctgcctggactgctctgccccagatatctctaggctcacccctcacccccttcaagtttctgctcgaatgcagtcttctccatgagggcccactctgaccacaccagcagcagccagctgccttccctgcaccacgcaccccagcacttgtygctctgctctttcctgttttccgtaacgtgatctaacattacttccaggcaacctacttattgcgcttattgcttacagtctgcctctcccctcttcttccagccaaaatgtaaggcccagaagggcaggaagcatcaactgttttgttagctgatctatccccacagtgcctggccctttgtgggtgagtcgactggcctccacaggaggtgggaaggggcagaggcacaaggggctgagctctccctgggctgggctgttcatccctaggaccctcggggccagccggggccagccag

SEQ ID NO: 121262 - DNA, 601 bp, Human
ttaaagggggtgggcagcacatttgggggtgtggacatcaaacagatggaattttaatcaaaatacttaagcctttttaatgcacgagtgatacaaagctacctctagtctgtttgccttctgggaattacacaatatttaaaagatcacaatattaagaatttggaaataaaacacagatttagaaaagtatatttatgccaacccacccatttctgggtgtatttatggtaaaacaatgtcttgtctctcctctagtctcttggctacctatctccctccatccatctaactaaaatcsaaggaaagcaaattgccactatgatcatttccctaaagcggtcctcattcactttgcttttcttctctttcggaataaaagtctgtcataaatgtttaattaaatggaagtctttccactgttaatgactagctgtatgaaaggcttttcatttttttaaggagggggcgtgtgtgtgcatgtgtttaaaacagtccctattaatttcttgatattgattttctggctggggaagagcatatagtattcagcatagagctcctctgcagaatatgttaaagacagcggtttggattgaga

SEQ ID NO: 121263 - DNA, 601 bp, Human
gcctgtctctaacaggtggtcatgtatcttctcattcttcagcagactagttaatttcaaaagcagccttagaggcaaggacattttttttttctattcttattttcatcaagaggtgaatgaaaataatcacctcaggagacaaaaagccctaatgaaaaccagacagcaaaagagatcagaggaagacagggttgtttttcatctggagtcattagcggcatcttagaaagaagatgtgaaatctgttcgcaatttctccagattgggcagaaaacacagatcaagtggttaaggggtrgggggtggggggatcttttttgaaagtccaatttttcacacaaaagaaacacaagttgggggaacctcaagcactgacaacttgatctccatagagagcgaccccattctgagtgctcataaaagcaagcacactgacagcccccaaggactgtctacgccaacttccagaaacaactgaacttacagcctttggagatcagtgcagtctttgaaaataagaggcttacaatctccaaactacttcctaagtcgccaaggcccaacttcctaaggtggtcccaggcctgcaaagctccaa

SEQ ID NO: 121264 - DNA, 601 bp, Human
aaaataagggtggtggttttttccctggcccttctccctctccccctgtgcctgtctctaacaggtggtcatgtatcttctcattcttcagcagactagttaatttcaaaagcagccttagaggcaaggacattttttttttctattcttattttcatcaagaggtgaatgaaaataatcacctcaggagacaaaaagccctaatgaaaaccagacagcaaaagagatcagaggaagacagggttgtttttcatctggagtcattagcggcatcttagaaagaagatgtgaaatctgttcscaatttctccagattgggcagaaaacacagatcaagtggttaaggggtggggggtggggggatcttttttgaaagtccaatttttcacacaaaagaaacacaagttgggggaacctcaagcactgacaacttgatctccatagagagcgaccccattctgagtgctcataaaagcaagcacactgacagcccccaaggactgtctacgccaacttccagaaacaactgaacttacagcctttggagatcagtgcagtctttgaaaataagaggcttacaatctccaaactacttcctaag

SEQ ID NO: 121265 - DNA, 601 bp, Human
ctttctctccctctcttcttcgccctctctccccactctcctccctctttctctctctctcgatcacttggttgtcacatatcctcatgatgtttgcattcatctcagtaattttaagaatttctgcatcaatccattgataaatatttcttatgcgcttcctgtgtgcaaagtacctaaagaaagtcaaattatcttgggaattatggagcaatacttgcacagtgtgaaggcctgttagtaccttccagattcagcccacccatgctagaaggcaagcgtgtctgggaaaggctattgrctttcctaaaataaaagatgaatcctttttttttcctgcagaataagagagccatggctgagccgagcgtggagcactgtatcacctcgcaggccatcatgacttggaaaagatttgggaccattgagagagacacttcttgctcaaagagaacaaggatgtagagtggctggcagagcccctgtgagcaagcagcctggtgggggcaagaaaggagaagccactgatggatgaggagctcagatattcagcagagggaatttgacagcctggacagagagtaagatttctgttctgcct

SEQ ID NO: 121266 - DNA, 601 bp, Human
caaaatgaaaggacaaaatagaggcacatggtgagtttggcctgaagttcagcattagaaattgactgctgcatttccttagactcagctactcagctcacagggggcgtggaccagggcacagtcgtcgtcaccctgaaaggtgcaaagcagctcaagatggcagctaggagggaggggtatgcaggggagtcactgggttggaactcaggcttcttgagatgctcaggttgagtgctcagtgagggatgctcaacaagacacagaccagatgtaacagtgcttattagtggatataagygggaggccaccgtggctcgggtctactgcccagagcactctggaggcttgcagagggcacatgatagggggacaatgtagcccgatgagtcataaggggcctggattcaagttctggctctgccactgcctgccatgtgactttggtgtgttgttcattcctgtgtgcctcattcagctcacctggaaagaggaagcaagggcagggagtgtggtgtgaactgaccaggactccaggtagaggagccgggtttggctaacacggtgagaatggctaggaatgcaaggcctggctgtatgg

SEQ ID NO: 121267 - DNA, 601 bp, Human
aacagttgttggaaaagagcaaccatcacccttttcctcctcaagcaagttgctggtaaggccacattctgctctatgctgcttcctgagtcacggggcaggcaccagctgcatgctggagaaatcctctgggctttcttagcaccctgcctacgtttctccctgcagcaagatagctgaccgtcttcttttgattctaaggcacgtattttaagttgcaagatttttgaaattagagtgtattttataattaatgtggaacattaaatttgtccccctctcccctgaaggctgtttttgrtagacaggtcattttacaattagcggtgtcttagaactgagagaatatggaactgggagaataaagccttttatgtacccaggagaaaggactgggggctggctaggccatcgcagctcaccagcaatcccacagctagtgacatgcatttcctggcattggggagcacagttaacatctcttattcctattttcaaaaaatctggtgttataactgagcctcattcaaattgcagctgaaatcctcgataattctaactgattgtaaaatatgccaagaatctctctgaatttgtggga

SEQ ID NO: 121268 - DNA, 601 bp, Human
ggtcccctaaacacttcatgcttgttcacacctcttcctaggacagcacctggcaatggtagtaacttggtaaattttgttgaagaaatagatgagggaactcatgatctagaggaagacacaggaatggaaacaagcaacataaaagatattagatgctgggatctggaggaagcagaccccaggtgggagggagcagggtgggaggcagcagagagaggtgacaacttcactaagtcctggagacaaagtaggatgtggctgggaaaggggcctttgggcagaaggcaggggagagggrgtatctgtattcacttccgcaccttcacaaactgcaaggagactgatgtccttgcattttgagggaacttctgttttcaaagcagtgaggaaatctggcagtcccttcactattcccccaccctgccatggataagctcaaaatgctgaagacttcatcatgcaagggagtacaaacagcatttctgttcagcattgccctcaacatctgaaagaagtttatttatagacttgggagccaagagaaaatggaagatataattagtgtcatagaaggctgtacacaggttttggggttgga

SEQ ID NO: 121269 - DNA, 601 bp, Human
caagcagggatagggcccagggttacaaaaatctttttttttccccccaagggaaccaaaaatgtggatttttatgggaaagttttcaatttgtagaacatttgagggccaagcacaactcgcttgccaatcaccctttgcaactgctagcgtcataaataataaacacaccactggtaatgacagcacccgacatttgtcaagtgctcactgtgtgccggcacctcggtaagcactctacgtggagcatcccaccaaaatttcacaagcaattcaggagggagacaaaatgattatcccmattttacacgtgaaaaatagacttaggctatatttcttgtccaagggaacatagctcataagtgacaggggtgggatttgaacccaggctgtcagatgtgagctgacatgaactccaggcctcactgggaaagaatgcatcctgatgatgatgatgatgatgacgatgatgggaaaaatctgagattaaataggcatcctaatcccagatgtcaagctttgtgctatgtcttttttctatattcactcactcattcattcaacaaacattgagcaatctcaccgtataatcattgctttg

SEQ ID NO: 121270 - DNA, 601 bp, Human
cgttctttaaaagggagtagatgaggctagccttccacctgaatcttatcaacaggccctgctcaggaatgtgggatatttatgcatttatttacagatgcacggctttcttccctctgtctctgtgagctgctacgccctgtctgcgctggtgtcattttagttctgtcttcagctgtcaaaagacaaagactctacctctaatttgccataggcgtagaggaggatttgcaaacttcgacgcctacagaggccgggaaacggccacgcacggtggagcggagcagccatgtaagccacktaagacactcgggagcagtggggactcagggggaagtgcgaggcacctgccgcacggaagagacatctgctgcccagctcttgctgatggctgccaagcagggatagggcccagggttacaaaaatctttttttttccccccaagggaaccaaaaatgtggatttttatgggaaagttttcaatttgtagaacatttgagggccaagcacaactcgcttgccaatcaccctttgcaactgctagcgtcataaataataaacacaccactggtaatgacagcacccgacatttgtcaagtg

SEQ ID NO: 121271 - DNA, 601 bp, Human
aagccaaggcactaactaatttgttcctcccttcctccgtccatctttccatcctttctccttttcttattttgttcattattactactatttttgctgagatcctactatgtgccagcccctgccttagctatttaattctgactgattggcctatccccatttattcaccaagagcttgaggtgtgccaggcactgtgccggacagccggtcacagaggtaaatgtgacaccatccatgtctcaagggctttgccacctggttgaggagacagatacttgaaaacagagaagcacaagraagtgtctggatctttgccgacatctgaactggcagaggctgcaaatgtctgagggtggaggctctttggctttgaggctggcaggagaaaggggagagtggccaccactcctggcttggatgggcccctgtctaatcccttcaccatgtcaaaacggacaccagggcataccaagacaacagcaacagctcgctgccacaaccctcctcagatataaaggctcatctctaaggagatgaccctgtcacagagcaagtccagaagaaggaaaaacctccgtttcttggtgctgtttcagg

SEQ ID NO: 121272 - DNA, 601 bp, Human
cctgtcctctggtgctctgcaaagccgctgacttagacctggggtggcagctggcttcctttacccccatcgctctgcccccacctcacccacaccacacgttctgcctctggccatgtcctggtaaccctggtgtcaggcacctcggctgccgaggcccatcgggaagccccagaggcacagtgttctcaagccgaggacaggccttttgaaacagatctttccggcctggttcttatgttctcctgtgaactcagtcctcaggggaaggattccgctgttccgggaccaaggcggggaragccgcctaccctaggagcggctgattccacgggaagccaaggcactaactaatttgttcctcccttcctccgtccatctttccatcctttctccttttcttattttgttcattattactactatttttgctgagatcctactatgtgccagcccctgccttagctatttaattctgactgattggcctatccccatttattcaccaagagcttgaggtgtgccaggcactgtgccggacagccggtcacagaggtaaatgtgacaccatccatgtctcaagggctttgccacctggttg

SEQ ID NO: 121273 - DNA, 601 bp, Human
cacgctctttccccaccctgtgccacctcgctatgctgagcttctgccccccgtcatccttaccatggacccacctctggctcctgtcctctggtgctctgcaaagccgctgacttagacctggggtggcagctggcttcctttacccccatcgctctgcccccacctcacccacaccacacgttctgcctctggccatgtcctggtaaccctggtgtcaggcacctcggctgccgaggcccatcgggaagccccagaggcacagtgttctcaagccgaggacaggccttttgaaacagayctttccggcctggttcttatgttctcctgtgaactcagtcctcaggggaaggattccgctgttccgggaccaaggcggggagagccgcctaccctaggagcggctgattccacgggaagccaaggcactaactaatttgttcctcccttcctccgtccatctttccatcctttctccttttcttattttgttcattattactactatttttgctgagatcctactatgtgccagcccctgccttagctatttaattctgactgattggcctatccccatttattcaccaagagcttgagg

SEQ ID NO: 121274 - DNA, 601 bp, Human
atcccttgagctcaggagtttgagaccagcctgggcagcatggcgaaaccccatctctacaaaaattcaaaaaaatgagccggtgtgatggtgcacccctgtagtctcagctcctcaggaggctcaggtaggaggatcacttgagcccagtaggtcaaggctgcagtgagccaagattgtgccactgccctccagtctgggcaacagagcgagaccttgtctcaaaaaaaaaaaaaaaacaaagtaaaaaaagatatgtgtttgattaataacagtcctgatttaaaacaacagcactgtsttttgagccttcactcagtatgcaactcctttatacagattttattttaatttttataacacactgcttgagaagcatatttatttccgtttttgtgtgtgcatgtggtggacaggaaacagtggttcagagagatgaagcaccctgcccgaggtggcagagtgcatcaggattcaaacccaggtctgtctgatgcccaaactgggctctttctgctggatcgcgctgcccaatcaatccgggaagaaagtagggcaggaagtggttgggttctagggaaaatctattggtcctgagctg

SEQ ID NO: 121275 - DNA, 601 bp, Human
tgaatttaggtggtatagggatgaacatttaaatagctttaagctaagtattttgaaggcatgttaaaaatataactagtgaattgaaccagtgatttcttgggtactattgcttaggatgaggctcgatttaaacaggggatcgatttaaagatacatgtttgaggctgggtgcagtggctcacacctgtaatcccagaactttgggaggccgaggtgggtggatcccttgagctcaggagtttgagaccagcctgggcagcatggcgaaaccccatctctacaaaaattcaaaaaaatkagccggtgtgatggtgcacccctgtagtctcagctcctcaggaggctcaggtaggaggatcacttgagcccagtaggtcaaggctgcagtgagccaagattgtgccactgccctccagtctgggcaacagagcgagaccttgtctcaaaaaaaaaaaaaaaacaaagtaaaaaaagatatgtgtttgattaataacagtcctgatttaaaacaacagcactgtgttttgagccttcactcagtatgcaactcctttatacagattttattttaatttttataacacactgcttgagaagc

SEQ ID NO: 121276 - DNA, 601 bp, Human
agtgataaacgtttgactgcataaacaagaataataacaacacaattatttgggatcattattaaattgtgagaccaaatgaagccaacacaatcaaaattgaatagaaagtcagtagagagtcacaccctctaatttgtttgaagatgctgccctggtttattactgatgctcaatcatacagttatttaaaggaaatccagactgacaatattaataatggtgacaaatcttcccggcatggacggctctcactttcttttaattgaagggaagctatggaagtgttttccttcatttwaaaaaaatcttcctttttttttctctcaggccatctgtctggctattaaaatcccatcagcttcattgcgagaacgcttacttcccccatgcctgccatcccaaagggggctcttacagccaactagctcatgatcgctccgggccctccaaagggtaagtgcatttgctctcagcgcttcctttgcagcatcctgtctttctttcctggcatctcattgctgtatagacaagatattctgtgatttatttccaggcccccacattaatactctgaaattagtttatatccataattatg

SEQ ID NO: 121277 - DNA, 601 bp, Human
gcaggagtgaagccagtgaagagacggagtcccaaacccgactcccacctctgcccctgttagctgtgggactctggcaaatcgcttaatctctcagcacctccgtttcctcctctgcagaatgaggaagagaagcctaaaacagattttgcatggtggttgtggggataaaataaaacctttggtatacaggagggtgctcaataggtagtgtttttcttcccttcctttcctctccatcctctccttcttttcaaacatttcctttttatcttgtattcccctccccccaccccactcycgacttcttcccaggtttcttgattcaaatttagatatgctggctactcaatggtgacttgtatagaacctgaagttcttaggaggatggacactaaagaatccaataagtgataaacgtttgactgcataaacaagaataataacaacacaattatttgggatcattattaaattgtgagaccaaatgaagccaacacaatcaaaattgaatagaaagtcagtagagagtcacaccctctaatttgtttgaagatgctgccctggtttattactgatgctcaatcatacagttatttaa

SEQ ID NO: 121278 - DNA, 601 bp, Human
tggacttttcctacctggtgatagcataaggaagagcaactacatgattttttctctttgtgggaaaaggggcacatctttttattcagagtcgaaagtttttaaaaaggaagaagacagggaatttgaatctttgtcagcacctggctctttagcataatgatctgcacattgttgacatcctgtaaatgcttactgaattaaatttgagcatcagcctttgggcaggaacagaattaaatccattttttggggggcagccacttttattccaaatatatttttgggttacatttctaayttctcccaccctttccttttgtctcttgtcaaaactcatcacactggtgctgaagtaaagttgaccatttgtgtttggaatccattggctggactagggtttaaatccctgcaccaccaatgaccaacctgaaaaagaaatcacttgacttcttttggcttcagttctctcatctgtaccaccaccctgccatacagggtggttgtgggaactgaatgaaaaaataaggactatacagtagatcccagaggatccagcccatggtagctggaggcatggcatgtgtatgtttcctgtaga

SEQ ID NO: 121279 - DNA, 601 bp, Human
agcaccttagaatatagagaatgcttccaagccctcgcagagactggacttttcctacctggtgatagcataaggaagagcaactacatgattttttctctttgtgggaaaaggggcacatctttttattcagagtcgaaagtttttaaaaaggaagaagacagggaatttgaatctttgtcagcacctggctctttagcataatgatctgcacattgttgacatcctgtaaatgcttactgaattaaatttgagcatcagcctttgggcaggaacagaattaaatccattttttggggggcagccacttttattccaaatatatttttgggttacatttctaacttctcccaccctttccttttgtctcttgtcaaaactcatcacactggtgctgaagtaaagttgaccatttgtgtttggaatccattggctggactagggtttaaatccctgcaccaccaatgaccaacctgaaaaagaaatcacttgacttcttttggcttcagttctctcatctgtaccaccaccctgccatacagggtggttgtgggaactgaatgaaaaaataaggactatacagtagatcccagaggatcca

SEQ ID NO: 121280 - DNA, 601 bp, Human
taaagatctatctatcatctatctgttcatctctctgcctattaatcgatggatcattttcttttgcttgttggttgtatttccatggctcttcccttttagtttgtcttcatccctccaccttctttctgttggtttagtgcttagggcctaaaagtaactgatgcagcaccttagaatatagagaatgcttccaagccctcgcagagactggacttttcctacctggtgatagcataaggaagagcaactacatgattttttctctttgtgggaaaaggggcacatctttttattcagrgtcgaaagtttttaaaaaggaagaagacagggaatttgaatctttgtcagcacctggctctttagcataatgatctgcacattgttgacatcctgtaaatgcttactgaattaaatttgagcatcagcctttgggcaggaacagaattaaatccattttttggggggcagccacttttattccaaatatatttttgggttacatttctaacttctcccaccctttccttttgtctcttgtcaaaactcatcacactggtgctgaagtaaagttgaccatttgtgtttggaatccattggc

SEQ ID NO: 121281 - DNA, 601 bp, Human
aaacagaaaaattattctttttttattattctaagaatttgtatctttttcacgagtaagttagaagctaaagatctatctatcatctatctgttcatctctctgcctattaatcgatggatcattttcttttgcttgttggttgtatttccatggctcttcccttttagtttgtcttcatccctccaccttctttctgttggtttagtgcttagggcctaaaagtaactgatgcagcaccttagaatatagagaatgcttccaagccctcgcagagactggacttttcctacctggtgayagcataaggaagagcaactacatgattttttctctttgtgggaaaaggggcacatctttttattcagagtcgaaagtttttaaaaaggaagaagacagggaatttgaatctttgtcagcacctggctctttagcataatgatctgcacattgttgacatcctgtaaatgcttactgaattaaatttgagcatcagcctttgggcaggaacagaattaaatccattttttggggggcagccacttttattccaaatatatttttgggttacatttctaacttctcccaccctttccttttg

SEQ ID NO: 121282 - DNA, 601 bp, Human
atttatccactaggaaccagattacaatcagttatgcatatgaaatctactaaacagttttcaggtgaaagggtattaagttctatcaacgttggggactgatttgggtgaatagacttggaggcgattggttgagggaagactggagagagcttttgtagccttgctctcgtttttgtaactgttcctccctaggtcactgcccacttacgtgtgatggagaaagagcccactccagctctccctgttctcttaacttggctgagttttggtgacactcacggtggaacttggttagaaatagttgttgttttgaaaaattcagaatttttcttctaaaatgaagtaatacacgttaaaggttttggacaccgtgaagagttgttccaaatggtagttattcggatgataacaatccctgttatcatcacaagcaccatctctgctgccaccaccttcatcatcaccacctgcatcacaatcattatcatcaccatcaccaccaccttcatgatcaccaccacctgcaccatggctataattactaccaccaccatcagcatcactaccaccaccatcattatcaccaccatcaccgcca

SEQ ID NO: 121283 - DNA, 601 bp, Human
agcctcagcgaatgccctggaaaaatggtagggacctaatttccctgagctgcctgatggagcttgcctctctttctgcttcttctaatattgtgtgtgtgtgtgtgtgtgtgtgtgtgtgtgtgtgttttaaaaatcttttgtcagcagcaaattcatctgaaattgcagcaagaataatacttcggtgtcacctctactcttctctggttctaacaatcttacagtatcaaacagcccctgcttcagaagaaaaataataatgaatgacttaaaataactctgctgaagaaaatgaagktttgatttgaattgcagagggaacgactccctttttgtccccctctctcttcatttcctgaagaaggctttcagaatctgcaagatccttctgcattcaaagattctgagagtcaagaaaaaccagggccaaattatttgatctgaaagtatatttatccccatcattccaaaataccaccaaatatcacctaaggaataggaagcattggtgtgtgtccatctctattcttctctaagaagccttaagctttctcgggtccacgggaaaggatgcggtttccccaccactgcactgcct

SEQ ID NO: 121284 - DNA, 601 bp, Human
gggcttcggcctctctcttcagaggttcctgccttgatatgaggccctcacgtggacagagcactttacagtttacaaagtactttacagtttatgaagcactttacagtttatgaagcatgagttatcacgagtcagctctacttgtcacttccaggaagtgaaaacactcaggcaggcaggagaggcagcaatgtgcgtcaggagtggggacgtgcctttaattgagggcggccggggtgatttggtaacggggtcccctgtgactctctctcgatagcacgcaatcgctggtgtgccrcgggcagccgtccctcccgcatgatcaagtaagacacaggcctggtggtgcccatgcttggccaagtcagccctggccattgaagaggttgcctagttgggcccccaccctgctgaaggctgcaggatgatgctggtcccagctgacggtgccatgtggtgggctcagagccagcctgcactcttggctccaccacccctgagaagggacaggggtgaccatgggaaagcaacttcacctctcccacctcccacttcctcagcatggactggagataaactcattcctttcttatttcat

SEQ ID NO: 121285 - DNA, 601 bp, Human
acaatcatagagacagaatgcagaagcatggttgccaggggttgaggggcaggggggaatgaggagtcattgtttgcttgggacaaagttgtagttttacaagatgaaaagagttctgcaaacgggtggtggtgatggttgcacatgaaggtatctaatgccacaggactctacacttatagattgctgagatagtaaaggctatgttatgtgtattttaccacaataaaaaaaatagaaaaaaaaataaaaccaacaaacctatgagtggaggctcttcactgccttcagagggaaccayacttcctaacttcctagcctggcattcaaggtctctgtggctcttctagtttctctatcacggccacctctctccatcctgtcccccactagaccggatggcccacttcccctgccagcacgttgctctttcacattccaggccttgctcttctttctttctctgcaagaactgcttccccgccaccccacttgactcacacgcaacatgggatcaccattttttttttttttttgagatggagtcttgctctgtcacataggctagagtgcagtggcccaatcttggctcactgcaacc

SEQ ID NO: 121286 - DNA, 601 bp, Human
tcgctttagcctaggagtttgagaccagcctggaaaacatagtaagaccttgtctctacaaataatggaaaaaattagctgggtaaatagtggcatgcagctttggtcccagccacttagaaggctgaggtgggaggattgtttaagcccaggtgattgaggctgcagtgagctgtgatcatgccactgcactccagcctgggtgacagagtgaaacccagtctcaaaataaataaataaataaataaatactgtatgattcaacttacatgaggtccccagaatagtgacaatcatagasacagaatgcagaagcatggttgccaggggttgaggggcaggggggaatgaggagtcattgtttgcttgggacaaagttgtagttttacaagatgaaaagagttctgcaaacgggtggtggtgatggttgcacatgaaggtatctaatgccacaggactctacacttatagattgctgagatagtaaaggctatgttatgtgtattttaccacaataaaaaaaatagaaaaaaaaataaaaccaacaaacctatgagtggaggctcttcactgccttcagagggaaccatacttcctaact

SEQ ID NO: 121287 - DNA, 601 bp, Human
gtcaggtgcagtggctcaaacctgtaacactagcacttttggaggctgatgtgggaggctcgctttagcctaggagtttgagaccagcctggaaaacatagtaagaccttgtctctacaaataatggaaaaaattagctgggtaaatagtggcatgcagctttggtcccagccacttagaaggctgaggtgggaggattgtttaagcccaggtgattgaggctgcagtgagctgtgatcatgccactgcactccagcctgggtgacagagtgaaacccagtctcaaaataaataaataaataaataaatactgtatgattcaacttacatgaggtccccagaatagtgacaatcatagagacagaatgcagaagcatggttgccaggggttgaggggcaggggggaatgaggagtcattgtttgcttgggacaaagttgtagttttacaagatgaaaagagttctgcaaacgggtggtggtgatggttgcacatgaaggtatctaatgccacaggactctacacttatagattgctgagatagtaaaggctatgttatgtgtattttaccacaataaaaaaaatagaaaaaaaaataaaac

SEQ ID NO: 121288 - DNA, 601 bp, Human
agccagacaaaaagataaatactgtcaggtgcagtggctcaaacctgtaacactagcacttttggaggctgatgtgggaggctcgctttagcctaggagtttgagaccagcctggaaaacatagtaagaccttgtctctacaaataatggaaaaaattagctgggtaaatagtggcatgcagctttggtcccagccacttagaaggctgaggtgggaggattgtttaagcccaggtgattgaggctgcagtgagctgtgatcatgccactgcactccagcctgggtgacagagtgaaaccsagtctcaaaataaataaataaataaataaatactgtatgattcaacttacatgaggtccccagaatagtgacaatcatagagacagaatgcagaagcatggttgccaggggttgaggggcaggggggaatgaggagtcattgtttgcttgggacaaagttgtagttttacaagatgaaaagagttctgcaaacgggtggtggtgatggttgcacatgaaggtatctaatgccacaggactctacacttatagattgctgagatagtaaaggctatgttatgtgtattttaccacaataaa

SEQ ID NO: 121289 - DNA, 601 bp, Human
gagaggcttgttaacaggaaagagggctggtgaaggcaggccacagaagacttgggcagcctgtaggatttatttcccacacctccttgctcctctccaagcctccagcttctcttcccagtgtctgcctttcacatgcagccagaatgacttttctagcaaagtagagcctgatgacgagtgtgtgggccctggagtcaagctgcctgggttcgaagcctgctctgttccttcctatgttgtgtgaccctgggcagtttacttaacccttctagacgtccctttcctcatctccaagtgsggattgaagtagtgccagactcatagggttgtcacgaggattgatggccaatgtgcatgaagcaagtacacagtgcctggcacatagtaaatgctcagttagcgtgagctgctttcattattttaaatctgctcagactactcccctttttaaaacccatgagtgcaaaaaccaacaactcgactcaaaaatgggcaaacaacttgaacagacatttttccaaggaaggtgctagttaaaatgaccaataagcaagcacatgaaaagatgcttaatatcattaatcattaaggaaaagca

SEQ ID NO: 121290 - DNA, 601 bp, Human
gtaaagagaatagacccagaaaacattgatttttgagtttacaactcagctctgacgagggggtgcctggtggattgggagggtaggaccccatgaagggccaggctggtgcccagaggaagctggcgagagtgggagggcctgctagaaggacctcaggatggaggagagaggctgacagggagaggcttgttaacaggaaagagggctggtgaaggcaggccacagaagacttgggcagcctgtaggatttatttcccacacctccttgctcctctccaagcctccagcttctcttccmagtgtctgcctttcacatgcagccagaatgacttttctagcaaagtagagcctgatgacgagtgtgtgggccctggagtcaagctgcctgggttcgaagcctgctctgttccttcctatgttgtgtgaccctgggcagtttacttaacccttctagacgtccctttcctcatctccaagtgcggattgaagtagtgccagactcatagggttgtcacgaggattgatggccaatgtgcatgaagcaagtacacagtgcctggcacatagtaaatgctcagttagcgtgagctgctttcat

SEQ ID NO: 121291 - DNA, 601 bp, Human
cctattcattcattcaaaaatgcttattgatcgcctactcgatgagacgcactgttctagccactggggctccagcagtgaacaggatgagcaaggtccttgtttctctaaagcttacgctcattccactcgagagcgtccctgggtgccaggcccagcacagggttaatcacactaaggatgcattataatgcaaagaggatggacaccacctacacccctttccgggctagggatctaaatgccagggagatcaacctgtccaagacctcacactgggttgtggacctggaatctgaasctagatttgaggccgactgtctttctactcactgctcaaagccgactaacaaacccgagctgagagcggtggtgcagttggggaggaagcatctagctgaagtgtgctcaaataaggcatcgtctaattcgattatgcttgctagactgcaatgtaataaaacagagttttcatataagcatcatctcctaatgtttacagaacaaggaagcaaaattaagagaggaatttccagggagaaaagcatgtgttttaggctgatgtaaagagaatagacccagaaaacattgatttttgagt

SEQ ID NO: 121292 - DNA, 601 bp, Human
cacccatacacacacgcacagaatgagaaatggagaggcatattttgacattcttccattcatctctctgcctattcattcattcaaaaatgcttattgatcgcctactcgatgagacgcactgttctagccactggggctccagcagtgaacaggatgagcaaggtccttgtttctctaaagcttacgctcattccactcgagagcgtccctgggtgccaggcccagcacagggttaatcacactaaggatgcattataatgcaaagaggatggacaccacctacacccctttccgggckagggatctaaatgccagggagatcaacctgtccaagacctcacactgggttgtggacctggaatctgaagctagatttgaggccgactgtctttctactcactgctcaaagccgactaacaaacccgagctgagagcggtggtgcagttggggaggaagcatctagctgaagtgtgctcaaataaggcatcgtctaattcgattatgcttgctagactgcaatgtaataaaacagagttttcatataagcatcatctcctaatgtttacagaacaaggaagcaaaattaagagaggaatt

SEQ ID NO: 121293 - DNA, 601 bp, Human
tttataccttgctgctcccctctggaccacatggctaaatgcatcttcccacccttcctcccctatggctggacattacatgagggtggctggcaaaacctatattatgcaagcctaattccactgacttagtgagtcaggaattgcaaggtacatataggggagaggaacataactgaaacgtttatagtaaggatttaagagccaagagggtcagacacacacacacacccatacacacacgcacagaatgagaaatggagaggcatattttgacattcttccattcatctctctgccyattcattcattcaaaaatgcttattgatcgcctactcgatgagacgcactgttctagccactggggctccagcagtgaacaggatgagcaaggtccttgtttctctaaagcttacgctcattccactcgagagcgtccctgggtgccaggcccagcacagggttaatcacactaaggatgcattataatgcaaagaggatggacaccacctacacccctttccgggctagggatctaaatgccagggagatcaacctgtccaagacctcacactgggttgtggacctggaatctgaagct

SEQ ID NO: 121294 - DNA, 601 bp, Human
cactcacgatatgtttctagaataataagagttaaaaaaaaaagagagagagagagacagaactcagtgaagtatctcaggatcccatcctcctccatggtttaagataagttctcattaggagcccaagccctttgagaggagacccttgcccaagtcggtctacgggtgggtgcctggtccggtgcctggcatggaggacgtgctcagaaaacacggatttgaccagtagctgtttttcccctttgagcgtgatcacttagggagttctgctttttgtgaaccaagactacttggggayctccgagtcaaaaggtctttggttttcgccaaggggtacttcgaggaaagggccacccctaccctctatactcagggaaattggatttctgatgactgctgcacacacaagcaagcaataaaatgacaaagcaatattaaagttcaagcgctcagcatacccatcttctccaggcatcctgagtttttttctttttagagcaaaaccctgcaatattaataaatgacagagagagaaggatagaaaaacgactctttccctttgacatggtgaagatcacaggaactagagggaccttta

SEQ ID NO: 121295 - DNA, 601 bp, Human
gccatgtacgtcggaggcagtacccgatggggtgtgactctctgtagctcctccaagcacctggggagcaacatttacatgcagcctcctgagatcgcatgttagatggaatcatatttatttcttccttagtcggagattacacggtgaagtgggagaagtgtggacttgccctcccatcatggccatttctgggctgagtgacatgggacaaatcatccaacttctctcatgcttatgggaatgggatgtcaggaggttcagtgtggacttgaaccgtgtggggcctagggtgtgccaytgaaaacagaaccctgctctgttcctaagagcatcgagcatattaagcgatcctgtcatcccaaatctgttttgtcggaggcctccttggtgaagggccacagcatctgaggtggaaggcagagtagtttttgtaattggctccattgcatgtcaacaaatgaaagggtaaccgagactgacagtcccctagctgtggggggaccttgtccagaacctgtcacaggacgaaagctctaggattggaggcaaggtggcctcatgggcctgggaagcaggctgcctggatttgaacaatgtc

SEQ ID NO: 121296 - DNA, 601 bp, Human
ttactatctcagggcttctaagtgttggggtgggatttaagcctgtcttcctcatccatctctttttaaattccttccgtcctttattcaacacatctgtatccagcccttgcccaggtgctgggtacactgcagggaccaaagcaggaatgttcctgccctcagggagctttcaatctgtgggcatgatgacagtgaacaaagtaacaaaccataatgtaatcacagagggcaatagtgctccagggggaataggcggggtgtggggacagggcaagagtgtgcggggaagggactccttaggttgggtggtcaggactggctccctgcagagactgaagataagatggagcctggtattggggtggggacagcaatgacgctgggagggaaggaaggggtgtgcaggttataggagccgagggagcgccagacggtggctctccgaagtgtatgtatgccctttcactccagcatgtggcttggcaagagaagcattggagtcagaggaggaaataccacattacacagtgggtaggaaactgactgcccttagaagtctaagacggtgtgggctgaaaataccaactgcttcccgcta

SEQ ID NO: 121297 - DNA, 601 bp, Human
aggctggagtgcagtgcttcgatcccagctcactgtagcctcgacctcccaaggctcaagaaatcctcctgcctcaacctcctaagtatagctgggactataagcatgtgccaccacacccagctaatattttttttaaaaaaatagacatgggggtctcactgtgttgcccagtctggtctcaaactcctgggcacaagcaatcctcccaccctggcctcccaaagtgctaggattgcaggtgtgacccactgcacctagcccattctatttatttttattttttgtagagatgggggtstcacttttttggccacgctgatcttgaactcctggcttcaagtgatccttctgcctgggcctcccagaatgctgggattttaggcatgagccaccgcgcctggccctctttgccattgtaaaacaccacaggcacactcctgcctcggggcctttgcgttagctgtttcctctacctgagtcacctttctctagatatctgctatttattgttctttagatattatttgtcattcatctccttcaggtatttattcaaatattactttcttactaaagtcttccctgttcactctatata

SEQ ID NO: 121298 - DNA, 601 bp, Human
caaatctgggccaggtgcggtggctcacacctgtaatcccagcactttgggaggccagggcaggtggatcacctgaggtcaagagtttgagaccagcctggccaacatggtgaaaccccgtctctactaaaaatacgaaaattagatgggtgtggtggcaggctcctataatcccagctactcgggaggctgaggcaggagaatcacttgaacccaggaggtggaggtttcagtgagccaagatcatgccattgcactccagcctgggcaacagagcaaaaactccatatcaaaaaaaaaatgcaaatctgattacatcaattctgagaatcttctctagctaccctgcctttcttcctggtccttcattatctcaatttgctgtcccacctcaggactttgcacaccctgttgcctctggctggaatgctctttccttgctccccttttacatagttaccaggtcatccctctctctccaggctagttaagccttgagtcacacactctcctagctccctgtgtttttccttcacagtgcgtagcacagtttgtagttgtgtgtgtgtgtgtatgtgcacacatgtgcatacgtgtgtat

SEQ ID NO: 121299 - DNA, 601 bp, Human
cttccttccctttttgtctttctcttctttctttctctctctttccttccttccttcctcccttcctcccttccttttcttccttccttctctctctctttctctgtctctctctctccaataaatatttcctaagccccaactatatgctgtgccctatcctagtcctttgggatatagaaatgaacaaaatagacaaaactctttgcttatttgggacttacattctaatgatctacatctatctgtctgtctgtctgtctatctatctatctatctatctatctatctatctatctaaccatcatgtgcagtgacctgaaatgacacagataatacaatcacaaaacaaaggatcaaagaatatgctaatcagaagggaaggtcaggactggaggagaagtaaagaaacaccaatgggcaggtcttagcatctcacagtgttgctaatgctactctgtgcaaccgaagctccctgacagccaaagcagagagggaacgtatgtcagttacatgaatcttattgttcaagaaggggcatcaccacagtccctatttcttctcatgataaaatgtgttttctaaccatattaccttattt

SEQ ID NO: 121300 - DNA, 601 bp, Human
ccctctcctttctttctccttccttccttccttgcttccttccttccctttttgtctttctcttctttctttctctctctttccttccttccttcctcccttcctcccttccttttcttccttccttctctctctctttctctgtctctctctctccaataaatatttcctaagccccaactatatgctgtgccctatcctagtcctttgggatatagaaatgaacaaaatagacaaaactctttgcttatttgggacttacattctaatgatctacatctatctgtctgtctgtctgtctatctatctatctatctatctatctatctatctatctatccatcatgtgcagtgacctgaaatgacacagataatacaatcacaaaacaaaggatcaaagaatatgctaatcagaagggaaggtcaggactggaggagaagtaaagaaacaccaatgggcaggtcttagcatctcacagtgttgctaatgctactctgtgcaaccgaagctccctgacagccaaagcagagagggaacgtatgtcagttacatgaatcttattgttcaagaaggggcatcaccacagtccctatttcttct

SEQ ID NO: 121301 - DNA, 601 bp, Human
aaagtgtggcattcccaagatccatacttgatccctccagaggacttgtgttattaaaccagagagcagagcaggttctggctggcaaggacccagggattaacgtccagggcgttaacatcataattgggccagccttgaaggcagcaacatctgctgtgtgaggctctggtgccagagcccatgttgcacctcctggctggctagggcctttgtcttgggaagtggcctgggtggccttaagactgcatttacttagcacatgctcaatagctactgtcaggtggtgaaaagctctcaktagggccaagaaattgacttgtgtcctgggcttctcagaaaaacaatggggacccatgggagaggctttgtgcctgaaggtgcccagggactggtaattgagttactgttcaagtgatgagagactgtggccactgacgagtattagtggaacaaggttggcaggctgttgcaagccttcctagcaaggccagcctgcattttctctttggcatggagtatatggggattcattttctttaaaaatgtttacgtaggcagtagagcccagtgatcaggggggcagcttggaagtcgggct

SEQ ID NO: 121302 - DNA, 601 bp, Human
tacccggccctcttgagctctttaatgggcaaaagatgcaggatgcagcaactcggtacacgtgtgagatgagagaggcgaggacaagggagctcctgttccctgggttctggaagttcacagatggtgttttcatccactgcaatgcagtggaggaaggtgaagaaggcgagttcagttatggactcagatgtaggagatgtggtgtgtcacttccctggggtgcatgtgacccttcctcccttctcacaggacactgatcttgtgaaacaactgcctctcagcccccacctctgtgtcrgcagtgtccttcaggggaagctggccccaccctagccccaggatggtcttcctgtccaggcaggtaacctatccctgagcaataattagcatgaagtggtcctgtgacccacttgggccaaagagacaggaggaaaggttttctggggccttctgagaaagtatcttccttgtttttatctaaaagcatccagagtgactctctctggtcctttgtggatgtgtggccccaaggcactgtcctgtctcactctcagcctcaggatagcaagagaaacaggcaaactagctggaactgccc

SEQ ID NO: 121303 - DNA, 601 bp, Human
aaagcgaagcaacactgtcgggtattatcttttgagacatgagcttccagtgtagatgtttgcatggaaggatgtggtgggaagcagagagatgaaatgaattaagatgctgttgtcatagcccaggcagagttggtgatagcctgagtaaggcgggatggagagatgtggacagattcttgagctatttgtttatttattgagacagagtcttgctctgtcacccaggctggtgtgcagtggtacgatcttggctcactacaacctccgcctcccaggttcaagcgattcttctgcctcrgcctcccaagtagctgggtctataggtgcctgccaccacacttggctaatttttgtatttttagtagagacggggtttcactatgttggccaggctgttctcgaactcctgacctcgtgatccacccgcctcggcctcccaaagtgcttggattacaggcgtgagccaccgtacccggccctcttgagctctttaatgggcaaaagatgcaggatgcagcaactcggtacacgtgtgagatgagagaggcgaggacaagggagctcctgttccctgggttctggaagttcacagatggtg

SEQ ID NO: 121304 - DNA, 601 bp, Human
tttcggttccatggatgtgtgccatataataaatgtcctcagcttggtgtgtgtttctggcatgaaactgtcaagaactcccctagaaagctctgattgtttgggttcactggcaggaaagtgtgaatcctgctgttccttctaggtggatataataagcccctccaacccccactgcttttttcttttgaaatgaggggtaaagacaacaataaaagccaagaatccttaaatctcaggagagagtggagaggtgaaagaggatctgttttatggtgcaccttcaataaaaaagatttasaggtaagtcattttctcttctttctaggcactagattgagaggattcagggaactaaaccccagggagagcttggcataaataaaaaaaaactgacaactgtcaaaacagatagcaaccaatcagaaatacaatgttgagggaggctccagttccaaaatgattcagagaagtgtttgcttgttacggcaagaataaggacttaggggaacattgggagggaattaggatgctcttcaaaatcccaaacttggagactgattgagtgagttgggtaagacggatctgattttatatctta

SEQ ID NO: 121305 - DNA, 601 bp, Human
cgaactcctgacctgagatgatccacgcgcctgggcctcccaaagtgctgggattacaggcgtgagccaccgcacccggcgacacctttaaaattagtatcagttgcagactaactgtgagctccaaattctaaccctatttctgatgctgacttgttttagtctctgaaagagtcacttaaatgttcgatccaagcttgcttctccggcaaagcataacagcattgacctacctcattcttgactacttctttttttttcctctcttttaaaagaatcatctgatccataccaccatttsttatttttatcctcttcttcttccttcctcttcctccttcttcccgctcctcctctaataattggacaaaatgtaagatcagagaatagatactgtcagggtttcattggtctgttctcttctttatcagtgaagaccatatttatgagatctttgtggatttccctgcaaaggcaagctgagaaccttaaacaactagggaggagctttttaaagagtcgagtcatattttggtttctgtctcttcaatggtttgcttttgggagattttccagctctaatgttaaaaggtgtcacttt

SEQ ID NO: 121306 - DNA, 601 bp, Human
ttaaaatagtttctgtatacagaggagagaacgctggatagagagtctgaaaatgcattctggctctcccactaacttgctgtgtgaccttggacaagttgcatccactctctgggcctcatttcaatcgagggttggatgagatggcctttcttcactctataatttggtgatcacattctgccttgaggttgtttgtatgtcctcccacccccattctcttgttggagggcagggtccttcagggcagggcactgctaccccttctttgctttggttggtgtccccagggtctagatarcaccctcacaaactctgtgttcagtaagtattgtccagcgaatgaacgatgcttccaagtatgtagtaggctgcttgattctgcaaactgtaatgtatcacatccagatcatcaccgatgatagcagctaatttgggtttttaaaaggaaactgtattatgctttgtctgacttgataaagtagctcagctttggagaaatcgtgtttatctttaactacagtttaaaaaaataatttttcataaaaccttcagaagataatttgactgtatgtgcttttctacctcaagtcattttctt

SEQ ID NO: 121307 - DNA, 601 bp, Human
gattaatccttggggtcccttccagatgtaacattctttgaggttagggtcctaatgtaaaaggtgtcaataaggcatctctgaggctccaccaggctttgtgcaatccctggcaggagaatgcaggacgtttcaaaaattaaaatagtttctgtatacagaggagagaacgctggatagagagtctgaaaatgcattctggctctcccactaacttgctgtgtgaccttggacaagttgcatccactctctgggcctcatttcaatcgagggttggatgagatggcctttcttcactctrtaatttggtgatcacattctgccttgaggttgtttgtatgtcctcccacccccattctcttgttggagggcagggtccttcagggcagggcactgctaccccttctttgctttggttggtgtccccagggtctagataacaccctcacaaactctgtgttcagtaagtattgtccagcgaatgaacgatgcttccaagtatgtagtaggctgcttgattctgcaaactgtaatgtatcacatccagatcatcaccgatgatagcagctaatttgggtttttaaaaggaaactgtattatg

SEQ ID NO: 121308 - DNA, 601 bp, Human
agctgggtgtggtggcatgtgcctataattccagctacttgggaggctgaggtaggagaatcgctcgaaccagtgagttggaggttgccgtgagccgagatcatgccactgcactccagcctggcaacagagtgagactctgtctcaaaaaaaaaaaaaaaaaaaaaaaaaaaaagaaccacagattaatccttggggtcccttccagatgtaacattctttgaggttagggtcctaatgtaaaaggtgtcaataaggcatctctgaggctccaccaggctttgtgcaatccctggcaggrgaatgcaggacgtttcaaaaattaaaatagtttctgtatacagaggagagaacgctggatagagagtctgaaaatgcattctggctctcccactaacttgctgtgtgaccttggacaagttgcatccactctctgggcctcatttcaatcgagggttggatgagatggcctttcttcactctataatttggtgatcacattctgccttgaggttgtttgtatgtcctcccacccccattctcttgttggagggcagggtccttcagggcagggcactgctaccccttctttgctttggtt

SEQ ID NO: 121309 - DNA, 601 bp, Human
gagtctgcccccggtgacttcgttagctggtaattgacacagaaagactgagactgaaagagtgagggttgagccactgaaagggactcagctgagcatctagggggaattgcttaaaaactgacaataatgatgatgatgatgacgatggtaataaaaatgataatgataactactattagtatcattcattaagacatttgtgggccagtgtgcaaaatgctctacagcaaaatttcattgagtcctcttgtcatcccaattattatttctgctgtcaggatggagagactggggttcrgtctcattaaccccaataatgctctgtgtgaccttgggcaagttgcttgacttctctgggcctccaagacggggttggtctcaaagttcttgaagggccttttggcttgcagattctagactgtacagttcctaagcggcgactcctcacctcatctcattaatatgcatctgttcttacagccttagggatcccaagagaggggaccttgttgcctttgagcttcagatatcaggggaccagattccctggaattcatgatttggaattctagaatcatttctaaatcatgcagcacca

SEQ ID NO: 121310 - DNA, 601 bp, Human
aagagtgcctggccagagtctgcccccggtgacttcgttagctggtaattgacacagaaagactgagactgaaagagtgagggttgagccactgaaagggactcagctgagcatctagggggaattgcttaaaaactgacaataatgatgatgatgatgacgatggtaataaaaatgataatgataactactattagtatcattcattaagacatttgtgggccagtgtgcaaaatgctctacagcaaaatttcattgagtcctcttgtcatcccaattattatttctgctgtcaggatgragagactggggttcagtctcattaaccccaataatgctctgtgtgaccttgggcaagttgcttgacttctctgggcctccaagacggggttggtctcaaagttcttgaagggccttttggcttgcagattctagactgtacagttcctaagcggcgactcctcacctcatctcattaatatgcatctgttcttacagccttagggatcccaagagaggggaccttgttgcctttgagcttcagatatcaggggaccagattccctggaattcatgatttggaattctagaatcatttcta

SEQ ID NO: 121311 - DNA, 601 bp, Human
aggatttcaactcagttctgtttatcaatctatgctcattccactgcactaggttttctcaaatttgagtggtgtagggatgtattaaatgaatataattctgatggcaccacaggatgacagagtttaaaaaattctgaggtttaaaatgtaaaaacattatcactaggtgcaaatttcttacgctcacgctcacagctctcatacaattgtcaaaattaccaaggaaatacagagttgcagtactaataaaagtcaaatgaacaatgttgattgaatgcgatgggtgatgttttgccgragtgtctattgagttcactacgctttgtccaatatgtaccaagtgttgactctgtttgtctgctaatgttttcagtttgaattatcttaagaccctcatacataaagaccaccgtaatgtcatttgacatcagttgacagtagtcccatcatccaccttgcctctgttcttttctccttagtcaatgataatcaaggcggtaaagttcctgcccaatgatgctgcctttgtgatgtaagatcaaagtctcaatttgtccaataacttaagaagtgaaagtgctattctacgagtctgact

SEQ ID NO: 121312 - DNA, 601 bp, Human
gagtgcctactacatgtctggcactttccataaaatagcttttgaaattctcacagccaaattgtgtggctaatgttattatttctactcagatgaggaaaccgagacccagaaaggtgaagggatggcccaagatcgcagtgtttctatgtggcagaggcaggatttcaactcagttctgtttatcaatctatgctcattccactgcactaggttttctcaaatttgagtggtgtagggatgtattaaatgaatataattctgatggcaccacaggatgacagagtttaaaaaattctgwggtttaaaatgtaaaaacattatcactaggtgcaaatttcttacgctcacgctcacagctctcatacaattgtcaaaattaccaaggaaatacagagttgcagtactaataaaagtcaaatgaacaatgttgattgaatgcgatgggtgatgttttgccggagtgtctattgagttcactacgctttgtccaatatgtaccaagtgttgactctgtttgtctgctaatgttttcagtttgaattatcttaagaccctcatacataaagaccaccgtaatgtcatttgacatcagttgaca

SEQ ID NO: 121313 - DNA, 601 bp, Human
agaacagggcaggaaattaacttttagggagtgcctactacatgtctggcactttccataaaatagcttttgaaattctcacagccaaattgtgtggctaatgttattatttctactcagatgaggaaaccgagacccagaaaggtgaagggatggcccaagatcgcagtgtttctatgtggcagaggcaggatttcaactcagttctgtttatcaatctatgctcattccactgcactaggttttctcaaatttgagtggtgtagggatgtattaaatgaatataattctgatggcaccrcaggatgacagagtttaaaaaattctgaggtttaaaatgtaaaaacattatcactaggtgcaaatttcttacgctcacgctcacagctctcatacaattgtcaaaattaccaaggaaatacagagttgcagtactaataaaagtcaaatgaacaatgttgattgaatgcgatgggtgatgttttgccggagtgtctattgagttcactacgctttgtccaatatgtaccaagtgttgactctgtttgtctgctaatgttttcagtttgaattatcttaagaccctcatacataaagacca

SEQ ID NO: 121314 - DNA, 601 bp, Human
aaaacaaaaaacaaaaaacaaaaagcaaacaaacaaaaaaacaaaacaaaagccttagagaacagggcaggaaattaacttttagggagtgcctactacatgtctggcactttccataaaatagcttttgaaattctcacagccaaattgtgtggctaatgttattatttctactcagatgaggaaaccgagacccagaaaggtgaagggatggcccaagatcgcagtgtttctatgtggcagaggcaggatttcaactcagttctgtttatcaatctatgctcattccactgcactaggwtttctcaaatttgagtggtgtagggatgtattaaatgaatataattctgatggcaccacaggatgacagagtttaaaaaattctgaggtttaaaatgtaaaaacattatcactaggtgcaaatttcttacgctcacgctcacagctctcatacaattgtcaaaattaccaaggaaatacagagttgcagtactaataaaagtcaaatgaacaatgttgattgaatgcgatgggtgatgttttgccggagtgtctattgagttcactacgctttgtccaatatgtaccaagtgttgactct

SEQ ID NO: 121315 - DNA, 601 bp, Human
cacctataatcccagcactttgggaggctgaggcgagaggatcatgaggtcaggagatcgagaccatcctggttaacatggtgaaaccccgtctctactaaaaatacaaaaaattagctgggtgtggtggtgtgtgcctatagtcccagctacttggtaggctgaggcaggagaaccacttgaacctgggagtcggaggttgcagtgagccgagatggcaccactacactccagcctaggcgacagagcgagactctgtttcaaaaaacaaaaaacaaaaaacaaaaagcaaacaaacaacaaaacaaaacaaaagccttagagaacagggcaggaaattaacttttagggagtgcctactacatgtctggcactttccataaaatagcttttgaaattctcacagccaaattgtgtggctaatgttattatttctactcagatgaggaaaccgagacccagaaaggtgaagggatggcccaagatcgcagtgtttctatgtggcagaggcaggatttcaactcagttctgtttatcaatctatgctcattccactgcactaggttttctcaaatttgagtggtgtagggatgtattaaat

SEQ ID NO: 121316 - DNA, 601 bp, Human
acctttctctagtcctgacaagtcagaaagaatgaaatggacacagtcaggcaagaattgatgatattggatgtggctgctatctctggtcttgcctccacttttgaaaggaaggagagagacaacagaatggcctgcagatgggaataaaacttagagaagggccaggcacagtggctccacctataatcccagcactttgggaggctgaggcgagaggatcatgaggtcaggagatcgagaccatcctggttaacatggtgaaaccccgtctctactaaaaatacaaaaaattagctgsgtgtggtggtgtgtgcctatagtcccagctacttggtaggctgaggcaggagaaccacttgaacctgggagtcggaggttgcagtgagccgagatggcaccactacactccagcctaggcgacagagcgagactctgtttcaaaaaacaaaaaacaaaaaacaaaaagcaaacaaacaaaaaaacaaaacaaaagccttagagaacagggcaggaaattaacttttagggagtgcctactacatgtctggcactttccataaaatagcttttgaaattctcacagccaaattgtgtggct

SEQ ID NO: 121317 - DNA, 601 bp, Human
ggcagctgtatggcctaagcgccggctctacctctctgccttcctgttagccaccagggcttacctttctctagtcctgacaagtcagaaagaatgaaatggacacagtcaggcaagaattgatgatattggatgtggctgctatctctggtcttgcctccacttttgaaaggaaggagagagacaacagaatggcctgcagatgggaataaaacttagagaagggccaggcacagtggctccacctataatcccagcactttgggaggctgaggcgagaggatcatgaggtcaggagatygagaccatcctggttaacatggtgaaaccccgtctctactaaaaatacaaaaaattagctgggtgtggtggtgtgtgcctatagtcccagctacttggtaggctgaggcaggagaaccacttgaacctgggagtcggaggttgcagtgagccgagatggcaccactacactccagcctaggcgacagagcgagactctgtttcaaaaaacaaaaaacaaaaaacaaaaagcaaacaaacaaaaaaacaaaacaaaagccttagagaacagggcaggaaattaacttttagggagtgccta

SEQ ID NO: 121318 - DNA, 601 bp, Human
ccccttcctggggagacaggtggcagctgtatggcctaagcgccggctctacctctctgccttcctgttagccaccagggcttacctttctctagtcctgacaagtcagaaagaatgaaatggacacagtcaggcaagaattgatgatattggatgtggctgctatctctggtcttgcctccacttttgaaaggaaggagagagacaacagaatggcctgcagatgggaataaaacttagagaagggccaggcacagtggctccacctataatcccagcactttgggaggctgaggcgagmggatcatgaggtcaggagatcgagaccatcctggttaacatggtgaaaccccgtctctactaaaaatacaaaaaattagctgggtgtggtggtgtgtgcctatagtcccagctacttggtaggctgaggcaggagaaccacttgaacctgggagtcggaggttgcagtgagccgagatggcaccactacactccagcctaggcgacagagcgagactctgtttcaaaaaacaaaaaacaaaaaacaaaaagcaaacaaacaaaaaaacaaaacaaaagccttagagaacagggcaggaaa

SEQ ID NO: 121319 - DNA, 601 bp, Human
ctgctgccaggtctccttgctgcccttacatgagcgactggctttccccttcctggggagacaggtggcagctgtatggcctaagcgccggctctacctctctgccttcctgttagccaccagggcttacctttctctagtcctgacaagtcagaaagaatgaaatggacacagtcaggcaagaattgatgatattggatgtggctgctatctctggtcttgcctccacttttgaaaggaaggagagagacaacagaatggcctgcagatgggaataaaacttagagaagggccaggcacrgtggctccacctataatcccagcactttgggaggctgaggcgagaggatcatgaggtcaggagatcgagaccatcctggttaacatggtgaaaccccgtctctactaaaaatacaaaaaattagctgggtgtggtggtgtgtgcctatagtcccagctacttggtaggctgaggcaggagaaccacttgaacctgggagtcggaggttgcagtgagccgagatggcaccactacactccagcctaggcgacagagcgagactctgtttcaaaaaacaaaaaacaaaaaacaaaaagcaaa

SEQ ID NO: 121320 - DNA, 601 bp, Human
aaaccttggctttgtcacttaccagctattcatgttgagccaatttacttaatctgagtctgtttcctcatctgaaaaagatatataatcgtatctgccccataggcttattataagtttaaaaggaagaaatccagtaaaaccctgatcctgggcatctagtaggcagtcaatacaacatcagtctcttttcccatcttaaattcaaaaggcaatgtggtgtgatgggatggatatgggctttagaatcagacagcccaatgactgaactctgacttcatcacctctctgcttaacttcyctgagcctgtttgttcacctgtagaatggcatactagctcctgcgtttgaggagctctgggaaaattaggtgaaataaattgtgttgaacacctgccacattctaagggttggtaaccatcaacccgaaccttaaaagtcctacacgttttagctgcttgccaagagtataagcattggagctctgcagtatttacctggccatggcagctaatcaataaacatgtgcagtatgattgtctgattctaagtgccatcctgggtggaggtggagggcaggagaagggacaggtagtgaatt

SEQ ID NO: 121321 - DNA, 601 bp, Human
tgatttttttttttctgtatggtatgaagcaggggttgagatgcatttcgttccctatacagacctgggtgacccaacaccattgcatcctgcttgcttggctcataaagttctctctgcttcaactgccatctcctttctcaggacctatttgagtcttccatattcttcaaagcacaactaaaatcctgcctcctttatgaagtctttcctgactaatgcactattcatttataccatgatgatctatttattttctactctgtgttgggcattgtgataggcaaagggatgctgggcrctggggagagtggtgaatgaatcagagaccatcccttccctcaagaatcacacaggccaggaaagggacacagacattgaccaagttatggtgcatgtgggtgttgggaagtggaattctgggctcctggagatgtgtaactgggatgtaacctagtttgggttttcaatgaagtctctcccaaggcatccatgttgaaattgagaccttgaagatgactaggaacttgctagaccaggtcatgggggtggggagattggtatttctccatgttccagtcttgaagagcacagacatatt

SEQ ID NO: 121322 - DNA, 601 bp, Human
agagaagtgcctgatacatactaagaactctgtaaatgttacttattgttgttgagttattttaatattgaattattattaaaattctcccttgttagaattctatccttgaatttctgatgcatttttcatgcagctgcattttagataagacatattaaatacctgtctttcactactgggatttatcttggtaaggctgcacgccatagtctagcgccttacgattcaccggattttcctgtctccaattgttcccattcacctgtctccccagcgagagtgtaagttcctggaaacyagagagtattgctgatagaggtctggacaaagtgtgactgttttcctttttcattgagatctgtaatccatctggaattgatttttttttttctgtatggtatgaagcaggggttgagatgcatttcgttccctatacagacctgggtgacccaacaccattgcatcctgcttgcttggctcataaagttctctctgcttcaactgccatctcctttctcaggacctatttgagtcttccatattcttcaaagcacaactaaaatcctgcctcctttatgaagtctttcctgactaatgc

SEQ ID NO: 121323 - DNA, 601 bp, Human
gtggtagatggagtgtttatctctcctatttttcaaatccagagctcagaaaagtaaaatcatttgccccaaagaccccaactcagaaacttatgtcatctgactccagatctcgtgtcccttgagtgacaatgtccttgaattacttaacctcttgttgccctggtgtcctcatctgtgatatggagataagaaaagtataatcctcctagtgttgtgtgaaggtcaaatgagttaatttggtgtgatgcttagagaagtgcctgatacatactaagaactctgtaaatgttacttattrttgttgagttattttaatattgaattattattaaaattctcccttgttagaattctatccttgaatttctgatgcatttttcatgcagctgcattttagataagacatattaaatacctgtctttcactactgggatttatcttggtaaggctgcacgccatagtctagcgccttacgattcaccggattttcctgtctccaattgttcccattcacctgtctccccagcgagagtgtaagttcctggaaactagagagtattgctgatagaggtctggacaaagtgtgactgttttcct

SEQ ID NO: 121324 - DNA, 601 bp, Human
tggtgtgaaagccccttgaagagctgctgcattcatcattgtatcctgaggcagaggcagaggcagcctgtccaccctctcatgtttccgatgcacccaagcaccatccagccccgggtcagcacatccacagagagcaggcagggtggtgggagcagcaagtggtgaggcctgtgatgccataatcaattttgctgggcttagcgtagttactgaaaagcttgtggagggaagagaacacacctattgactcaaaggaggtttggggattttctgtggtttgcaacgatccatttgctcrttactagctgagatctggaattggcagtactgacataatggcttatgtccgtggacttactgcacatggagaaagaagcttcggagtctgggggaagaatgcatttcgcctttccaagcttcccttgtccttgcctcatctcttgagcggtgccagatgacaagggcctctgtcactgtgatgcagtttacttcctatctccctctctagcagaggtctgctcttggagaacggactatgtgtattttgttcacaatgtacctccactgcccatccagggctttggcttgcaccaggtgc

SEQ ID NO: 121325 - DNA, 601 bp, Human
aggccacctcctggttatgcctcttcccacaaccctctcacttggccagcatccgcctggttatttggctggtcatacgctccaccacgagcacacaacacatgtccaaagaatgtgcttcccacgctcctcaatcctcactttcccaaacataccccctccaccaccttccagcttgctaccacttagcagatgcctgatatgttttagctcaatgaatgaatgagagaacccagaccaaagaagtcttttgtcctaagcttgggagaggatgctttttaccagtggtttaccggctgcrggtatttcatccattagacacatcctttcccgctaatgctgtgatttccaaagttcattctgctgattccagccccaggagatgctaagaggagatacaaaataaaggggttccactggcaagtaagtttgggaaatgctgaacaaggggaggttaaataggtttccttacctcagggcttttctgtgcctttactatgctaactgcattgtcaaactctaatgtgggaatatagtgctcaatgtttccaaaagttcatttcattacaggctctctctgtgtgtgtgtgtgtgtgtgtgt

SEQ ID NO: 121326 - DNA, 601 bp, Human
aagaaccagcctgtgtgggttcaaatctcagggctgccacttactagccatgacctcgggtaagacatgtcacctcttagtgccttacattctttattggagaatacaatgataagtatctactggggtattggaaggataggtcagctaatatttgtaatggacttagaagagtactttatgcatagtagggattcattaaatgtcagccattactatattagtataacataaggtgcctggcacatagtagatgcttaataaatggtattgactacaaccacattgagaataatcttcyactctgcctggagtaaaagactctagcctcctaagtccctgagatccttactagttttcttcattgtttttaccagccaatatcttccgtacattcatagtttatcgtccctggaaatctcataacttcttggaggagagaggccacctcctggttatgcctcttcccacaaccctctcacttggccagcatccgcctggttatttggctggtcatacgctccaccacgagcacacaacacatgtccaaagaatgtgcttcccacgctcctcaatcctcactttcccaaacataccccct

SEQ ID NO: 121327 - DNA, 601 bp, Human
tgagtggggaaaggactggaggggcaagaccagaagccatgggcccagattcctccatcgggtgaaaaatgcttgtggcctttcctacttggcaaaatataccttaattttctaaccacagatttccccaaacctgtcttggcccttttctttttttgagccagggacttgctctgtcaccccagccagagtacagtggcacaatcacggctcactgcagccttgcactccccaggctcaggtgacaggtgatcctcccatctcagcctcctgagtagctgggactacagacacgcgcaaycatgctcagctaatttttgtattttttgtagagacagggtttcatcacgtttcccaggctgggctcaagtgattctttcacctctcagcctcccgaagtgctgggattacagatgtgagccactgcacctggtccccttggtccattttaatcacatatgtatattcagttttgtggcatagagtcaagccagagtgctcaaacaccacctacaccattaacccatgagagcggaaatagctcgtgcaacgaggacccacaggcctgaggatgcccatgtagccacattcccatttccag

SEQ ID NO: 121328 - DNA, 601 bp, Human
gattatgttttgctgggccccacggtcggggcacagatagatcacacagtctctactttgaagaagctcacagactagtaggggagagaccggtgattacactctgctgtgccaagagagcctgcccaaggagctatgggaaccgcatgcacttagatcctatgaaacaggatggttcaaatgactctgtcaaccccagagtccctggagtaggcggataatgaataaacactgtcatgtgtcaacagccctaaattcatcttaagaagccctgtggtgtggtggctgtgcctctcgcagragagcgtgggtctgagttctctttctgccgtgtattaaccatgtgctctcggacaaggtgttcatctttcagttcagtacttcagctcgtccttgaatttttatcaagtggttactaggtgttggtgttgagctaggttccacagcagagaagggatcaatacagacggattccccgtcccccagagctgagtcttgagaggaccctagacaaataattaatgcagacgacccagaatgaaaccacaagggcagcgagggcgttggctggtcgccgggaacaagctgccatgagccaggc

SEQ ID NO: 121329 - DNA, 601 bp, Human
cactgcaacctctgtctcctgggttcaagcaattctcctgcctcagcctcctgagtagctgggactataggtgcccaccaccatgcccggctactttttgtgtttttagtagagatggggtttcaccatgttggccaggctggtcacgaacccttggcctcaagtgattcacccaccttggcctcccaaagtgctgggattaaaggcatgagccaccatgcccggccccaacataacttttatatgcactaggaaaccaaaaaatttgtgtgactcactatgttatgatatctggtgtatkgtggtgatccagaaccgaatcctcagtatctcccaagtctgcctgtatgagagaggcagtgatgctcagtggttagcttcacagggtctggaggctggctacctgggtccacattctagttatgccactgaacctgagcgttggctcctccactgtaaaatgaggagtcagttaaacttctgtcatagagttgtgagaattgcataaaacactgcattgagagggctcagcacagtggctgtcacctagctcgctaagaggtaggtgtgattatgttttgctgggccccacggtcggggc

SEQ ID NO: 121330 - DNA, 601 bp, Human
gcaactttgaaagaagttcaactgtggataaaaatatatcaaacaatatcacttgctatacagaaatcttttgcgaaaggaagaatcaattgatgtggcaaactacattgttgtcttagtttaagaaattggcacaaccaccccaaccttcagcaaccaccaccctggtcaatcagcagctatcaacatcgaggcaagaccctccatcagcaaaaagatgatggcacactgaaggctcagatggtcagtagcatttttagcaataaaatatgttaaaattatgtatgtacattgttttctyagacataatgctattgcacacttaatagactacagtatagtgtaaacataacatatattttttgagacagaatctcactcggtcacccaggttggagtgaaatggcacaattatagctcactgcagccttgacctcctggacttaagcaatcctcccacctcagtctcctgagcagctgggaccacagatatgtgtcaccacgactggctgattttttatttgtagagatgggggtctcactatgttgtccagactggtctcaaactcctgggcttaagcaatcctcctgcctcagcctc

SEQ ID NO: 121331 - DNA, 601 bp, Human
aatatatttgctgatatggagaaactttgagcagtctggatagatcaaaccagacacaacattcccttaagccaaagcctaatccagagtaaggccctaactctcttcaattgtatgaaggctaagagaggtgaggaagctgcagaagaaaagctggaagctagcagaggttggttcatgaggtttaagaaagaagctgtctccataacagaaaagtgcaaggtgaaggggcaagtgctgatggagaagctgcaacaaatcatccagaagatctggttaagatcattgatgaaggtggccrcactaaacaacaaattttcaaggtagatgcaacagctttctattggaagaagatgccatctaggattttcatagcaagagaggtcaatggttggcttcaaagcttcaaaagacaggctaactctcttgataggggctaatgcaactggtgactttaagttgaggccaaggttcatttaccattctaaaaattttagagcccttaagaagtatgctaaatctactctacctgtgctctataaatgagacaaaaaagcctacatgcagcatatctatttatgggatggtttactgaatattt

SEQ ID NO: 121332 - DNA, 601 bp, Human
atttttagtagagacggggtttcgccatgttggccaggctggtcttgaactcctgacctcaggtgatccgcctgcctcagccttccaaagtgttgggattacaggcgtgagccactgcgcccggactacttcttcattattattacatctgttatggcgatctgtgatcagtgatcttggatgttaccattgtaattgttttggagtgccaagaactgcactatataagatgacgaacttaattgataaatgctatgtatgttctgactgttccaccagttggccatgtccctgtttctcyccctctccttggacccccctattctctaagacatgacaatactgaaattagggcaattaataaccctacaatggcctctaagagttcaagtgaaaggaagagttgaacatatctcactttaaatcaaaagctagaaacaattaagcttagtgaggaaggcatgtcataagcccagacaagctgaaagctaggcctcttaagtcaaacagttagccaagatatgaatgcaaagggaaagttattaagggaagttaaaagtgctactctctatgaatgataagaaagtgaaatatatttgct

SEQ ID NO: 121333 - DNA, 601 bp, Human
atatgtatttattattaaacacattctaaaaatatatatatatatattttttgagacagaatcttgctctgtcacccaggctggagtgcagtggtgcgatctcggctctctgcaacctttgcctcctaggttcaagcgattctcttgcctcagctagccgagtagctgggattacaggcacccgccaccacgcccagctaatttttgtatttttagtagagacggggtttcgccatgttggccaggctggtcttgaactcctgacctcaggtgatccgcctgcctcagccttccaaagtgytgggattacaggcgtgagccactgcgcccggactacttcttcattattattacatctgttatggcgatctgtgatcagtgatcttggatgttaccattgtaattgttttggagtgccaagaactgcactatataagatgacgaacttaattgataaatgctatgtatgttctgactgttccaccagttggccatgtccctgtttctccccctctccttggacccccctattctctaagacatgacaatactgaaattagggcaattaataaccctacaatggcctctaagagttcaagtg

SEQ ID NO: 121334 - DNA, 601 bp, Human
tcattttgttgtttgttaaaatagtcttttatatgtatttattattaaacacattctaaaaatatatatatatatattttttgagacagaatcttgctctgtcacccaggctggagtgcagtggtgcgatctcggctctctgcaacctttgcctcctaggttcaagcgattctcttgcctcagctagccgagtagctgggattacaggcacccgccaccacgcccagctaatttttgtatttttagtagagacggggtttcgccatgttggccaggctggtcttgaactcctgacctcagrtgatccgcctgcctcagccttccaaagtgttgggattacaggcgtgagccactgcgcccggactacttcttcattattattacatctgttatggcgatctgtgatcagtgatcttggatgttaccattgtaattgttttggagtgccaagaactgcactatataagatgacgaacttaattgataaatgctatgtatgttctgactgttccaccagttggccatgtccctgtttctccccctctccttggacccccctattctctaagacatgacaatactgaaattagggcaattaata

SEQ ID NO: 121335 - DNA, 601 bp, Human
tggtttgcaaatgtgtttcccaatctgtacattgccctttcattttgttgtttgttaaaatagtcttttatatgtatttattattaaacacattctaaaaatatatatatatatattttttgagacagaatcttgctctgtcacccaggctggagtgcagtggtgcgatctcggctctctgcaacctttgcctcctaggttcaagcgattctcttgcctcagctagccgagtagctgggattacaggcacccgccaccacgcccagctaatttttgtatttttagtagagacggggtttcrccatgttggccaggctggtcttgaactcctgacctcaggtgatccgcctgcctcagccttccaaagtgttgggattacaggcgtgagccactgcgcccggactacttcttcattattattacatctgttatggcgatctgtgatcagtgatcttggatgttaccattgtaattgttttggagtgccaagaactgcactatataagatgacgaacttaattgataaatgctatgtatgttctgactgttccaccagttggccatgtccctgtttctccccctctccttggacccccctatt

SEQ ID NO: 121336 - DNA, 601 bp, Human
ctaatatatggtttgcaaatgtgtttcccaatctgtacattgccctttcattttgttgtttgttaaaatagtcttttatatgtatttattattaaacacattctaaaaatatatatatatatattttttgagacagaatcttgctctgtcacccaggctggagtgcagtggtgcgatctcggctctctgcaacctttgcctcctaggttcaagcgattctcttgcctcagctagccgagtagctgggattacaggcacccgccaccacgcccagctaatttttgtatttttagtagagacrgggtttcgccatgttggccaggctggtcttgaactcctgacctcaggtgatccgcctgcctcagccttccaaagtgttgggattacaggcgtgagccactgcgcccggactacttcttcattattattacatctgttatggcgatctgtgatcagtgatcttggatgttaccattgtaattgttttggagtgccaagaactgcactatataagatgacgaacttaattgataaatgctatgtatgttctgactgttccaccagttggccatgtccctgtttctccccctctccttggacc

SEQ ID NO: 121337 - DNA, 601 bp, Human
aacccttatctaatatatggtttgcaaatgtgtttcccaatctgtacattgccctttcattttgttgtttgttaaaatagtcttttatatgtatttattattaaacacattctaaaaatatatatatatatattttttgagacagaatcttgctctgtcacccaggctggagtgcagtggtgcgatctcggctctctgcaacctttgcctcctaggttcaagcgattctcttgcctcagctagccgagtagctgggattacaggcacccgccaccacgcccagctaatttttgtatttttwgtagagacggggtttcgccatgttggccaggctggtcttgaactcctgacctcaggtgatccgcctgcctcagccttccaaagtgttgggattacaggcgtgagccactgcgcccggactacttcttcattattattacatctgttatggcgatctgtgatcagtgatcttggatgttaccattgtaattgttttggagtgccaagaactgcactatataagatgacgaacttaattgataaatgctatgtatgttctgactgttccaccagttggccatgtccctgtttctccccctct

SEQ ID NO: 121338 - DNA, 601 bp, Human
tgacgttggacacttttccatttacctattggccattttaatgtcatctttggagaaatgcctattaaagtcctctgctcatttttaaattgtgttatacattttcttgctattgagttgtatgtgttctttataaatcttggatattgagactttagtttaaacaagaatatatgtttaaaaactcagatattaacccttatctaatatatggtttgcaaatgtgtttcccaatctgtacattgccctttcattttgttgtttgttaaaatagtcttttatatgtatttattattaaacwcattctaaaaatatatatatatatattttttgagacagaatcttgctctgtcacccaggctggagtgcagtggtgcgatctcggctctctgcaacctttgcctcctaggttcaagcgattctcttgcctcagctagccgagtagctgggattacaggcacccgccaccacgcccagctaatttttgtatttttagtagagacggggtttcgccatgttggccaggctggtcttgaactcctgacctcaggtgatccgcctgcctcagccttccaaagtgttgggattacaggcgtgagcc

SEQ ID NO: 121339 - DNA, 601 bp, Human
ctcccatggagtgttataccagtcttggataacttatctccagagctgtgcaacgagaaagaaataaactatcaactatctttattttcttacttttaatttttttagagacaggttcttgctttgtcacccagattggagtgcagtggcatgatcatagctcactgtgacctcgaactcttgggcttaaatgatcctcctgcctcagtctcctgagtagctgggactacaggtgcatgccaccacacccgtcctgtctttttaattttaggtaaataaaccaaaaaaacaaaaaaaaaaatgcgggaaactttatagccaagcctaatcctaatgaacataacctgtacaagttaaaatagtctttaaaaaagcttgatttttaaatttgttttttttttttgatacggagtcttgctctgttgccaaggctggagtgcagtggtgtgatcttggctcactgcaaactctgcctcccgagttcaagcgattcttgtgcctcagcctcctgagtagttggaattacagacacgcaccaccaagcttggctaacttttgtatttttggtagagatggagttttactatgttggccaggctgg

SEQ ID NO: 121340 - DNA, 601 bp, Human
tgcccccaatccaaatctatttgaatatatcaaaacatacgtatagcctgcaactcagcaattctgcttagaaatgtgtgttgaagaaacacttgcatacatgcacacgatgtatgagaatgttcataacagcactgcttataacaacaacaaacttggaatagcccagatttctattatcggagaaatgatagcatagtatattgatgtaatgtagtgtacagcagtgaaagttagtgaattacagctacacaagtcaacccagatgaattccacaaacataacactggacagaaaaaaatcaagctgcagaaaaatgcatatggtatgattccattttcattaagttaaaaacatgttatagattatttagaaatacatgtgtatgtggcaaaactgtaaagtcaagcaagggaatgataaacatcaagtttaagagtgtttgcagctgggcgtggtggctcacacctgtaatccctgcactttgggaggtggaggtgggaggatcgcatgagcccaggagttccaacccagcctgggcaacatggcgaaatcctgtctctacaaaaaaataaaaaattagccaagcatggtggtgcac

SEQ ID NO: 121341 - DNA, 601 bp, Human
agcgagctgaggcgtggggaggaggctgtctgagtaattttttaagtgaagcaaaggaagggtttagtgggagctgctttctctgtgttttcaacctttgctgctcctggctttttgctttcctggcaatacctccctgacggcagggattcgggaggcctcagggagggtgggccatgcctggcttgtttctggctggaaccccagccccctggggcacagcgcagccaccagcttgggttggatggtttgcaacaacagaacgtgtggcatcctatgagtttgatcgttctctcgttcsttcattcattctttcagtgggtagtttctttctttttttgttttttgggaaggagggaggggaggaagagctaggggtcaagaagggagagggcagtctcagtgggtagtttcgaatgcctactgtgtgctaggcactgggcagggtgagatgaagtaagtggtctgtcctgcctgcctgccatgaatttgctccttccattggctctgagctcccacttcactgaagtccccagcactcaggagctgaccacaatgaacaattgctcatccaactttcagttgcatcctgtcctggctc

SEQ ID NO: 121342 - DNA, 601 bp, Human
tgacctaaattctagaaggtgccatggcaaggatttaggagggcgggggagttagagatccagccagatcagaggacacacagccctgagggacaagtgatgagtagggaggagtgatggggtaaactgggatacaggtcactgtgcgattggtcccaacgcctctggtggccatgaggctgtgagggtcagctggaggagcacagggtctccaggagcacttggagctcggtgggccctggattcagtctgattaatggtggtgctggggagaggtataggaggggagggggcactagcrgcactcaagcattagtggtgaaatttgaacttcataggacatctacgtcaacagacatcactccagtaaggggagagtggtgagtggtgatgaaatgaatgagatttcatttccctaaggccagcctagggttccattgtatttccttctggttggtggtaatccaccccaggggttgtgatggcttcaggcacagatggatccaggtgctccaaaatctggaacctctctccatctctgactttcctcccaactagcttcattcctaggcaccctctgtccctgtggtagagactaagg

SEQ ID NO: 121343 - DNA, 601 bp, Human
ccagccttggggagcgaggagaggagatggagccttggtcccagcccttctcttctctctgccccgcccaatgcaggagccaccccttcccccagccagcttccctgacatagtaagactgatcggtacaacagtatttcaatatttaacaaccagtgaggcagcaccggcacatcaggttggagtgaaggggtcacggccagggactggaggggctgattgcctggttgtggaatctgcaaggatgataacgggagcagcattggaggcaaaggcagtgagccagcgctcagctccccaragactgaatggcggcggccatgagggagtcggacaggtaggctgggatgtgtttcacagaggcagggagtttagggaggaggcagggaaatggaccggaaatgtcgatgaggcccagggaggcctgggatgtgagcagtaaaacactctcgacagtgagagtttgcaggggcggtggtgtccttcggggaaagccagatttccattagagcaaggacagaatggggggattctgctggcactgtgacctaaattctagaaggtgccatggcaaggatttaggagggcgggggagttagag

SEQ ID NO: 121344 - DNA, 601 bp, Human
agccccaggaggtcagggccgggaatgggaaggtagtgggaggctgtgagaggggtagaggctctcatcggcagggcagtggtgtgcgcccagcccagcccagtcccaccagtcaggaccagtagggagactcttcttctcttgcccccatccttggggcgggccttggagtttatagaacctgagaacagagctgagtccttaacccagccttggggagcgaggagaggagatggagccttggtcccagcccttctcttctctctgccccgcccaatgcaggagccaccccttcccccarccagcttccctgacatagtaagactgatcggtacaacagtatttcaatatttaacaaccagtgaggcagcaccggcacatcaggttggagtgaaggggtcacggccagggactggaggggctgattgcctggttgtggaatctgcaaggatgataacgggagcagcattggaggcaaaggcagtgagccagcgctcagctccccaaagactgaatggcggcggccatgagggagtcggacaggtaggctgggatgtgtttcacagaggcagggagtttagggaggaggcagggaaatgga

SEQ ID NO: 121345 - DNA, 601 bp, Human
gttgaaatgggggtgcatgggagtgagctgcaacggtggcacgtggtagccagagagtgggatgcaaaagacagagagtggagggggtgtggatattggaaatgccaagggcaagggtaagaccccgaatgaggtggcttggggcaggcagaggtagggatgatcttcaagtatgcactggaaaggtcacacaaattaatagataaggcaaaactacaacattcgctgttattttctatatacatcgagtatatattaagaaactgcctacccggttaaaatttgaagtgcaaatgattcrtcaaattattctaataagccccaaatcaccgattggtttttagaaatgagtggtgtgatcttttgatgatgaggctgttatgagctaaatgatggcttgactggaccatgctttgacacaggaaaccacaccagatgctccccaagcttccctgttagagtaagggtcattccacctcggcgagtgcagaatcttctcctaagttgtcctctacggttcgactagaggacctctctgtgcccagcagccccaggaggtcagggccgggaatgggaaggtagtgggaggctgtgagagggg

SEQ ID NO: 121346 - DNA, 601 bp, Human
cactgtgctactggggtgtcctccactagctggctagtgctggctgctctgtgttggggggagatatattttttttttttgagacggtgtctcgctctgtcacccaggctggagtgcagtggcacaatctcggctcactgcaagctccgcctcccgggttcacgccattctcctgcctcagcctccagagtagctggaactacaggcgcccgccactacgcccggctaatttttttttttgtattatttgtagagacggggtttcactgtggtctcgatctcctgacctcgtgatccgccygcttcggcctcccaaagtgctgggattacaggcgtgagccaccgcgcccggcctaaggggggagatattaaagcctgtatgatactagtgggaatgttctagtagagagggaagaagggaggggctgggggcagtggctcagccttagctttaggaagctgaggcaggaggatcccttgaacccagcagttcaagaccagcctgggcaacatagcaagaccctatatctacaaaaaataaaaacaaattagccagatgtggtggtatgtgtctgtggtcctagcttacttgggagtctga

SEQ ID NO: 121347 - DNA, 601 bp, Human
gcctctttctcctaacctccttctgcctccctgcactgtgctactggggtgtcctccactagctggctagtgctggctgctctgtgttggggggagatatattttttttttttgagacggtgtctcgctctgtcacccaggctggagtgcagtggcacaatctcggctcactgcaagctccgcctcccgggttcacgccattctcctgcctcagcctccagagtagctggaactacaggcgcccgccactacgcccggctaatttttttttttgtattatttgtagagacggggtttcacygtggtctcgatctcctgacctcgtgatccgcctgcttcggcctcccaaagtgctgggattacaggcgtgagccaccgcgcccggcctaaggggggagatattaaagcctgtatgatactagtgggaatgttctagtagagagggaagaagggaggggctgggggcagtggctcagccttagctttaggaagctgaggcaggaggatcccttgaacccagcagttcaagaccagcctgggcaacatagcaagaccctatatctacaaaaaataaaaacaaattagccagatgtggtggtat

SEQ ID NO: 121348 - DNA, 601 bp, Human
gctcaacatctctaacaaagcctgacccccaacctccacatctggcctcacctcccacccacctcctccctccctgtgcatctctgccttctttcctgccatgctccctcctacctcaggaccgtggcacatgcatgctggtcctgctgcctgaactcccaccacgtcctctgttgcctctttctcctaacctccttctgcctccctgcactgtgctactggggtgtcctccactagctggctagtgctggctgctctgtgttggggggagatatattttttttttttgagacggtgtctygctctgtcacccaggctggagtgcagtggcacaatctcggctcactgcaagctccgcctcccgggttcacgccattctcctgcctcagcctccagagtagctggaactacaggcgcccgccactacgcccggctaatttttttttttgtattatttgtagagacggggtttcactgtggtctcgatctcctgacctcgtgatccgcctgcttcggcctcccaaagtgctgggattacaggcgtgagccaccgcgcccggcctaaggggggagatattaaagcctgtatgatactagtggg

SEQ ID NO: 121349 - DNA, 601 bp, Human
cagctcggaaacactccagcttcccagtgctgtcggggaaaagctcaacatctctaacaaagcctgacccccaacctccacatctggcctcacctcccacccacctcctccctccctgtgcatctctgccttctttcctgccatgctccctcctacctcaggaccgtggcacatgcatgctggtcctgctgcctgaactcccaccacgtcctctgttgcctctttctcctaacctccttctgcctccctgcactgtgctactggggtgtcctccactagctggctagtgctggctgctctrtgttggggggagatatattttttttttttgagacggtgtctcgctctgtcacccaggctggagtgcagtggcacaatctcggctcactgcaagctccgcctcccgggttcacgccattctcctgcctcagcctccagagtagctggaactacaggcgcccgccactacgcccggctaatttttttttttgtattatttgtagagacggggtttcactgtggtctcgatctcctgacctcgtgatccgcctgcttcggcctcccaaagtgctgggattacaggcgtgagccaccgcgcccg

SEQ ID NO: 121350 - DNA, 601 bp, Human
gcctatttgacatctcctggtggatgttttaaaggcactgaacatgaactcctgatctttccctctagcctggcactctggaggccccagttagcttggcgaatgcttctccagggttcccttgtgtaagcctgagcctagttgtcagcgctgacatctatctcttcctcctccctgcaggctccatccatcagggcgtcctgtctgtattagatccttagtgtctcaaacttgcctgatgtctctgagacagcaccgcccactaccaggccaccatccctgctccctggatggctgccgyggcctccccactcatcagtttgcacccactcttatccttctctacagagctatgacagtgatcctttgtacatgcaaatctgatcatgccacctccagctcggaaacactccagcttcccagtgctgtcggggaaaagctcaacatctctaacaaagcctgacccccaacctccacatctggcctcacctcccacccacctcctccctccctgtgcatctctgccttctttcctgccatgctccctcctacctcaggaccgtggcacatgcatgctggtcctgctgcctgaactcccacc

SEQ ID NO: 121351 - DNA, 601 bp, Human
ctccctattgttaaaattacaaatcagtgtatttgaaaagcacttcgcaaagcactctcattttctttcaattcaatctgacaaatatttcagcaagccggtgccaggcatctttataaagaatctgtgcaggagtgaggctcagagagcagtactgacatgccctgaggcgtcccacaaattgaggacagagcttcacccagcagggccccagctgcatcctggtgggccacacccgctcctgttccccgcaggaacaggagctcacattctacggggagcctagttgctccttgtgtgyaagcctgggcttcactcatccttggaccattggctcctagcgcagtgcctggcacagaagcagggttcaggagatgctaacagagaggccgtgcgagataatcagtggcccagacctctccttgaggcctggacctgggtatccagctgcctatttgacatctcctggtggatgttttaaaggcactgaacatgaactcctgatctttccctctagcctggcactctggaggccccagttagcttggcgaatgcttctccagggttcccttgtgtaagcctgagcctagttgtcagcgct

SEQ ID NO: 121352 - DNA, 601 bp, Human
ctgaaatggagtctcactctgtcacccaggcttgagtgcagtggtgtgatctcggctcacggcaacctccaactcccaagttcaagtgattctcctgcgtcagcctcctgagtagctgggattacaggcacataccaacatgcccagctaatttttgtattttagtagagatggggtttcaccatgttggccaggctggtcccccactcctgacttcaagtgatctgcctgccttggcctcccaaagtgctgggattacaggcataatccactgtgcccagcctagacatatatatatatrtgtgtgtgtgtgtataaaatagacctatatattaggttggtgcaaaagcaactgtggtttttgccatcaaaagtaatagtgaaaccgtaattacttttgcatcaacctaatagtacacaggtatatagtatacagggatacttacgtactacgtaggaatataagcattttaggaacttctggctatgattatatgctgcatataatggaaaagaggaatctctgtaactccctttcacacatgagctatccctgtaccaaattcactaactttcttgagttctacaagaaaaacaattc

SEQ ID NO: 121353 - DNA, 601 bp, Human
acctaattaatacagccctcaatacatgttggcaatgattttcttctacagtcctgagactatgtcttataaaataggggcagattctagtatgtgtcatagatattaattaggaattttacggtattattacatataccttttttttttttttttccccctgaaatggagtctcactctgtcacccaggcttgagtgcagtggtgtgatctcggctcacggcaacctccaactcccaagttcaagtgattctcctgcgtcagcctcctgagtagctgggattacaggcacataccaacaygcccagctaatttttgtattttagtagagatggggtttcaccatgttggccaggctggtcccccactcctgacttcaagtgatctgcctgccttggcctcccaaagtgctgggattacaggcataatccactgtgcccagcctagacatatatatatatatgtgtgtgtgtgtataaaatagacctatatattaggttggtgcaaaagcaactgtggtttttgccatcaaaagtaatagtgaaaccgtaattacttttgcatcaacctaatagtacacaggtatatagtatacagggata

SEQ ID NO: 121354 - DNA, 601 bp, Human
aaggggacacaccccgcactggtgctgccagatgctgccacagccctttagaagagcctgcaaaacactttcccatctgcaattccgcacggaattcaccaaacccagccgccaactgctctgaaataaatatgggggtggggaggaagttgagccccctgggggctggacttttgggttttgaactacagctcattttggttccaccacaggcctgtgaggggggtattatcatcctcattgtatagatgaggaaactgaggctcagaaaggctgaactatctgagcaagtgcttgtggytaggaaatgacggaatcagggctgaaactaggatcttttgactctaaatgtttcctcggtgcctgctgggaaggtgagaactggcctggggcaaatcccagcacagtgtcacaggcaggtcctccccagtgttcactgatgagcacgtgaactcttgaatgtggcctttctaaaaaccgataagtagcacagactctacaatcaccagagcatcggcttcctgacagcagagactttgtttcattcactgtcttatctccagcaccagcataggcacagtgaatgtcctttaaccttctc

SEQ ID NO: 121355 - DNA, 601 bp, Human
ggactgccacgcaggaggccgatgaatgctcctcagcccgtctctgtgccccagcatagctgggagtcatcctgcattttacatgtgagaaagtagcagatcactttctaaaggggacacaccccgcactggtgctgccagatgctgccacagccctttagaagagcctgcaaaacactttcccatctgcaattccgcacggaattcaccaaacccagccgccaactgctctgaaataaatatgggggtggggaggaagttgagccccctgggggctggacttttgggttttgaactacarctcattttggttccaccacaggcctgtgaggggggtattatcatcctcattgtatagatgaggaaactgaggctcagaaaggctgaactatctgagcaagtgcttgtggctaggaaatgacggaatcagggctgaaactaggatcttttgactctaaatgtttcctcggtgcctgctgggaaggtgagaactggcctggggcaaatcccagcacagtgtcacaggcaggtcctccccagtgttcactgatgagcacgtgaactcttgaatgtggcctttctaaaaaccgataagtagcac

SEQ ID NO: 121356 - DNA, 601 bp, Human
tgcatcgtgttccctccctctttcttcccagctgcctggctgactttacattccacgggcttttcaatgaaaccagattccaggctgacctgagagctgggcttgatgtgagaagtaattattgaaagagacaggggcaatctatataataaaatgcctcctacatgcttcataaaagtgatctgagggcaatggcaatccttgtgctgttgggaaggggaggtggcagggcctggagcagaggcggggttgctcctgggaggagagcaaacctccttccaaagagatggcctgagaacctcggctttgctgtcccaggcctcaaggactctcagcccctctcttggaaatccctttctcagggaataggtagccttgttagtttttgctgatacttgagacatttccttggagcctcagaatgctttctcttgataatatgtctcaggtggatttaagattgcagctgttacatcaggatttaactttgacttacttgacttgcgggggaagaaaaaatctctctctttttttttttttcattagaagttccaatctggcactgcctggtgggttacttcatccaattattcaagaaata

SEQ ID NO: 121357 - DNA, 601 bp, Human
cttttaggaattccagttaagagcaacgtcttgaaggaattcataaaaggaaatgaagagcagggtatgatattttttcctttaaaaaaaagaatctaaaaattgcatcgtgttccctccctctttcttcccagctgcctggctgactttacattccacgggcttttcaatgaaaccagattccaggctgacctgagagctgggcttgatgtgagaagtaattattgaaagagacaggggcaatctatataataaaatgcctcctacatgcttcataaaagtgatctgagggcaatggcartccttgtgctgttgggaaggggaggtggcagggcctggagcagaggcggggttgctcctgggaggagagcaaacctccttccaaagagatggcctgagaacctcggctttgctgtcccaggcctcaaggactctcagcccctctcttggaaatccctttctcagggaataggtagccttgttagtttttgctgatacttgagacatttccttggagcctcagaatgctttctcttgataatatgtctcaggtggatttaagattgcagctgttacatcaggatttaactttgacttactt

SEQ ID NO: 121358 - DNA, 601 bp, Human
cttgagtgttcacatattcacccacccagtcacttcattgctcagtcatcaaagtgcttttttgggtcaaattccctgccatggccttttctgggtgcttggggtgcagaaatgaatgggacatagctctgccttcaagaagctcatagtctcttggggatcccgagtgtgaaccagtgacattgcagcaaagtgtggtcggggttgaattgtagacacatgcagggtgccagggaggccccagaggagcttctgaatcagaagcgggggtagggactgggggcaggggatccttctagaraaatcatccccgtcttccagcttctctcaagatctaggttagaacttcgtagagaatgatagaaacttgcgtcttccagctttaaagaattatttttgttttccggcccaggactagcattttatagaccaggggtcagcaaactataccaaatgaagcctgctgcctggttgtgtaaatcaagttaagtttcactgtaacacagccacacatatgcctccatattgtcagtggccacaagagcagagttgggtaaatgggacagagattgcatggcccacaaagcctaaaatattcaac

SEQ ID NO: 121359 - DNA, 601 bp, Human
ccaccccaggtgcagctcagcccgcctccttcagcctaagctctgcccacctctgggagccacctgcctacttctggcgaatgggggcccagctgttttcctctggaagcctgttgcttgcattgatctcggggcattagaccatgatttacttgagtgttcacatattcacccacccagtcacttcattgctcagtcatcaaagtgcttttttgggtcaaattccctgccatggccttttctgggtgcttggggtgcagaaatgaatgggacatagctctgccttcaagaagctcatagyctcttggggatcccgagtgtgaaccagtgacattgcagcaaagtgtggtcggggttgaattgtagacacatgcagggtgccagggaggccccagaggagcttctgaatcagaagcgggggtagggactgggggcaggggatccttctagaaaaatcatccccgtcttccagcttctctcaagatctaggttagaacttcgtagagaatgatagaaacttgcgtcttccagctttaaagaattatttttgttttccggcccaggactagcattttatagaccaggggtcagcaaactatac

SEQ ID NO: 121360 - DNA, 601 bp, Human
tcagtgagtgcttagtaaatatctctcgagtgaatgaatgaatgaattggctctggtgccaccttctctagggaactcttatggaaggacctcctctggtctgggttaggggacaggttccctcagcaccacacgattccttctattccagcatgcagcataaacattaggtctgtaggtctccctccagatggctagccctcagggagaggagctgcttctgccccctcacagcctcccctgcggcagatgagcggtgcagatgggtttgacagaccttaactaggagtggactcaggcyctctccaccccaggtgcagctcagcccgcctccttcagcctaagctctgcccacctctgggagccacctgcctacttctggcgaatgggggcccagctgttttcctctggaagcctgttgcttgcattgatctcggggcattagaccatgatttacttgagtgttcacatattcacccacccagtcacttcattgctcagtcatcaaagtgcttttttgggtcaaattccctgccatggccttttctgggtgcttggggtgcagaaatgaatgggacatagctctgccttcaagaagctc

SEQ ID NO: 121361 - DNA, 601 bp, Human
gtgtctaaatcggtcattcccatcacacttagaatgagagctgaggtctccccctggtcccaggcccacatgactgggttcctctgctgtctctgctgtaggaccccactccacccctgcactgggctcctgcaagaccagctacccctctgatcctcaaacatgatgctctgtgcctgctttaaggactttgctcttgctattctctccatcagctactctcttccccagaaatcttcttacctggttccctttctttactcagagaaactttgggaccaccttatctaagtgacatgcyctcaggacccactggcccctcccccatcactctccactctccaacccctcccagaccactcagaaactatctcagctggggccgggcgtggtggctcacgcctgtaatcccagcactttggcaggctgaggcaggcggatcacctgaggccaggaatttaagaccagccaggctaacatggtgaaaccccatctttactaaaaatacaaaaaaattagccaggcatggtggcgcatgcatgtaatcccagctactcgggaggctgaggcaggagaatcgcttgaacccgggaagcagagg

SEQ ID NO: 121362 - DNA, 601 bp, Human
tttccaaccgtcactaccacagcagccaggctgatgtgtctaaatcggtcattcccatcacacttagaatgagagctgaggtctccccctggtcccaggcccacatgactgggttcctctgctgtctctgctgtaggaccccactccacccctgcactgggctcctgcaagaccagctacccctctgatcctcaaacatgatgctctgtgcctgctttaaggactttgctcttgctattctctccatcagctactctcttccccagaaatcttcttacctggttccctttctttactcagrgaaactttgggaccaccttatctaagtgacatgccctcaggacccactggcccctcccccatcactctccactctccaacccctcccagaccactcagaaactatctcagctggggccgggcgtggtggctcacgcctgtaatcccagcactttggcaggctgaggcaggcggatcacctgaggccaggaatttaagaccagccaggctaacatggtgaaaccccatctttactaaaaatacaaaaaaattagccaggcatggtggcgcatgcatgtaatcccagctactcgggaggctg

SEQ ID NO: 121363 - DNA, 601 bp, Human
agccccaggctctgagtatggagtggggagacctgaccataccccgcagtcctggacaatgagtggccacaatagagtggattttggggtctggcacacagtaggtgcttaatacatgactgttggaggaagccaaattcctctgattcttcttcccttactccaaatcacaataggacagctaggaaatgtcacctcccatctcctggacacaacacgcacacatacacacacacaacacacagggacccacatacacacagacatgtgcaaacacacaagcgcttacacattcagacayagacactcaaacacacagacatgcgggtaccgaaagacacagaacacagcacagactcatgccctcatgcacaaagacagatgcatggatgcacgcttgacattcaagagaagtcacaccccggtcaccacagcctcgttcctcaccacgctccttaatctttggttaatgagggaagaggatatggaggctgccacagcagacacattcgatgggcccacagcgctggttgggagaaacagtccagtcacattcattactgggtaagccagttataggtggggcgaaatccatattggt

SEQ ID NO: 121364 - DNA, 601 bp, Human
cctcatgctgttccactggggctctggggagacctaaaaaagcactgttcacgggaggctcagagaagttgtgtaacttgccaaaggtcacagagtggagcaccccttgaattcaggcccttttattctaagtaacaacctcgggttttgacacctggtctccccacacttccctggctcatgttccctggtgggactggtggaggtggggagagaggggcaatgggaaggagggacactgtctgaggccaggaagggtggctctggcccaggttgacacccaatatcctcctctgacctyattctgggaagagggtgaacatgccagctgccctagggcgggcggtaccttgtttattcacttagcaaacctctcctgggtctgatcctgggaaaggccctgtgctggagggggtggatgggtgggaggaggacactctatttgcagccactccttgtggtgtcctcaagctgttcacagtccgtggggagaagattccgtaacagaaaccaagatgaaacagaccggcaatagagtggtcacctccccgcacagcagcctcgtcctacattcccagcctcagagaagggcagtaatgtt

SEQ ID NO: 121365 - DNA, 601 bp, Human
gatgatgggctgggtgcggtagctcacacctgtcatcccagcactttgggaggccaaggctggcagatcacttgaggtgaggagtttgagaccaacctggccaacatggtgaaaccccgtctctactaaaaaaaaatacaaaaaattagctgggtgtgatggcgtgcacctgtaatcccagctactgagacagaagaattgcttgaacccaggaggcggaggttgcagtgagccgagatggcaccactgcactccagcctgggtgacagagcgagactcaatctcaaaaaaaaaaaaaaaagccggaatgatggatcattacacttctaaaactctaggcgggtgaagcctggtggacgcccctcatgctgttccactggggctctggggagacctaaaaaagcactgttcacgggaggctcagagaagttgtgtaacttgccaaaggtcacagagtggagcaccccttgaattcaggcccttttattctaagtaacaacctcgggttttgacacctggtctccccacacttccctggctcatgttccctggtgggactggtggaggtggggagagaggggcaatgggaaggagggacact

SEQ ID NO: 121366 - DNA, 601 bp, Human
ggggtggggtcacaatagttttagccgcactggttgtgatgacttctggaggggatgtctctcagaagccccctcatggcaatgttttctagaaggggctgagagccctgggcagtggacaggtagcaggataatggacctggataatgctcccagggtgcagtcccagaaagtgtgccgggctggggcaggtcattttccctcttgggcctccgtttttccctcatctgtaaaatgggagggtggggctgggtgatcctaagctaggatgatgggctgggtgcggtagctcacacctgtmatcccagcactttgggaggccaaggctggcagatcacttgaggtgaggagtttgagaccaacctggccaacatggtgaaaccccgtctctactaaaaaaaaatacaaaaaattagctgggtgtgatggcgtgcacctgtaatcccagctactgagacagaagaattgcttgaacccaggaggcggaggttgcagtgagccgagatggcaccactgcactccagcctgggtgacagagcgagactcaatctcaaaaaaaaaaaaaaaagccggaatgatggatcattacacttctaaaact

SEQ ID NO: 121367 - DNA, 601 bp, Human
ggaggccgaggcgggtggatcacgaggtcaagagatcgagaccatcctggccaacatggtgaaacccggtctctactaaaaatacaaaaatgagccaggcgtggtggcgcaggcccgtagtcccacctacttgggaggctgaggcaggagactcgcttgaaccggggaggcggaggttgcagtgagccgagatcatgccaccgcgctccagtctggcgacagagtgagactccgtcttggaaaaaaaaaaaaaaaaaaaagaaatgaactaggacagaatagaaactgccggccagtgtgygttcaggaaggctgggtggcttttggggaacattttgctctggttctgcagatgtgagtgagtacaagtggcagcttagatgtttcctaaccatggggtggggtcacaatagttttagccgcactggttgtgatgacttctggaggggatgtctctcagaagccccctcatggcaatgttttctagaaggggctgagagccctgggcagtggacaggtagcaggataatggacctggataatgctcccagggtgcagtcccagaaagtgtgccgggctggggcaggtcattttccctctt

SEQ ID NO: 121368 - DNA, 601 bp, Human
ctattattctaagtgaagtaactcaggaatggaaaaccaaacattatatgttctcactcataagtgggagctaacctacgaggatgcaaaggcataagaatgatagaatggactctggggattcagggggaaagggtggggagaggatgaggtataaaaggctacaaattgggttcattgtgtcctgcttggatgatgggtgcaccacaatctcacaaatcaccactgaagaactaactcatgtaaccaaacaccacctgttccccaacaacctctggaaataaaaaattaaaaaaaaaaacactccaaaatgcctctgtgtgtgcgtgtgtgtgtgtgtgtgtatgtgtgtgtgtgtgtgagagagagagagtcagaaagacctcaaagaagaaagaggagaacaaagatggtgggtgagaaatagaaagagaagtcaaacgctatggtttggagcatgggttccagatgcagcccgcttggggtctcctcctggacccccactggctctgtagcctctgtgccttgcctttcccatctgtgtgatggggacactgatcatctcaccctcatagggtggttgtgaagatgaattaagata

SEQ ID NO: 121369 - DNA, 601 bp, Human
gtatgtagcgggcaggttcctcattttctgtgcctagtgttatgctcttatcccatctgggatttgactcatcattaggatgaattaggatcattaggatcaatccgcattaggggatacagtctacagtcacagacctgcacagacctgctgggttgcaaggagctttctagtctcttgggcatctcttcccatcttctccttccacgctgtgctggctggtgtagccaatggccgtgagaagggatgcgtttcaaaaaatgcctgtgtgatgcatgtttatagcagtacaatttgcaaktgcaaaattgtggaaccaacccaaatacctatccatcaatgagtggataaagactgtggtataaatatgatggaatactactcagcaataaaaaggaatgactaatggcatttgcagcaacctgggtgagatcggagactattattctaagtgaagtaactcaggaatggaaaaccaaacattatatgttctcactcataagtgggagctaacctacgaggatgcaaaggcataagaatgatagaatggactctggggattcagggggaaagggtggggagaggatgaggtataaaaggc

SEQ ID NO: 121370 - DNA, 601 bp, Human
cagtgaactatgagcaatttattattttctatgagggtgacagaaataaagagtatcctaagtgcccaggaggcaagcgacatcttgccttctggaacgggtggcctgagctatctgttctttgcaaatctgctttttggccaaactccctagacaaatcatcttgtgatcttgtgcctcggtgggccccagcctctctggccatcacgctgtgacatggtgcttcatggtgggcatagccagaggccaggccagacagggcacgcggggccccgaggttttctcactgtgtctggcagcrgaggagggtgggctggtggtcagtgggggtggggatgtgacgacggggggaggtcaggagacctgggcctgctgtgcactctttgcctagctctccacgggacctgagcatgtgctattccttctctggcctcagatctgcactctgatgaggttggagtagacgatctctaaggccctgtccctcaatgatggtcccgtgcccatcaagacctctccccagggcccatacagccaggccatgctgctgccttacctgttccctgtgcgagtaatgaccttgaatcaaaatagtcaccgt

SEQ ID NO: 121371 - DNA, 601 bp, Human
agaattgcttgaacctgggaggtggaggttgccgtgcaccaaaattgtgccattgcactccagcctgggcaacaagagcggaactctgtctcaacaaaacaaaacaaaacaaaacaaaacaaacaaaaaaagagactagaggaggaagatcaaaggtttggttttggacatgctgagtttgagatgccttggggatgtgcatgtagagtgtgggtggggcagttgggtgtgcagatgtggagcacaggggtgccatctgggttgaagctatctcacagacacacagagagcttgcctatgratgaagagaggcttaggcctgaggcttggggagccccaatggttagtgaccatctcaagaagaccttgggcaaataatagtgttccttggccccaatttccttttctgtaaaatggaaatgaaaatcctaactccgtctaccttactgggttacagggattaagcaggaagaggaatgtggacgctttagaaaatgcaggatgtcagtgaactatgagcaatttattattttctatgagggtgacagaaataaagagtatcctaagtgcccaggaggcaagcgacatcttgccttctgga

SEQ ID NO: 121372 - DNA, 601 bp, Human
tcacctgaggtcaggagttcgaaaccagcctggccaacatggtgaaaccccatctctactaaaaaaatacaaaattagccaggggtggtggcgcatccctgtaaacccagctacttgggaagctgaggcaggagaattgcttgaacctgggaggtggaggttgccgtgcaccaaaattgtgccattgcactccagcctgggcaacaagagcggaactctgtctcaacaaaacaaaacaaaacaaaacaaaacaaacaaaaaaagagactagaggaggaagatcaaaggtttggttttggayatgctgagtttgagatgccttggggatgtgcatgtagagtgtgggtggggcagttgggtgtgcagatgtggagcacaggggtgccatctgggttgaagctatctcacagacacacagagagcttgcctatggatgaagagaggcttaggcctgaggcttggggagccccaatggttagtgaccatctcaagaagaccttgggcaaataatagtgttccttggccccaatttccttttctgtaaaatggaaatgaaaatcctaactccgtctaccttactgggttacagggattaagcagg

SEQ ID NO: 121373 - DNA, 601 bp, Human
ggtggctcacgcctgtaatcccagcactttggaaggctgaggccggtggatcacctgaggtcaggagttcgaaaccagcctggccaacatggtgaaaccccatctctactaaaaaaatacaaaattagccaggggtggtggcgcatccctgtaaacccagctacttgggaagctgaggcaggagaattgcttgaacctgggaggtggaggttgccgtgcaccaaaattgtgccattgcactccagcctgggcaacaagagcggaactctgtctcaacaaaacaaaacaaaacaaaacaaaacaaacaaaaaaagagactagaggaggaagatcaaaggtttggttttggacatgctgagtttgagatgccttggggatgtgcatgtagagtgtgggtggggcagttgggtgtgcagatgtggagcacaggggtgccatctgggttgaagctatctcacagacacacagagagcttgcctatggatgaagagaggcttaggcctgaggcttggggagccccaatggttagtgaccatctcaagaagaccttgggcaaataatagtgttccttggccccaatttccttttctgtaaaatggaa

SEQ ID NO: 121374 - DNA, 601 bp, Human
cctgggcgaggtggctcacgcctgtaatcccagcactttggaaggctgaggccggtggatcacctgaggtcaggagttcgaaaccagcctggccaacatggtgaaaccccatctctactaaaaaaatacaaaattagccaggggtggtggcgcatccctgtaaacccagctacttgggaagctgaggcaggagaattgcttgaacctgggaggtggaggttgccgtgcaccaaaattgtgccattgcactccagcctgggcaacaagagcggaactctgtctcaacaaaacaaaacaaaacaaaacaaaacaaacaaaaaaagagactagaggaggaagatcaaaggtttggttttggacatgctgagtttgagatgccttggggatgtgcatgtagagtgtgggtggggcagttgggtgtgcagatgtggagcacaggggtgccatctgggttgaagctatctcacagacacacagagagcttgcctatggatgaagagaggcttaggcctgaggcttggggagccccaatggttagtgaccatctcaagaagaccttgggcaaataatagtgttccttggccccaatttccttttctgt

SEQ ID NO: 121375 - DNA, 601 bp, Human
gcctcccaaagtgccgggagtgcaggcgtgagccaccacacatggcctatagaggtattttaattatccccactctacagagaccaaactgaagcaaggagaggttaagccatttgttcaagatttgtgaatccaggcagtctgactctagggtctgtgtgtctaaccactgcattcccttcttttcaggctctacactttgctgcccttcaaagcatcctctgagcttatgtggggatcaggacaggtctccctgaggaagtggtggtagagctgacctctggcgaataaggagcagctrattaggcacaatgaaggcagggctgtgggagagagagcagcaggagccgaaggtggaggaggcatggctccttcagagacctggaagaaggctggatcacgaggagccagtggaagagtgtggggagcactgaagggaggagccagtggaggagtgtggggagcacctaaggagaggaggcaggcgggtctgggccacgtggggcctcatgagttgagctaaagagcttagctttatcccaagagcaatgggaaactttaaagggcttagaacaggcagggctgtcatgatctgatttgc

SEQ ID NO: 121376 - DNA, 601 bp, Human
ttattatttttttgagacagagtcttgctctgtcacccaggctggagagcagtggcgtgatctcggctcactgtaacctctgcctcctgggtttgagtgattcttgtgtctcagcctcccaagtagcttagattacaggccatgtgccatcacacctggctaatttttgtatttttagtagagacggggtttcaccatgttggccagcctggtctcaaacttctggcctcaaatgatatgcctgcctcagcctcccaaagtgccgggagtgcaggcgtgagccaccacacatggcctatakaggtattttaattatccccactctacagagaccaaactgaagcaaggagaggttaagccatttgttcaagatttgtgaatccaggcagtctgactctagggtctgtgtgtctaaccactgcattcccttcttttcaggctctacactttgctgcccttcaaagcatcctctgagcttatgtggggatcaggacaggtctccctgaggaagtggtggtagagctgacctctggcgaataaggagcagctaattaggcacaatgaaggcagggctgtgggagagagagcagcaggagccgaa

SEQ ID NO: 121377 - DNA, 601 bp, Human
gccaagagtatactctatactggggaaaaggccacgtggtccagagcagggagatgctttgctctaggctagctgtgaatccagtgagcaaatatggactgagtgcccaccgctgtgctagacctgggcttggcatgagagacatgaggggtccaaaacaggcctggttcatgtctttctagagcttatactctcatgaaggacatgtatgccatcagataatcacacagcctggataacgtgctatgaaagaaaagtacctatatggcaccatgagggtatgtgacaggctaatgtcacrtgtagacaactaatgtccatagagagcttagagtatgccgaggactgttttgagcactgcacatacacaaactcgttagttctcattacaactctgtgaagtaagtacttcatattatttttattttttaaatttattttagttctacttattgcattatcttaagcagcatataatagtatggcctctgaaatgtgatagacctggattcaaatccaatgcttttgttttttactttttaattattattattatttttttgagacagagtcttgctctgtcacccaggctggagagcag

SEQ ID NO: 121378 - DNA, 601 bp, Human
ttggggctgggctcggtggctcacacctgtaatcccagcactttgggaggccgaggctggtggatcacttgaggtcaggagttcaagaccagcctagccaatatgatgaaacctcgtctctaccaaaaataaaaaaattagctgggcatggtggtgcacacccatagccccagctacttggggggctgaggcaggagaatcgcttgaacgcgggaggcagaggttgcagtgagccaagatctcaccactgcactccagcctgggcgtcacagcaagattctgtctcaaaaacaaaaacaamaaaaaaaaagaattaaattgggtcctaccttttactgtgtctcacactagaagttgcacagtaaaaggtagcaatttttatttctgaggtccctcttcccaaaacatcagtccaggcataacttccctataaattgtcctcacttcctacaaagccaagcatggtcttgttgccaaaatctatcacaagagtcaggaaatatctgatttatttaatgaacaaatatttactggtctcctatgagtaagcatatggcacttcacattacctgacaacatttatggagcccctcccctgtac

SEQ ID NO: 121379 - DNA, 601 bp, Human
ataatctccattttaatgagatccccagagcaagatttgcatgcatatgaaagtttgagaagtgctgttataagaattaaattggggctgggctcggtggctcacacctgtaatcccagcactttgggaggccgaggctggtggatcacttgaggtcaggagttcaagaccagcctagccaatatgatgaaacctcgtctctaccaaaaataaaaaaattagctgggcatggtggtgcacacccatagccccagctacttggggggctgaggcaggagaatcgcttgaacgcgggaggcakaggttgcagtgagccaagatctcaccactgcactccagcctgggcgtcacagcaagattctgtctcaaaaacaaaaacaacaaaaaaaaagaattaaattgggtcctaccttttactgtgtctcacactagaagttgcacagtaaaaggtagcaatttttatttctgaggtccctcttcccaaaacatcagtccaggcataacttccctataaattgtcctcacttcctacaaagccaagcatggtcttgttgccaaaatctatcacaagagtcaggaaatatctgatttatttaatgaa

SEQ ID NO: 121380 - DNA, 601 bp, Human
ctttcccccaactgagtcataatctccattttaatgagatccccagagcaagatttgcatgcatatgaaagtttgagaagtgctgttataagaattaaattggggctgggctcggtggctcacacctgtaatcccagcactttgggaggccgaggctggtggatcacttgaggtcaggagttcaagaccagcctagccaatatgatgaaacctcgtctctaccaaaaataaaaaaattagctgggcatggtggtgcacacccatagccccagctacttggggggctgaggcaggagaatcrcttgaacgcgggaggcagaggttgcagtgagccaagatctcaccactgcactccagcctgggcgtcacagcaagattctgtctcaaaaacaaaaacaacaaaaaaaaagaattaaattgggtcctaccttttactgtgtctcacactagaagttgcacagtaaaaggtagcaatttttatttctgaggtccctcttcccaaaacatcagtccaggcataacttccctataaattgtcctcacttcctacaaagccaagcatggtcttgttgccaaaatctatcacaagagtcaggaaata

SEQ ID NO: 121381 - DNA, 601 bp, Human
ttgaatcctcgctttgtcagttatcaacagtgtgacccttgggcaagggtcattactgctctgagcctcagtttccccatcctgtgaaatgggaatagtaaaaataatatttagcttataggaatgttgtaaggccttgctgctgcaagtgtggcctgaggcccagcggcattggcatctgattagaaaggcagccctgccaggcatggtggctcatgcctgtaatcccagcactttgggatgctgaggtgagcggatcacatgaagtcaggagttcgagaccaacctggccagcatggcraaaccttgcttctactaaaaatacaaaaattagccgggcgtgacggtaagtgcctgtaatctcagctacttgggaggctgaggcaggagaaccgcttgaacccgggaggcagaggttgcagtaaactgagatttcgccactgcactctagcctgggtgacggagcgaggttccatctcagaaaaaaagaaaaaagaaatgccgcccctcagctctttcccccaactgagtcataatctccattttaatgagatccccagagcaagatttgcatgcatatgaaagtttgagaagtgctgtt

SEQ ID NO: 121382 - DNA, 601 bp, Human
acaaagtgtctttgcgaagtaaaacattttttttttaatccaaattcaaataggcagtgagtgacctcaggacccagctccgtgtcctgggagccatgggctaggcaggaggcagagctggcttgaggcaggggtgagggaaaatatgtcttctttattattattattttttgagacggagtcttcccctgtcacccaggctggagtgcagtggtgcaatctcggctcactgcaacttctgcctcctgggttcaagtgattctcctgcctcagcctcccaagtagctgggactacaggcgkgtaccaccatgcttggctaatttttgtacttttagtagagatggggtttcactatgttggccaggctggtctcaaactcttgacctcatgatctgcccaccttggcctcccaaagtgctgggattacaggcttgagccaccgtgcctggccaaagatgtcttctttaaatggtgcttaagtggtttctaaggaagttgagtcctgataattacaggaccctttggccaagcccagggattggtcagggaggttggttttggaggggaatgtgccaggagcggagcttcctcttatcccca

SEQ ID NO: 121383 - DNA, 601 bp, Human
tcctacagttgggggtggatgggggaaaagggggacaggtggctaagggcagaggtcggggctacatgtgtttgtggggggagcagcacctgaatgaggacccagaggtgttggggagcccttcacaaagtgtctttgcgaagtaaaacattttttttttaatccaaattcaaataggcagtgagtgacctcaggacccagctccgtgtcctgggagccatgggctaggcaggaggcagagctggcttgaggcaggggtgagggaaaatatgtcttctttattattattattttttgagamggagtcttcccctgtcacccaggctggagtgcagtggtgcaatctcggctcactgcaacttctgcctcctgggttcaagtgattctcctgcctcagcctcccaagtagctgggactacaggcgggtaccaccatgcttggctaatttttgtacttttagtagagatggggtttcactatgttggccaggctggtctcaaactcttgacctcatgatctgcccaccttggcctcccaaagtgctgggattacaggcttgagccaccgtgcctggccaaagatgtcttctttaaatggtgct

SEQ ID NO: 121384 - DNA, 601 bp, Human
ttgtgaggattaaatgagttgattcaggcaatgcacttagataagtttctggtgtctataataaacattcaatgcatgatattataataaatatttgtgtatacatatgcttccaccatgaaccatgggtcgtgagacaaggactgtggctttacaaagaaaaagtttcttgtctttatcctctctgttcaacgacacagtagtctgccaatagaagctcattaagtgaataaatgtggggtcgtggtccagaaggaaggaacaggcacattgcaaagaaaacaaagtaagaagagaaacycctctagataaggactgacaaacaggaccggagaagaaaagaatatggtaatgaaaagggagaaacagaaggtgagggccagggctcctacagttgggggtggatgggggaaaagggggacaggtggctaagggcagaggtcggggctacatgtgtttgtggggggagcagcacctgaatgaggacccagaggtgttggggagcccttcacaaagtgtctttgcgaagtaaaacattttttttttaatccaaattcaaataggcagtgagtgacctcaggacccagctccgtgtcctggg

SEQ ID NO: 121385 - DNA, 601 bp, Human
ctgcgatgcagaggccacccatgaaaagcagaatcacactcaggattgggaaaatgctggaggccctcacggcccctgtggaacacagagggtcagggagaaagagaacggcatggctgtgagactgaggcacacagaggcaggtgggagagcagccccgaggcgctgggggtttatggacacagccttagaggagaggttgctttgcaatcctagggagggagagacagcgagcaggccactgcccagctcacagccctgcaggagctccccactgcctccagggccaaactccagcacrccgtcaggcacacagggccctgtgtgacttggcctctgcccacttccagctcccacggctcccagtcctcatgttctctctcgtcccaccacatcaaacttcccacgacatgtcatttcatgctgctgacttttgaaatacagagcttcctactggaatgtctttcctattcttcactcagcaaactcttcttcatccttcaaaacccagctcgaagtcccctcttctgtaaagccttccctgacttccttaggcaaagttatgagctccctcgtctgcactttggggcccttgggcacg

SEQ ID NO: 121386 - DNA, 601 bp, Human
gccctcgtggcccctgagcacccagaccccagccttcttcccagtggcaggactggatcagtggctgttacctgcagacacgaagaagatgccggcactcaggatgatgttgtgtcgagttttgtagaactcgctggctgcgatgcagaggccacccatgaaaagcagaatcacactcaggattgggaaaatgctggaggccctcacggcccctgtggaacacagagggtcagggagaaagagaacggcatggctgtgagactgaggcacacagaggcaggtgggagagcagccccgaggygctgggggtttatggacacagccttagaggagaggttgctttgcaatcctagggagggagagacagcgagcaggccactgcccagctcacagccctgcaggagctccccactgcctccagggccaaactccagcacaccgtcaggcacacagggccctgtgtgacttggcctctgcccacttccagctcccacggctcccagtcctcatgttctctctcgtcccaccacatcaaacttcccacgacatgtcatttcatgctgctgacttttgaaatacagagcttcctactggaatgtct

SEQ ID NO: 121387 - DNA, 601 bp, Human
ccttcatgaacaggtggggcggtgtagatggacatccgcaagcttccccttaacattttatctttccattcagagagagccacaagggaagcgctaatggaaacagacatgggcagggcgggagaagggaggcatttcacaaggcgctgagtaactaataatagatattgttcattgagccttctctacctgctttcactgcttggtgcttctcaagcagggcacagatgaggaaacaagcacagagaggttaaggaacttgcttaaggctgcacagggcttcaaagctggtgtagcagcrggtgaaggcgggctgatggagccaggctggcctgcgttcaaagccttcgcaagttaaccttggtttgagtttccagatctgtagaatgggagtaaggttaagccttactctttagggccacggagagggttaaatgggtgaatacatgtgagtactcttagatgttggtggttcctttttttttttttaagatacagtcttgctctgtcacccaggctggagtgcagtggtgtgatcacagctcactgcagtctcaaactcctgggatcaagcgatcctcccaccttagcctctctagta

SEQ ID NO: 121388 - DNA, 601 bp, Human
aggtagtccgtggcgcgggccgtggcccgcagctgtttgtgccggtcgataaacatgtgcaccgccagcaccccgaccatctcggcgatgatgaaggacagggccccgaagtagaaggaccagccgtatgagtaactattctttttggagtcgctcttggaggggtctccggcattggcagatatgtacactatgatgccaatgatgttactcagacctgcggggcgcagggtggcggggtgggggatcagagagaaggacgttagtttctcaggaagtcggccacagggcagccgtaaargacggggacagctgtgtgggccttccccggtcccgcgccttcatgaacaggtggggcggtgtagatggacatccgcaagcttccccttaacattttatctttccattcagagagagccacaagggaagcgctaatggaaacagacatgggcagggcgggagaagggaggcatttcacaaggcgctgagtaactaataatagatattgttcattgagccttctctacctgctttcactgcttggtgcttctcaagcagggcacagatgaggaaacaagcacagagaggttaaggaacttgc

SEQ ID NO: 121389 - DNA, 601 bp, Human
tcttaatctgacaacgagcaactatgaaaaatctaatctaatatccaatttaatggtacaatattgaatacttttctctaaagttcagaaagaagccaaggatgtccactctcaccacttctattcaatattgtattggtggggtaagcaagtgcaataaagcaagaaaaaaaaagccataaatttttttttaaaaaaggagatgaaactatctctgtatgaagatgataggattatttacatagaaaaacctgaggaatctacaaaacaactagaagaataagtgaatttagcaaaattmcagaatataaagttaatatataaaaatcagttatattttaatattagcagcaaacaattagaaaataaaataaaaccaattccatttataatgggatcgaaaaccataaaatacttaagcacaaattttaaaaatatatgtgcaagacctgtattaataaaactataagaccactgctgagagaaaatgagaccttaaaaaatggggagatatattatgctcgtgaattataagatgctatattacactaaggtgttgattcttcccaaattgatctacatactcaatgttactgtaatc

SEQ ID NO: 121390 - DNA, 601 bp, Human
ttcaatatatatagaaaaaaatttgacaaaatacaggagccattgatgacaaaaacccttttcaaataacagaaaataattttcttaatctgacaacgagcaactatgaaaaatctaatctaatatccaatttaatggtacaatattgaatacttttctctaaagttcagaaagaagccaaggatgtccactctcaccacttctattcaatattgtattggtggggtaagcaagtgcaataaagcaagaaaaaaaaagccataaatttttttttaaaaaaggagatgaaactatctctgtwtgaagatgataggattatttacatagaaaaacctgaggaatctacaaaacaactagaagaataagtgaatttagcaaaattacagaatataaagttaatatataaaaatcagttatattttaatattagcagcaaacaattagaaaataaaataaaaccaattccatttataatgggatcgaaaaccataaaatacttaagcacaaattttaaaaatatatgtgcaagacctgtattaataaaactataagaccactgctgagagaaaatgagaccttaaaaaatggggagatatattat

SEQ ID NO: 121391 - DNA, 601 bp, Human
ttcaccctgttggccaggctggtcttgaactcctggcctcaagtgatccacccaccttccaaagtgctggaattacaggcgtgagccaccacgcccagactaaagcagtgtttatagggaaatttatagcttcacaagcttaccttagaaaaggtaagtaaggtttcatcttaagaagcttagaaaaagaaaaacaaaataatatatactgaaaataagtgaaggaataagtaacaaaggtatgagcagaaatcaactcaataggcaacaaaccatagagaaaattaacaaagtcaaaaaktggttctttgaaaagattaacaaaattgctaaacccctaggtagactgagtaagaaatatttttttaaaaaagaaagagaattcataatttgccaacagtaggagtaaaaggggatttcagattctacagacatcaaagggataataatggaatattatgaacaacttcatgtcaataaattcaataacatagatgacatgggcaaattattcaaaaatataacctaaaattcatataaaacacaaaccttacatatttacttaaaaaattaaattatcaaaaccttttcagaaagaaat

SEQ ID NO: 121392 - DNA, 601 bp, Human
gagcaagacagataagcattctagtaaggtgcaacaaataataagcaaacacataaacctgagaaaatatcagggagtgataaatgctataaaaaataggataatatgatacaggatgatggaactactttagaatgaaaaggtcttcccgaggaaatgacttataccagacctaagttacaaggagctaaatacatggagatcccaggcaagagcgcttgaggtagaaacaaccgatacaaaggccttaactaactccaatagctaaggccttcagtaagcttggtgtatttggaatgtraaaagaacaatgtggagtggagtgaactgggaaaaaaacgatattttatgaactcagagagtatacaggggccatggcataggtagccctgtgtaaagccacagtcagtaaagaggcgagggctgtggtaggagagcgagaaaaggaggcagatgcagggtacgttctggaggtaaactcaaggatttattgaagaagtaaatatgtgagtgagactaaggaatcaaggaaagtacctattttgtttgtttgtttgtttgttttgagacggagtcttgctctgtcaccaggctggagtgc

SEQ ID NO: 121393 - DNA, 601 bp, Human
tgaatagcggggactcaaactcaggtttgaacttaaaaccaaaatttatattcagcacaatttcttgcatatagttaacgctcaataaatgctagatgttagaacagtatctaaaagtgcaacagagcactggtataccaatgagcggaggtggtgaggaacaccttggtcattggaaggtgtatctatatcctgtattttgatgttgagaaaagcgcagcttagcatacatgcctttttctggtctgtggtatcccttaaaaggatatcaactttcttgctacatgactttatttaaatracttcaggcttttgtgtattggtttcctcagtgaaaagtaatatggttccaaaggtaaagatcacagatgtgtctactaaggcgttcctatgcaggacaagaagctagattagacaactccaagagtctgttattgtaaggtaaggactatggatgtctgtgtctgagctgtagaacctatacctgaacagaacagacaattgtaggggaaaaaaaggtcacatttcatattcaagagaagggcactatctctaaaacatcatagtttatcaaaaggacttcattctcaccctaagaatg

SEQ ID NO: 121394 - DNA, 601 bp, Human
ccatcattctgttttacctactataccaaactccataaattagatcttacagggaaactagccaaggtctaattaagttttacatttcctaacaaggaaataaattaaaactgccacacttcttttgggaattcaagtcttgctcttacttcaaatgtacctgacaattataagtcagttcactttcataaagatttcacataaacaagttgggctaacagtccctgtgaggcaatagatttggaaataattttaggctatgacatgtcacttaaaacattacttcattcagtaaaaagckgatttagttataatcatacaatttcaaatctgcatgaacccttagagatacttataactccaacctgagggtcagagtagtgacctgctcaaggagtcaaaggaaattaatgacatgggaaggtgctacagtcctaacactcttcccctcaccctacgctcttactagagtatttcatcatcctttgcaggatctggaaaggtctagaattaattcatttacataacataaacgaacatctgtttatataaagagttgttctaggctctgaatagcacacaaagttgtagaaaacatggt

SEQ ID NO: 121395 - DNA, 601 bp, Human
aagaccagcctggccaacatggtaaaaccctgtctctactaaaaatatataaattagctgggcgtggtggtgtgtgcctgtaatcccagctaactgggaggctgagacaggagaatcactagaacccaggaggcggaggttgtagtgagctgagatcatgccactgcactctagcctaggtgacagagcaagactgtctcaaaaaaaaccaaccaaacaaacaaaaaaccaaaaaacaaagtaagggtttaaacaaaatgatttttaagttatcttccagccctaaaatttaaatcagttwaaatgtccctatcttcagaataataaaaccaaaggtgtaggtttctaaaatgatggctggtgtgctgagcagaattctgacgtgccccccgcccagtatttccaccctctggtccacatatcctgtgtaatcccctctcctcaggtgggcagaacctgtgactacgataatcctgtgatgaggttactgtatatgagaaaggtgatgggctagtcagtcccataactatgttatgtaagaatccatcttagcagactgaggcgagagattctgttgctggctctgaagaagtgagttgcc

SEQ ID NO: 121396 - DNA, 601 bp, Human
tgatgactctgtcttaaatgaatggaatcctggccaacactcctcttcacatataaatgtttttaccaaatgtaatgatgaactgaagtgcaagagcttgcctcccacaaactttaaaagaatttataaaataggagcttttttcctgttgtaatctcttccttacatgtctttgtgacactcctgccttcctgccatgtcttggctgtctgggggatgctctccctacattcttgctgtgaatttgccccactttccggcatcacataaaagcattgagtcctcgatgtaattctctagstccttctagcagcagtaggtgccagggtactaatgagaaccctggtgtggaagtcgctgaacctgaacttctggtctgtgatttcagcaagtcatttccctttatgaatgttaaaaacaagcaggccgggcacagtggctcacgtctataaatccaacactttgggaggccgagctgggcagatcacctgaggtcaggagttcaagaccagcctggccaacatggtaaaaccctgtctctactaaaaatatataaattagctgggcgtggtggtgtgtgcctgtaatcccagctaactgg

SEQ ID NO: 121397 - DNA, 601 bp, Human
tgccattgtctagtattgtatctgggtttattaaaaatccccatcacatcttttccacaaagggctagcatttctgcaagcatcattaggtagtcaatgatttcagctgacacacccatgggacaatcacagtttggtggaggagactgtgtatatatatatctatacacacacacacacacacacacacacacacacacacacacacacacattaagatggagaaacacgtagaagagacagatatcagatatattaatacacacatatgggaaataatggaatagtgtgtatttggtaygagttacattttggatctgaattcttttttttttttgagacagtcttgctctgtcgcccaggctggagtgcagtggtgcgatctcggctcattgcaacctcgcctcccgggtttaagtgattctcctgcctcagcctccctagtagctgggattacaggtgcctgccaccacgtccggctaatttttttttttttttagtagagacagggtttcgccatgttggctaggctggtctcgaactcctgacctcaggtgatccacccgccttgacctcccaaagtgctgggattacaggcatg

SEQ ID NO: 121398 - DNA, 601 bp, Human
attccctaggaactcataccgacaattttagggacaacttaaaaagtgtattcaacagcaatccaacgaaaagcacatgtaacgaatgtggccctgggagtttttctccacagctgcctctgatgcacagatacagctttaggcagcatgacccagttaggagctacctgcctcttcctaatgcaaaagtgtttggaaaggtggtatgacaagttgggctgacagtctctaagctgtgtggccatgtactattcctgccttaccggactgcagtggagaaaatcaaaagctgactggtgayggccaaggttaagtgaggggagatggttctgcttcagccctggaaaggctgatgcagatgtcttgttttcttaagtccatccctagatggctttgggtggaacaagggggaggatatttccttaaagagcatgtgtcctgtcttttgtatctccttccatgagcttttgttaatacaaatgcacattttaacctagttctggggtgaggggaggggaaacgacaacatttaggagaactagcaatttaaggagccaagagcaatgcagcctacaagtaatggaaatgataacaattcctt

SEQ ID NO: 121399 - DNA, 601 bp, Human
gaaggaacagaaatcaggccaatttgcaataagaatagtaactgttaagagaactacaatgatgacagctggtcattatacttctcagtaggaaagctactaaggaaaccccattcacctcagaagattaacctcaaaagattactcagtgaaaacagaatgagatcagaaggaactggaagcgcttaaactgtgattgcctacagctttactctttgctgccacagaaatgtgtcctgagaaggggatcggaacctgttctgtattagataaacatgaacactttctgttaaccattcckttttctgcatttcacatcaaccttaagcttctgacttccttttctctttcccagttcttccattctctcagggcacagccttctgcaattgtcttgatatttcaagtactcatcttctccccatgaagatggtgccctttcctgtaaataaaccattaattaaataatactcaaggatgtcagtgagagctcttgacaatttctaatgagaggctcattaaattggtattaagtggttgtagaatagggacttctggaggcctccagcaagaatgcctcattacagatgccatctcttca

SEQ ID NO: 121400 - DNA, 601 bp, Human
acggagtcttgctctgttgcccaggctggagtgcagtggcgcgatctcagctcactgcaacctccgcctcccaggttcaagcgattctcctgcctcagcctcctgagtagctgcaactagaggcgcatgccaccatgcccggctaatttttgtacatatatatttttttgagacggagtctcactctgtcacccaggctggagtgcagtggtgcgatctcggatcactgcaagtaccacctcccaggttcatgccattctcctgcctcagcctcccaagtagctgggaccacaggcacccrccatcatgcccagctaattttttttgtatttttagtagagatgggtttcaccgtgttagccaggatggtctcaatctcctgacctcatgatccgcccaccttggcctcccaaagtgctggattacaggcgtgagacactgcgcctggccaagagcatctgttttaattagaaaccacccaagccacacagaacagtaaccactgtaatagcagaggtacagtcaccctttgcaagacacccaggggcctgttgattaaaataatgacacccattactggtggtgataagatagcaggaaa

SEQ ID NO: 121401 - DNA, 601 bp, Human
tcagaaaaaaactggaagcaggggagtaagaagcaggcagatttccattttggacagatttttctggctggttgtgtgaggatggattggaaggcggcacacctggaatattggggtcagttaggagactgctgcaatagtctctctgctgtaatggagagatggtgagggggtttcgtggtgaaaaccaaaatcaaactttggctttggattgagcccattttctcatggtttcctaatccaccctcttcagtgtcagagggctggaagaaactttggagagcatctgtttttttttttkttgttgttgttgtttgtttgttttgagacggagtcttgctctgttgcccaggctggagtgcagtggcgcgatctcagctcactgcaacctccgcctcccaggttcaagcgattctcctgcctcagcctcctgagtagctgcaactagaggcgcatgccaccatgcccggctaatttttgtacatatatatttttttgagacggagtctcactctgtcacccaggctggagtgcagtggtgcgatctcggatcactgcaagtaccacctcccaggttcatgccattctcctgcctcagcct

SEQ ID NO: 121402 - DNA, 601 bp, Human
gtggtggcttgtgcttgatttcctagctacttgggaggctgaggcaggaggatctcttgaggtcaagagtttaagaccagcctagacaatatagcgagaccctgtctctaaaaatttttttcaaattaactgggcatggtggtggacacctgtagtcccagctacttgggaggctaaggcaggaagatcgcttgattaccacccggtgattgcggcaatcaccaggagctcaaggctgcagtgtgctatgatgaccactgcactccagcctgggtgacacagtgagaccatgtctcttggaaaaaaaaaaaaaaaaaagaggtgggcaggagacaggtccccccagggtctgtattgctcctaaaggtctggcactttctcttccaggcaatggaacatcagaaaaaaactggaagcaggggagtaagaagcaggcagatttccattttggacagatttttctggctggttgtgtgaggatggattggaaggcggcacacctggaatattggggtcagttaggagactgctgcaatagtctctctgctgtaatggagagatggtgagggggtttcgtggtgaaaaccaaaatcaaactttg

SEQ ID NO: 121403 - DNA, 601 bp, Human; identical to SEQ ID NO: 33892

SEQ ID NO: 121404 - DNA, 601 bp, Human
cctggtcagtgcaaatgccaacctcccattatatgctgtgtgaatcttacttagtcttcaagattaatcagatttctagcatctccatgaagatttatttttgatagacttttttcacatagaagtaattttggcctcgcctatattttcatagtaattatctatagcattttcatactacttaaggtgctagtaattatctatagtactttcatactacttaaggtgctcaaattacattatgcctatttggggatatgttttaaatcataagattccggagcacaaaaagaactatatyttattttttgtatcctttccccacatctagttcaatgaagtgcatatagtagatacccagccaatatttgctatataatcaagggaagataataaaaggcattagattaaagccaaaaatgttccatgaaaagttatgaaaggagaataggtgaaatatgtcaaattatactttgaataaaaccagtattttaaacaaaatatgcttaattatatgaaaaaaccccattgctggttcaaactacaaagcatttagtgtatttcatatgtacttgtgaacatatatgtttttcactcatgg

SEQ ID NO: 121405 - DNA, 601 bp, Human
ggttattatctattcatattcactgcttatacatccccacaggtttcttttacctaagcatgtgaatcagctctttatgtttaatacatatttaccatctgtcttttcatacttgacatgcattcgttttcctaagatttttccctatttagtttttttatcatattctttcttttttctttctttctttttgtttttgagatggagtttcgctcttgttgcccaggctggagtgcaatggcgtgatcttggctcaccacaacctccgcctcctgggttcatgtgattctcctgcctcagmctccggagtaactgggattacaagcatgcaccaccacgcccggctaattttgtattttcagtagagacagggtttctccatgttggtcaggctggtcttgaactcccgacctcaggtaatccacctgccttggcctcccaaagtgctgggattacaggcgtgagccaccgtgcccggcccatcatattcttaaggccaactttatcttcaacatttggaataaataataagcttgtgatcctccttattatataaaataataactttgatttttgtaacagcagttgaatgtgtatataa

SEQ ID NO: 121406 - DNA, 601 bp, Human
gccaccatgcccagctcatttttgtatttttcaccgcgttcatccagctggtctcaaactcctgacctcaggtgatccaccctccttggcctcccaaagtgctgggattacagatgtgagccactgccccggccattattttcataatttagctttcttcttttaaaatgtttctttaggataattcatcatatgtgaaactaaaaagtgaaaggaaaactattttgaacttcttgggctctactgtcttagtgatctttaaaaagataacataaatttataaatattccagacttatatrtgaatatggcagtttcaagcaaaattcactaccattgaataataaagcttattttagaatcatttagattttgataagagttaaataatacctaaaagtggttttcatttttattttttattattaatgtaagagagagatttcactgtaattgtctgtcatacattgttcttcttgggttattatctattcatattcactgcttatacatccccacaggtttcttttacctaagcatgtgaatcagctctttatgtttaatacatatttaccatctgtcttttcatacttgacatgcat

SEQ ID NO: 121407 - DNA, 601 bp, Human
aaaaagcagaccacctgtaattcctgcactttgggaggctgaggcgggtggatcacctgaggtcaggagttcgagaccatcctggcccaatgatgaaaccctgtctctactaaaaatacaaaaaattagctgagtgtggtggcgggtacctctaatcccagctactcagaaggctgagacaggagaattgcttgaacctgggaaacagaggtagcagtgagccaagatcaggccactgcactctagcctgggcaacaagaataaaactctgtctccaaaaaaaaaaaaaaaaaaaaaaaarggaaagaaagaaaaagcaagcaagcaagcaagctgactgttcctgaacatccattttcaacctacaaccccttggggctttgtcttccccaccctggcttcattttctttcccccaaaaacatatattccttatttgtcttgtctatcatctgtcttctctcatccaagccagatccatgatgtggacttttgatctctttggttcagggatcagagagttcctgaaggtgctcattacatacataatgccgtatttaaaattacataaataaatgaaaggcaagatatttttcaagatg

SEQ ID NO: 121408 - DNA, 601 bp, Human
aagtgggtaatcaaggtaggaatacagaaaagatgacaatgaatcagggttttgaaaatgagcagaatctggggtaaggtcattccaggatggaaaatatcatgttaaaaagcatgaaggtatgaacaatatggaactgagagcagttttaatttttcataaagacaacatttatttttcaccttaacatttatttttaatatgccttacttaggttaagagaaaacaaagatttaaaaagccaagtgtcccttttattattatactttcttttcacataaccttttcagcctagattcasgtaacttcctgtctctcccattaaaggagaggggtcctgcacattacaacaggcaaaaaaggctttcaggaaataaaatgttttaatttgatctattacatctgttcaattttcttgagtaccttcgagagtgggaaaaagacaaaaggagaaaaaaatggtattttaaacaaacagactataataaccttagttaggttggtagtacactatttatgctttttctctaaacaggtacaaaggaggttcaaaaagaagaggctggagaggcatgtagccggtagcatccgactcatcaat

SEQ ID NO: 121409 - DNA, 601 bp, Human
tataattatatatatatatatggcacaggcatagtacaaaagtgagtgattaactcttttggggaagtgggtaatcaaggtaggaatacagaaaagatgacaatgaatcagggttttgaaaatgagcagaatctggggtaaggtcattccaggatggaaaatatcatgttaaaaagcatgaaggtatgaacaatatggaactgagagcagttttaatttttcataaagacaacatttatttttcaccttaacatttatttttaatatgccttacttaggttaagagaaaacaaagatttawaaagccaagtgtcccttttattattatactttcttttcacataaccttttcagcctagattcaggtaacttcctgtctctcccattaaaggagaggggtcctgcacattacaacaggcaaaaaaggctttcaggaaataaaatgttttaatttgatctattacatctgttcaattttcttgagtaccttcgagagtgggaaaaagacaaaaggagaaaaaaatggtattttaaacaaacagactataataaccttagttaggttggtagtacactatttatgctttttctctaaacaggt

SEQ ID NO: 121410 - DNA, 601 bp, Human
gacctcaagtctgcctcccaaagtgctgtgattgcaggtgtgagccattgtacccggtctctctctttctctctgtctgtctctctctctctccccttctccctctctcctctctctcccttctttctctctctctcccttctctcttctctcattcactctttcactttccagagcttttctcattttacattggcagccatataaatatgtccttgtaccttttccagcataatctctattttatgtgcatactaagcagcttttaaaaatgttcctgtgtctctttaacatgtatcaraaacattggaaaggtttgataaaaagaaactgatgggcctcaccaccagagtttctgatatttggggtgggggctcaagaatttgcaattccaacaaattctcaagaggtgatgcaattggtctgaggaccacattttaagaaccttttccataaaaggtgattatgacttcttttgttggacacagttccgttcatgtgattgacaaatttagcataaagccaacatcttctgatcatttcttattttcttgaatgctgtgtaatggacttagcacagcacagttctaactgagtgcac

SEQ ID NO: 121411 - DNA, 601 bp, Human
tgcatgtgtctttataccagcatgatttataatcctttgggtatatacccagtaatgggatggctgggtcaaacggtatttctagttctaaatccctgaggaattgccacactgacttccacaagggttgaactagtttacagtcccaccaacagtgtaaaagtgttcctatttctccacatcctctccagcagctgttgtttcctgactttttaatgatcaccattctaactggtgtgagatggtatctcattgtggtttggattagcatttctctgatggccagtgatgatgagcattaaaaaaaaaatgaaacggaatctatattctatgacacaatctgtaataaataacatttaattttagcaaaaaaaccataattagttaaatttgtatatctctcatatacagcaatgtattaaacttacccataagttttaactttcacgtaaaaagacagatgtatgtggaaccctctcatgtatctttctatttacaaacatgtatgtctatttttagaggtgtgttttttgagtgtggaaaaagaggtatctcttctttcttagctgaaaagttttttacaggtgacagaaaataactt

SEQ ID NO: 121412 - DNA, 601 bp, Human
tttttcttttttttttttaattatactttaagctctagggtacatgtgcacaacgtgcaggtctgtcatatattatacatgtaccatgttggtgtgctgcacccacaaactcgtcatctaacactaggtatatctcctaatagctatccctcccccctccccctaccccacaacaggccccagtgtgtgacgttccccttcctgtgaccatgtgttctcattgttcaatttccacctatgagtgagaacatgcggtgtttgggtttttgtccttgcgatagtttgctgagaatgatggttyccagcttcatccatgtccctacaaaggacataaactcatccttttttgtggctgcatagtactccacggtgtacatgtgccacattttcttaatccaggctatcgttggacatttgggttggttccaagtctttgctattgtgaatagtgccgccgcaataaacatatgtgtgcatgtgtctttataccagcatgatttataatcctttgggtatatacccagtaatgggatggctgggtcaaacggtatttctagttctaaatccctgaggaattgccacactgacttccacaagggtt

SEQ ID NO: 121413 - DNA, 601 bp, Human
gacttctgcatctcagaactgtgagcgaatacatttctgttttaagcctcccatttgttacaacaactctagaaaactaatacaggcacctaccacccatgattttcgaatattagctcacggtgctaggatcatatttatctccagaacctaatattgtagctgggaagccagaaggctcaatcaatgttgtagattaatttaatttcatataatactgccttacttttatttaagcttatttttattctgtctcaagaatacccctgttggtcaaataagtattattttaacatccacwtacatttaaggtaagtctcaagactataattttatattttgtcaataactctaagaacaacctccatgggcagcccatccccctctacttactcggaggaagcaaagctgtcattgagcgagcatcaaatttcacagattcggagcagctatcagtgtcctcctgttgattgtgaaagtgatcccactgctccatacttctatgaaacaaaatggaaaaatatattaattccacatgaaatggctagggctcttttgcataatgttttaaactgaaatttcagtttgaaatggaatctat

SEQ ID NO: 121414 - DNA, 601 bp, Human
agctggatgcagtggctcacgcctgtaatcccagcactttgggaggccaaggcgggaggatggcttgagcctaggagtttgagaccagcctgggcaacatggagaaaccctggctctacaaaaactacaaaaattagccagtcatggtagcatgtccctgtaacccaagatacttacgaggctgaggtaggagaattgcttgagcccaagaggttgaggctgcaatgggctatgatcgcaccactgcactccagcctaggtgaaaaagtgagaccctgtctcaaaaagaaaaaaaaaaaaaggaaaagagagaaaaggaaaggaaagaaaagatggaaggaaaaaagaaaaagaacccataatagaagcaagtggagatatagtccacctgccaggttgattaagcctgaaaagtaggagtcatcttctcatctctaatttatcatcacaaatgtaaattctaccttttaaatagctctcaaacattttgattgctttttctctgctcccgatgtctctctcctccttcttcaaactctcatcatttctgtctgtaacagccctcactgttatcttttcttacatgtgtctcacttgtgcc

SEQ ID NO: 121415 - DNA, 601 bp, Human
gcccaaataaacaattttatcaaaattacttcaaaattttcctctaacgttgtccttttttgattattatttcttttgaagtagcagttaagaatttagattctagaatagaactgcctgggttagcaattctggctctgccctttataaactatggcgttggacaagttacttaatctgttattgcctctatttcaccacctgtataaatggggtactaatagtcagtgtccaaataattaaatgaactatatgtaaaatacttagaccacttcctggcatgtaataagcacttgaaaaktttcaggtttttgctatgattaatatttggattcaagatgtgtgattcaggtacctatatgcccaatattgattaactatggggaagtagcattgtgtgataaaaatctttttctggagttggatgttcatatgaacacagtcatctctctgctttattttactatgcacattgctctgattgctcaaccatatacttttactttcactggaaataagatttattttgtatcagtaaagctaatatttttcacaatatggaaagagaagccccaatgtgactaaggtcatatgaccaact

SEQ ID NO: 121416 - DNA, 601 bp, Human
agtatgtcgggtagttccagacattcagcataaagtgttaagtgactagacagtgattttgcttcctagaaacgaggaatcatccaggtttttcatcatacctaaaagctgaggctactttttctttcttttttttttttttttttttttttgagacggagtctcgcactgtcacccaggctggagtgcaatggcatgatctcggctccctgcaacctccacctcctgggttcaagtggttctcccgagtagctgggattacaggtgcacactaccacacctgactaatttttttttttttaattttgtagagatggggtttcactatgttggccagactggtctcgaactcctgacctcgtggtccacccacctcggcctcccaaagtgctgggattacaggtgtgaggcactgcgcctggcagctgaggctgccttattattcccttctttgaaaactgcacatggtgtttacatttgtcaaatttcagtggaaattattttcactgggaggaggaaaagtgtatttaatttcaaaaaatcctatatagcatccacacactccctccacatgctaccaccagtgaccctcctagaaaca

SEQ ID NO: 121417 - DNA, 601 bp, Human
taatttactgatttcctgtaaaacataagtgagcattcacagcctttgttacatacataattatcaaatatgaaagttcaagaaaccctcggagttcaggtttttaaaaacatattatgggagttttatggaataagaatatagaaattagaaaactgttttgaaagtagtaattctttaattgtgaaacatttcctcttttgactgaatggctgaatgtttacaatcacaacccccttcaaaaatcaatttaatgtatctatgatatgtttctattcctatatatatagatgtcaaaatkctaacaataaaattaaataaacaccataaggtcttaatttatctgaagtaaaatgtcttcgtactgtacttacagtggcaacatagtcaaatttcgtgaatttgatagatttatattggaaattgttttatagtaataagtgaagtttaatgtcataatcctcagtggtgatgatcattgacaatagattttcatactcaataaaacctcgaactcgcatattaacagtgctttactttcagtttgcattgcctctgtatttgaggcattagtattttgtgttttcaaatacacgtatat

SEQ ID NO: 121418 - DNA, 601 bp, Human
agttcaaaagatccttttaattaataatacagtcaagtaagaaataaaaaagactggaagttttggaaaagcaatattaacaagcttggtttgtgaacatgtgaagaaacttgtaattacaaaaaacttgtattcagtacttatgaggtagtttttaacaatgagaaaatcattagaccttaagatatattttgcttttccctttctatttaagtgataccaggctactggttatcgtaccctgtctttatctgattttcatattctttcctttgggtatttgcagtaaatgtaagctcaraaactatttatttcaaaccataggatttcaaatatcaaatctctgcatgtatcagtatattttaatatatatatcattttctggagaaatgacaagacattttaccttgaattaaagtgatatttctcaaggtctgagaatgttcccaatctttcagtctgagatcattagtgatgttattcagtactttcacttctccttttatttcctgttccaaatgcacttgttcttctttcatagccataatttctgctgatacattgtaaacacgctcctctaatttactgatttcctgtaaaa

SEQ ID NO: 121419 - DNA, 601 bp, Human
ttaaatacctttctctagagttcatctttgcttctttaaatcacgttatccccaactctccaccaaactctacttcaccatttccacaatgaaattttatgtagttctttaaggctctaattattataactatttgagaaatgtattaaaaaatctttgtctcttttaactgtataattatttagtgattattaatataagggaaaagagaacacaaagtaattacactaactctgcaatcaacacatgataaaggataaagcactcattaatttctaaaatatggttcttaagttataayttaattaatagatattttatggctaggtgctataagagatataaagaacagtttctaatggaagtagcttgtgtccaggaagagtgaacactgttctcgaagagaatatgagatacttttatacataactatcacattaagtattctcttgtgagagaatacttaatgttccatattaagacagaaataagtatcagctgggccttactattggtagaaccagcaaaggcttcatgcaagaggtggcatcttagatggactttgaatgataaacaagatatcttcgaatacaaatcaaag

SEQ ID NO: 121420 - DNA, 601 bp, Human
aattacagttacaggaataattcataaatactatcacaataatctgccatgaagaattacctttatacaacacatgcacaaaatctactatgtagcttcctccatgattacttcttaaaaaggaaaagtaatatttctatataaccacaaaaaagtactgatatataatatttgataatcatcaatatcatagaacaaaattacacaatttactagaaaaacaaacccaggtgtatcatatcatttaaaatcctcagacgataacatagcactaataatatctgactaagtttccagagckatgcttctctagtttttattcattatgagcattaatcttctactccgttttcaatcttgtctcatattcagatcatcataaaaatctgccacatcttctagtctattgctgcctaaacctgcttcttttttttttctctagttttcatgctcattgatttagatatgtttaatctggaagacactttaaacattgtttaactaaacatatttatagagggtcagagagtgagttgctcaaggtcttaaagctagttgggttaaatcagaactagaagaatttcatttctttcctgatcct

SEQ ID NO: 121421 - DNA, 601 bp, Human
gtcagctcccttgctgatacatgtcaaaaaaaatgggttaatattggccaaaatatatgatttattctagttcaagaagccatagaatttacattatttttcatctttaatatttccaattacagttacaggaataattcataaatactatcacaataatctgccatgaagaattacctttatacaacacatgcacaaaatctactatgtagcttcctccatgattacttcttaaaaaggaaaagtaatatttctatataaccacaaaaaagtactgatatataatatttgataatcatcwatatcatagaacaaaattacacaatttactagaaaaacaaacccaggtgtatcatatcatttaaaatcctcagacgataacatagcactaataatatctgactaagtttccagagcgatgcttctctagtttttattcattatgagcattaatcttctactccgttttcaatcttgtctcatattcagatcatcataaaaatctgccacatcttctagtctattgctgcctaaacctgcttcttttttttttctctagttttcatgctcattgatttagatatgtttaatctggaagaca

SEQ ID NO: 121422 - DNA, 601 bp, Human
gagtgactgtcagcaaggtaagtgtcatccatattttagccaatatttacattcagatttcattagtttaaacagatatattccaaatactatataagaaatatagtccaatttgcttgtgattcataactcactactagtgtgagtttttatgtcttaaaaatgagatagcttgcaaatgtgaagatgatttattcaacgcaaagataattgttgtactccccttcacatatgatctacggttaggtctgccttatactgtttgctgtctattatatacatgtcactatctagacttacraacaattccatttggttactctggttaaagcatttattttcttcaacagtcatgagtaatgcttatcattcagtgtattatgtgattaggctactagaacatttactaatcccccaaaacacacacacatatacacacatgtgcgtgcatacacacacacacacacatacacatcctctgcaggatataaataaaatagcaatcctcccctacacatgtacctggatgtatatcatctatcttcacagtatatgattaaatagctaaaattaccatacctattggacctggaaatcctcg

SEQ ID NO: 121423 - DNA, 601 bp, Human
ttcatgttctctcttctgtgtcttctttcaaaatatttctttcaagattacaacttagaggaaaataatttgaaacagttttgctcttagtaaagcacagagagtgactgtcagcaaggtaagtgtcatccatattttagccaatatttacattcagatttcattagtttaaacagatatattccaaatactatataagaaatatagtccaatttgcttgtgattcataactcactactagtgtgagtttttatgtcttaaaaatgagatagcttgcaaatgtgaagatgatttattcaaygcaaagataattgttgtactccccttcacatatgatctacggttaggtctgccttatactgtttgctgtctattatatacatgtcactatctagacttacaaacaattccatttggttactctggttaaagcatttattttcttcaacagtcatgagtaatgcttatcattcagtgtattatgtgattaggctactagaacatttactaatcccccaaaacacacacacatatacacacatgtgcgtgcatacacacacacacacacatacacatcctctgcaggatataaataaaatag

SEQ ID NO: 121424 - DNA, 601 bp, Human
cttggtcaagctgagtttagtaggctcaaatggatgtagagatggggaagcaataaacctgctcagattagaaagcagaattagtatgattgtccatcatatactctttgcttcctgatttcggcatcaaatataaggcaattagacaatctggtggagaaacgaacagaatgcagcaagacatccagaaataattcattaggaaagatgcctggtattttgaatacttttcttgtagtgcaccaaacaaaatggtaacctgataacctagaagagtcattgattaccccaggaactcgayctgtcttttatgaggaactgggtaatgcctatttgtgtaaatgagcagtaccaaaagcaacaaattatgacatcactttttaccctgtaaatttaaaccatgacaaatcgttaatttacaataaaaaaaaaacaaaatcaaagattctttgcaatggtgtctatttataacattaacacaagctgaaatttataaatccttctatttcatacattcacagttcagaaacagctgcagaagattctcccaagatgaagcactgtatggcaagatgtagcccagactgaatttttatggttg

SEQ ID NO: 121425 - DNA, 601 bp, Human
ccccttaaaagaaactcacatgagataaaaaatccttgatcatgacatttgcctcccttatattactacttatcatcctggaagcgctgtgaattcagagattctgtatctgtttacacatactctatagggtattgtagaacaccaggcctggagaaagtgctcagcacatagtttttgagtgaaaagtgataggtcattctccctagcatgctttcaaggaaatagccctctaaaataaatttgttattatttggggaataaagcatatttaaacataatatccaccctagtatatgartaataattctactatatttaatgtattagttatttgaggctactaggacaaccacttaggttttgcagatattcgcatcatgattgtgagtctaggtgagtttgacttggtcaagctgagtttagtaggctcaaatggatgtagagatggggaagcaataaacctgctcagattagaaagcagaattagtatgattgtccatcatatactctttgcttcctgatttcggcatcaaatataaggcaattagacaatctggtggagaaacgaacagaatgcagcaagacatccagaaataat

SEQ ID NO: 121426 - DNA, 601 bp, Human
tgagctttattttctcttctggaagcacgattcctatggtggaaaattcagactacgtaaggaagtaaatagtactggttgatgatgaaaagtttgcagccagagaagccttcagttctctcgagggcatctcatgtaggtagccccacccatgcctacaggtcaaactaccttgttattgatcacattgggcataaacagcttcttagatggcccacacaaagtttcctttagaaaagaaagttgcttctccttcaaaacattgttgtcatgggtaaaatcagccccttaaaagaaactyacatgagataaaaaatccttgatcatgacatttgcctcccttatattactacttatcatcctggaagcgctgtgaattcagagattctgtatctgtttacacatactctatagggtattgtagaacaccaggcctggagaaagtgctcagcacatagtttttgagtgaaaagtgataggtcattctccctagcatgctttcaaggaaatagccctctaaaataaatttgttattatttggggaataaagcatatttaaacataatatccaccctagtatatgaataataattctactata

SEQ ID NO: 121427 - DNA, 601 bp, Human
gattgtggtggggaggaatagagttggtggagcacaggggacctttagggcagtgaaactattctgtctaatactgtaatgatggatacatgacattatacatctgctgaaacacataaaatgtacaacagaaagagtggccactaatgtacattatagattttgggtaataatatgtcagtgttggtttattaatggttacatatataccacactaatgcaagatgttaatagtagaggagaccatgtgtgcatgggtggtttatgggaactctctatgctttctgtgcagtttttctayaaatgtaaaactgttctaaaaataaaatgtagtttaaaaatacctcaatgatagggaccctattccttttttttctttttcttatttttttagagacagggcctcactatgttgctcaggctcgtctcaaactcctgagctaagcaatcctcccacctcagcgtctcaaatagctgggactacaggtactcacctctgcacttggcccgactctattctcttgatgataattcactttgaaatgaggagacagtaagcctagctctttctaagattgctgttcaaagtttgcaatttaag

SEQ ID NO: 121428 - DNA, 601 bp, Human
gagggagaatagaagaaaatagatggaggatgttctttttgaactttttgcttcagaatctgataatgtttttgatatcattcacatagtccaggctgtgaaaaaattacaactcaagcaatgtaaagtatcaaagagtgtttatatcacaaattggggtcttagctctgaaatatattactttatctatcacggacctgtttttacttatttcatatttgacaattatcggacttatttctaattttagcaccttcttcagactcttgtagaggagagactgtactgttccttcttttastctgcagtacaactagaacagcacctggcactgctgctgacatctctaccagattggtgtcttttaataagaagtgatgtcctaaggatatgttttgtcaagggacttattacctctgccgttgtttttctttgtgcgtgattactctttctgcactgtttttttccacctaaacataatggttttcaaaatgtggtccctggaccaatagcatcaccgtcacctggacattggtgaggatgcaagcccaatcccagacctactgcatcagaaactctggggtggagtcctgtaagctgt

SEQ ID NO: 121429 - DNA, 601 bp, Human
tacactatcttttttgctttgctttcctctgtcttcagccactcctcctctattttatctttccataagcatttaagtggtactcagatccttccttcaaagaaaaaaaaaaccatatgaaacaaacaaaactaacaaaaaatgcatctcttcctcctcctctgcatagtgaggcagcttgagagttgagtctaccacatctccaacccttatcaaccattcccttctccgcataccctaatctggttatcaccccaccccacagaatctgctctgaacaatggcaacatccccacagcascaggtgcaaagggctttttgtagacttcaccttacttgaccacctttgaaactctgtgtttgccttttttcatgctctgttctctgggttttcttcttcagttgggctacttctcttccatttgctactttgttcatctcagcctgtacttctggaactacttaaagctttatgctatgccccttctctttgtacctttccactctctacccataaaatattattaaaatcagtggttctgaataatatttatataatcatagataaactttgtcttttaatctctggcctctactcgaa

SEQ ID NO: 121430 - DNA, 601 bp, Human
aaggagaactttttaagaggaactcagctgaaagtaaatggagtgaaaaggagaaagaaagaagtaagtcgagtaaaaagtacacagcaggtgggccaggcttggtggctcatgcctgtaatcccagcactttgggaggctgaggtgggcagatcatgaggtcaggggatcgagaccagcctggtcaaaatggtgaaaccccgtctctactaaataacaaaaattagctgggtgtggtggcatgtgcctgtaatcccagctactcaggaggctgaggtgggagaagaatcatttcaacccrggaggtggaggttgcagtgagccgagatggtgccactgcactccatcctggcgacagagcgagactccatctcaaaacaaacaaacaaacaaacaaaaaaacaaaaaagtatacagcattcaaaagtgaccacattaaagaacgaatggatagaatggagaaaagacagacagattaatgtttctattgttttaatataacagtaatactcattaagtaacactaaagtactccgaagacacacaatactctgttgtactttgaaagcatcatgattacactaatgactactctaatggc

SEQ ID NO: 121431 - DNA, 601 bp, Human
tcaaagaaagcatgtgcataaactccaaaatagccatgaaaatactgtaactgaaaacatttctgaacatatctgaagaaaatgttcaaagcatttgataaccttaggtaatggaagacagtggggtgctgtttgcagtgtaaaaataaaaaaaaaatagtttcttatttgcaaaacttgactaaagtcaatgttaagaagctcagagaaagcctcaggaaaaggagataaaaacaaaagataaaataaaggcagagataaagataacataaggataagaaggagaactttttaagaggarctcagctgaaagtaaatggagtgaaaaggagaaagaaagaagtaagtcgagtaaaaagtacacagcaggtgggccaggcttggtggctcatgcctgtaatcccagcactttgggaggctgaggtgggcagatcatgaggtcaggggatcgagaccagcctggtcaaaatggtgaaaccccgtctctactaaataacaaaaattagctgggtgtggtggcatgtgcctgtaatcccagctactcaggaggctgaggtgggagaagaatcatttcaacccgggaggtggaggttgcagtgag

SEQ ID NO: 121432 - DNA, 601 bp, Human
caataattcatcaaatggtaaaatgtatgtaacctttgaaccattgattctacttctagcaaattccctattaaaaagtattcccacaagattacatgtgagagtgttgaatgtagcattgtttattaaagtctgaccaaagcaaacaaaaatcatttagtgttcaggactagaggagtgaatggctatattatggtgattatggtgtagctgaataatagaataatgtgtagccattgagagaaaagaggtagtgacatatataatgatatggacagatgactgacatattaacataagygaaaagcagaatataccacattagatgtttatgtatatcattctttgtttttaaagcattatgcagttgttatatactctgcatgaggagggagggcatggtggagaatgcagaggctgtatacaaacatctctcttactccttcctcaaagaaagcatgtgcataaactccaaaatagccatgaaaatactgtaactgaaaacatttctgaacatatctgaagaaaatgttcaaagcatttgataaccttaggtaatggaagacagtggggtgctgtttgcagtgtaaaaataaaaaaa

SEQ ID NO: 121433 - DNA, 601 bp, Human
gatctcctgacctcaggtgatccgcccgcctcagcctcccaaagtgctgggattacaggcgcgcaccaccacacccaaccaatttctgtatttttagtagagatggggtttcaccatgttggccaggctggcctgtggcctttttggtgggcctcccctggccttttaaatcaggcagccatagctctcatctgctggtaatcctcttctgttcaactgtttctttataatttcattcctttctaccagttcagtgattgtttctccagagagttgccattcttttttttttttttttttctttgggggggacggagtcttgctctgttgcccaggctggagtgcagtggcacgatcccagctcactgcaagctctgcctcctgggttcacaccattctcctgccccagcctcccgagcagccaggactacaggcacctgccaccatgcccggctaattttttctattttttagtagagacggggtttcactgtgttaaccaggatggtctcaatctccgaacctcatgatccgcccgccttggcctcccaaagcgctgggattacaggcgtgagccaccgcacccagcccagagagttgc

SEQ ID NO: 121434 - DNA, 601 bp, Human
cctcaggtgatccgcccgcctcagcctcccaaagtgctgggattacaggcgcgcaccaccacacccaaccaatttctgtatttttagtagagatggggtttcaccatgttggccaggctggcctgtggcctttttggtgggcctcccctggccttttaaatcaggcagccatagctctcatctgctggtaatcctcttctgttcaactgtttctttataatttcattcctttctaccagttcagtgattgtttctccagagagttgccattcttttttttttttttttttttttgggggggacggagtcttgctctgttgcccaggctggagtgcagtggcacgatcccagctcactgcaagctctgcctcctgggttcacaccattctcctgccccagcctcccgagcagccaggactacaggcacctgccaccatgcccggctaattttttctattttttagtagagacggggtttcactgtgttaaccaggatggtctcaatctccgaacctcatgatccgcccgccttggcctcccaaagcgctgggattacaggcgtgagccaccgcacccagcccagagagttgccattctaaca

SEQ ID NO: 121435 - DNA, 601 bp, Human
cactatgggataataaaggagaaaataatttttaaaaagactctgcaaaattacattagttctcctaatcatgagatgcttgcttcagagtttcaggatccacccaacatgggaagtcaaagcctctctgggatactacggggctaaggtgcacagtcgctcaggttgtgcacaacacaagggcaccccattcacatgaaaacatcttcattattttgaaaatctgcagagcactgtgtagacacattagggattaccttacatgaggctatactaatttatgatagcaattatttatgtsttgttatggaaaactgggagacaaaaatgaattactgttttgagatcttacgaagcttggaagacagattggccctggggaggcagcggtggccgcagtttgcagggaagattgctgccgaggaggaatctgtgcacacgacaggctccaacgatctgcacagggccacatggggctttggctgaggactaagcttcgcacgcactgcacaaaaccccaagagctgagcaaaagtggccacctgggagccccctgaaagctgcaccaggacaaggcccgtctgaccaggtcaagtgcaga

SEQ ID NO: 121436 - DNA, 601 bp, Human
cgggtgtccggagtttcaacatggcacttccagggctacaaggaggtgaatggatgaagagctcctgttgagtggagacagaggagccctgaggcctctttatgaaaaagcaaaaataagcaccatggagcaggtggtggtcgtgccactggtgggagtgggatcatcctgctaggcaccaaccatccccaaccaacagaggaacacaggctctgcctcctgctccgcatctcctcattacacacagaaacgtcctcggctcgaggacaaaagcccatctgtattctgatctgagcaggastgggtgccgccctcacatctggagggagcctgagactacccgacaggagccacaggtaccacacggtgaggacccccttccagacacccccctgcccagctcctgtggaccctcccccaacctttgccaggggggaccgtggtcctctgtggcgtgtcgtctgcacccgtcttcatcgggggcactagcacctgccacacactcaacagcatcacttcccactggaaaaacaatgccacaagattcttcttggcgagaacaaaccagaaaatgggacctgaagaagccgagagcctcgcc

SEQ ID NO: 121437 - DNA, 601 bp, Human
ggtgctgcgggtggaagctgctgtcacagtcgtgttagggtgagtggactatggccgcagactgtgggctcctcccagccaaccctcactcccgctagcgccccaaatcttcagtccagcaccccttccccgtcccacccactctccacactgagccctcccagccaaccctcactcccgctagcaccacaaatcctcagcccagcaccccttccctgtcccacctgctctccacactgagcccagccactccacgctcccttgggcaggtggcaaggcagagcctgaggtcagctgccayccccagccccaccccagggccctcatgcccccagcaaggcctctccagctctgcggtcccactcaagatgcgcttagctcatttcacacgcaggtgagtgtctcagttctgcgggcacggaggcccctgtgggagggaggttggcaggcccctcgctgacggaggggagcaaggggcaaagtgggggtgtccagaagggggttgtgaggaactgggggacgggaaagagcccggagaggaaaaaggaggtggggaggggctgcgtgtgcatagacctcagggtggggcaaccgaggacct

SEQ ID NO: 121438 - DNA, 601 bp, Human
cacagtcgaaggtggtgcagacgcccacagggagggagagccaggggaaccccaaacttccactgtggcagaagcagctttatcccatgggagcccacgccagccgccaggggagaacaaacctggtagccactgagcacaggggtccagggtgggactggggagggacaagagacagaatcgagacaggctcactggagtcactgaaggagggaagggcagggcctgttcatgcaaagcctgggctagggcagacgcttcccgaggacagaggcggtcctggcgggactggagaacaagmggggtgtgaggtgcctgccagactgggtgagggcagcggccagcagagacctggaaaggccctgaggagctgcccggcaagggggctctgaggaagaaggggaggggggaagccccttctccctgtcctgcacccgtcccagcttcctctccccttttctgtccccacagctaaggaggctgcaagaggcccaggcagcctccgctcttgctggatgagccttgggaattacccaccaggctgccagcccaggggcaggtgtggtccctccttcccaggcagctggggagtggcaatcct

SEQ ID NO: 121439 - DNA, 601 bp, Human
gggctagggcagacgcttcccgaggacagaggcggtcctggcgggactggagaacaagaggggtgtgaggtgcctgccagactgggtgagggcagcggccagcagagacctggaaaggccctgaggagctgcccggcaagggggctctgaggaagaaggggaggggggaagccccttctccctgtcctgcacccgtcccagcttcctctccccttttctgtccccacagctaaggaggctgcaagaggcccaggcagcctccgctcttgctggatgagccttgggaattacccaccaggcygccagcccaggggcaggtgtggtccctccttcccaggcagctggggagtggcaatcctggtttgttttcgtttgtgggttttttttttttttgagacagagtcttgctctgtcaccaggctggagtacagtggcatgatgtcagctcactgcaacctccgtctcccacgttcaagcgattctcctgccttggcctcctgagtagctaggactagaggtgcccgccaccacacccggctaatttttgtatttttaatagagacagagtttcgtcatgttggtcaggctgttctcgaactcc

SEQ ID NO: 121440 - DNA, 601 bp, Human
gtccccacagctaaggaggctgcaagaggcccaggcagcctccgctcttgctggatgagccttgggaattacccaccaggctgccagcccaggggcaggtgtggtccctccttcccaggcagctggggagtggcaatcctggtttgttttcgtttgtgggttttttttttttttgagacagagtcttgctctgtcaccaggctggagtacagtggcatgatgtcagctcactgcaacctccgtctcccacgttcaagcgattctcctgccttggcctcctgagtagctaggactagaggtkcccgccaccacacccggctaatttttgtatttttaatagagacagagtttcgtcatgttggtcaggctgttctcgaactcctgacctcaggtgatcaacctgcctcagatttccaaagtgctgggataacaggcgtgagccaccgcaccaggccggaagtggcaatcctcttatcccaatggcagtaagcaagcagcaaggcagtgacctagattcagtaatccccgggttaccttcatctccacctccctcctaagaagtggggcacccacaaatcaatcgtgcatcaggagcatgagt

SEQ ID NO: 121441 - DNA, 601 bp, Human
gcagtgacctagattcagtaatccccgggttaccttcatctccacctccctcctaagaagtggggcacccacaaatcaatcgtgcatcaggagcatgagttaccaggaagccaggaaacttcacagcagtggggcctggggtggacaccagctgctcctccctccccccgttccctcctccctcctcccctcactctcctgccaccctcctccctccttttctgccatcctccccctctcccttccttcctcctgcacacaatccccaagacaacttctcatccccaccctgtcccaaatmtgggctgtgtctttcttgcccccaggagtttgtcccccgctgccaccaccccttcacccctttgtccccacccggctgatggtgtctcttccctgctctgcgggtccccctcaaactgctgggctgtcctaggtccgtccctcggcctggcctgttccccagggctgttctaggtcctgccacccccacccccagtgccatggccgcacctgccccaggactgacctccgaggcctctcccctgcccagtgtagctggtgccattccaaggggctgggcatggtgtctgtccctccattc

SEQ ID NO: 121442 - DNA, 601 bp, Human
ctgccccaaaacacctcatcacggggtcctgcacgtcgccagcagtcaagacccttcgactcagtcctatggtggtctctacaaggctggacagagcaggggcgttgagaacacgggctgggtgggaatccggagatagagggaggagggtggcaggaccggccgtcagccatgctgagcacagacggcagaggaggtgtggggcttgggcagttggaggtgctttggagaagccacagtgggtgtgaaggccccagagcgaggcccagctgctcggctatgtgagcacacacagcccccwggcctgctagaggcagagcaaatgcagggggttcccaggagcctgagagtccacagctgccacctgctcccagacaaggctcctggcatgtctgaccaggagcctctggggaagtagggaagcccagactggacagtggagaggaagagaccagcaggcaaggaccccccggccaggcatcactacaggggacacagaacccagagggcaccagagaggagagacggggggccagcaggggccacgtgttaatcttcaccgacagacacacgatggtgtggctgcatttcacaatgggtg

SEQ ID NO: 121443 - DNA, 601 bp, Human
gggtgggaatccggagatagagggaggagggtggcaggaccggccgtcagccatgctgagcacagacggcagaggaggtgtggggcttgggcagttggaggtgctttggagaagccacagtgggtgtgaaggccccagagcgaggcccagctgctcggctatgtgagcacacacagcccccaggcctgctagaggcagagcaaatgcagggggttcccaggagcctgagagtccacagctgccacctgctcccagacaaggctcctggcatgtctgaccaggagcctctggggaagtaggraagcccagactggacagtggagaggaagagaccagcaggcaaggaccccccggccaggcatcactacaggggacacagaacccagagggcaccagagaggagagacggggggccagcaggggccacgtgttaatcttcaccgacagacacacgatggtgtggctgcatttcacaatgggtggggcagctggcagtcggacagggaggccgagggatccatccctgtggccgaggggagtttgcagggctgtcatctcaggaagtgaaggctgggctggggtcgggctgctgggccacgag

SEQ ID NO: 121444 - DNA, 601 bp, Human
agacacaaagaggctgcagtcacaaagcctcagcgtgaaggtctcagtgctgggaccaagggtgtatctggcacaggcctggaaggaccagggagtgaatggggccagtggtgaaggagagaagctgtcggcataaggatggtaacggcagcccacctcagctgggacagctgaaatggagccaggtgcctgctgagaccagtgacgcagccaggaaggcaggggacccaggagcagctgtgaaggagaaaagacggcagacgaacgggctgagagagcattttacagagtcctgagtgcrcttaaatcccaggatggggagagactatgaagaagagaaggtgacaaatagggtgaggttcttgggtggagggtaggccacaagagagaggcaggaaggctctgtggctgttcccatactttctttgtgaaacaagagctgtgaaaacgtgtggggcagagagaagtgacagagtcaggtctgagatccaggaagaaactggtagagacaaagctggcaagagaagtgaggctgaacattgatcaaccatagcctgtgtgactatggggcaccatctgagggtcactttgtgtggatctg

SEQ ID NO: 121445 - DNA, 601 bp, Human
gaaggagaaaagacggcagacgaacgggctgagagagcattttacagagtcctgagtgcgcttaaatcccaggatggggagagactatgaagaagagaaggtgacaaatagggtgaggttcttgggtggagggtaggccacaagagagaggcaggaaggctctgtggctgttcccatactttctttgtgaaacaagagctgtgaaaacgtgtggggcagagagaagtgacagagtcaggtctgagatccaggaagaaactggtagagacaaagctggcaagagaagtgaggctgaacattsatcaaccatagcctgtgtgactatggggcaccatctgagggtcactttgtgtggatctgtgtggctccatctaagagtcacattgtgtggatcctgtggcactgtctgagggttacattgtgtggatccctgtggcgctgtctgaaggtcatgttatgtggatctgtgtgacaccgtctgagggttacattgtgtggatccttgtggcactgtctgagggttatgttgcgtggatctgtgtggcaccatctgagggtcacattgtatggatttgtgtttgggaccatctaagggtcatga

SEQ ID NO: 121446 - DNA, 601 bp, Human
gtgactatggggcaccatctgagggtcactttgtgtggatctgtgtggctccatctaagagtcacattgtgtggatcctgtggcactgtctgagggttacattgtgtggatccctgtggcgctgtctgaaggtcatgttatgtggatctgtgtgacaccgtctgagggttacattgtgtggatccttgtggcactgtctgagggttatgttgcgtggatctgtgtggcaccatctgagggtcacattgtatggatttgtgtttgggaccatctaagggtcatgaggatcacgttgcgtggrtccatgtggctccatctgagggtcacgttgtgtggatttatgtgtgggaccatcaaagggtcatgagggtcacattgtgtgggtccatgtggcaccatctgagggtcacattgtggggatttgtgtgtgggaccatcaaagggtcatgagggtcatgttgtgtgggtccatgtggcaccatctgagggtcacgttgtgtggatctgtgtgacaccatctgctatctcagggtcacattgcatggattcatgtgtcaccatctgagggtcatcctgtgtggaactgtgtggcaccatctgc

SEQ ID NO: 121447 - DNA, 601 bp, Human
accgtctgagggttacattgtgtggatccttgtggcactgtctgagggttatgttgcgtggatctgtgtggcaccatctgagggtcacattgtatggatttgtgtttgggaccatctaagggtcatgaggatcacgttgcgtggatccatgtggctccatctgagggtcacgttgtgtggatttatgtgtgggaccatcaaagggtcatgagggtcacattgtgtgggtccatgtggcaccatctgagggtcacattgtggggatttgtgtgtgggaccatcaaagggtcatgagggtcaygttgtgtgggtccatgtggcaccatctgagggtcacgttgtgtggatctgtgtgacaccatctgctatctcagggtcacattgcatggattcatgtgtcaccatctgagggtcatcctgtgtggaactgtgtggcaccatctgctatctcagggtcacattgcatggattcatgtggcaccatctgagggtcatgttgtgtggatctgcatggcaccatctgaggtcatcctgtgtggatctgtgtggcaccatctgctatctcagggtcacattgcatggattcatgtggcaccatctg

SEQ ID NO: 121448 - DNA, 601 bp, Human
ctgagggtcacattgtggggatttgtgtgtgggaccatcaaagggtcatgagggtcatgttgtgtgggtccatgtggcaccatctgagggtcacgttgtgtggatctgtgtgacaccatctgctatctcagggtcacattgcatggattcatgtgtcaccatctgagggtcatcctgtgtggaactgtgtggcaccatctgctatctcagggtcacattgcatggattcatgtggcaccatctgagggtcatgttgtgtggatctgcatggcaccatctgaggtcatcctgtgtggatctrtgtggcaccatctgctatctcagggtcacattgcatggattcatgtggcaccatctgagggtcatgttgtgctctttccagaatcactggtatatgtccaggtgtcatgctgtgatctgtgtggcaccatctgagtgtcacgttatgtgaatccatgtggtatcagctgagagacatgctgtgtggatccgtgtggcactgtctgggggtcacgttgtgtggatttgtgtgtggcaccatctaagggtcatcttgtgtgatgccatctgaggatcacatgtggatccatgaggcaccgtc

SEQ ID NO: 121449 - DNA, 601 bp, Human
ggtcacattgtggggatttgtgtgtgggaccatcaaagggtcatgagggtcatgttgtgtgggtccatgtggcaccatctgagggtcacgttgtgtggatctgtgtgacaccatctgctatctcagggtcacattgcatggattcatgtgtcaccatctgagggtcatcctgtgtggaactgtgtggcaccatctgctatctcagggtcacattgcatggattcatgtggcaccatctgagggtcatgttgtgtggatctgcatggcaccatctgaggtcatcctgtgtggatctgtgtgrcaccatctgctatctcagggtcacattgcatggattcatgtggcaccatctgagggtcatgttgtgctctttccagaatcactggtatatgtccaggtgtcatgctgtgatctgtgtggcaccatctgagtgtcacgttatgtgaatccatgtggtatcagctgagagacatgctgtgtggatccgtgtggcactgtctgggggtcacgttgtgtggatttgtgtgtggcaccatctaagggtcatcttgtgtgatgccatctgaggatcacatgtggatccatgaggcaccgtctgagg

SEQ ID NO: 121450 - DNA, 601 bp, Human
agggtcacgttgtgtggatctgtgtgacaccatctgctatctcagggtcacattgcatggattcatgtgtcaccatctgagggtcatcctgtgtggaactgtgtggcaccatctgctatctcagggtcacattgcatggattcatgtggcaccatctgagggtcatgttgtgtggatctgcatggcaccatctgaggtcatcctgtgtggatctgtgtggcaccatctgctatctcagggtcacattgcatggattcatgtggcaccatctgagggtcatgttgtgctctttccagaatcwctggtatatgtccaggtgtcatgctgtgatctgtgtggcaccatctgagtgtcacgttatgtgaatccatgtggtatcagctgagagacatgctgtgtggatccgtgtggcactgtctgggggtcacgttgtgtggatttgtgtgtggcaccatctaagggtcatcttgtgtgatgccatctgaggatcacatgtggatccatgaggcaccgtctgaggatcatgttgtgtggatccatgtggtgccgtctgagggttatgagggtcacattgtggggatctgtgtggtgccatctcagg

SEQ ID NO: 121451 - DNA, 601 bp, Human
tgtgacaccatctgctatctcagggtcacattgcatggattcatgtgtcaccatctgagggtcatcctgtgtggaactgtgtggcaccatctgctatctcagggtcacattgcatggattcatgtggcaccatctgagggtcatgttgtgtggatctgcatggcaccatctgaggtcatcctgtgtggatctgtgtggcaccatctgctatctcagggtcacattgcatggattcatgtggcaccatctgagggtcatgttgtgctctttccagaatcactggtatatgtccaggtgtcaygctgtgatctgtgtggcaccatctgagtgtcacgttatgtgaatccatgtggtatcagctgagagacatgctgtgtggatccgtgtggcactgtctgggggtcacgttgtgtggatttgtgtgtggcaccatctaagggtcatcttgtgtgatgccatctgaggatcacatgtggatccatgaggcaccgtctgaggatcatgttgtgtggatccatgtggtgccgtctgagggttatgagggtcacattgtggggatctgtgtggtgccatctcagggtcacgttgtgtggatctgcgt

SEQ ID NO: 121452 - DNA, 601 bp, Human
ctgtgtggaactgtgtggcaccatctgctatctcagggtcacattgcatggattcatgtggcaccatctgagggtcatgttgtgtggatctgcatggcaccatctgaggtcatcctgtgtggatctgtgtggcaccatctgctatctcagggtcacattgcatggattcatgtggcaccatctgagggtcatgttgtgctctttccagaatcactggtatatgtccaggtgtcatgctgtgatctgtgtggcaccatctgagtgtcacgttatgtgaatccatgtggtatcagctgagagwcatgctgtgtggatccgtgtggcactgtctgggggtcacgttgtgtggatttgtgtgtggcaccatctaagggtcatcttgtgtgatgccatctgaggatcacatgtggatccatgaggcaccgtctgaggatcatgttgtgtggatccatgtggtgccgtctgagggttatgagggtcacattgtggggatctgtgtggtgccatctcagggtcacgttgtgtggatctgcgtggcagcatctctggatcacgttttgtggatccatgtggcaccatctctggatcatgttgtgtggat

SEQ ID NO: 121453 - DNA, 601 bp, Human
gatccatgtggcaccatctctggatcatgttgtgtggatctgcatggtgccgtctgggggtcacatggtggggatctgtgtggtgctgtctcagggtcacgttgtgtggatccgtgtggcaccatctctggatcacctgtggatctgcgtggtgctgtctgggggtcacattgtggggatctgtgtggtgctgtctcagggtcacgttgtgtgggtccgtgtggcaccatctctggatcacgttgtgtggatccatgtggcaccatctctggatcacgttgtgtggatctgcatggtgcckagggtcacattgtgtggatctgtgtggtgccgtctgagggtcatgttgtgctctttccataatcactggtatatgtccaggtgtcatgctgtgaagatcagcaaccagggaaggaccccaggtgagggtgtcagtgaggttggcaagggatgggtaaaaggatgggctccaggtagaaagggagggaaacagtaacagagactctgaattcatcagggagcacacatggtggccactgtagcactgacggctggtggaggagacactgtccaaactgccacaggcacaacaggcaccacg

SEQ ID NO: 121454 - DNA, 601 bp, Human
ggtccgtgtggcaccatctctggatcacgttgtgtggatccatgtggcaccatctctggatcacgttgtgtggatctgcatggtgccgagggtcacattgtgtggatctgtgtggtgccgtctgagggtcatgttgtgctctttccataatcactggtatatgtccaggtgtcatgctgtgaagatcagcaaccagggaaggaccccaggtgagggtgtcagtgaggttggcaagggatgggtaaaaggatgggctccaggtagaaagggagggaaacagtaacagagactctgaattcakcagggagcacacatggtggccactgtagcactgacggctggtggaggagacactgtccaaactgccacaggcacaacaggcaccacgacaagcaggcaggagtgtgctgtgcttggcctcaggggacacaggtgcagagatgagccctcgggggacgcaggtgcagagatgagccctcaggggttgcaggtggtgagatgagccctccctcagggcccatccctgtttcagatccaataaagggatgctggctccactgcccacgctgccacccctgccagggctcactcacccgtcttc

SEQ ID NO: 121455 - DNA, 601 bp, Human
tcactcacccgtcttcctgctccaccatcttttaaatgctggttttccttcaatgccagcccacatggctatgggcagcagctgtatctccaagaatcaggaaatgaggagcaggaagggtgggtgccatttaggagcacgctagcacctcggccagcccccagcaggcttcctctgacctctcaaccttgctgcaggggaagggggtggaggggagttgcgaggagtctgccctctgctgctgcagggccaccgtccctagaaacagcaggagatgtgaggcgcatcccaggagctcccrttcagctggcgcagtggctgagggcagagcctgttatttttgccccattgactggtgaggagaaggccacagaaccaccctgtgcccactgcaggtcgcacaggtgggaagtcctgaccccagcagggctgactccggagccgtccacctgggtcactgccccagggcaccctggcctcatgtaaacaaatgtcagaaccaggaagtaagaggagggtctggggtcacatccaactctctgaaggacagaatcccagtcaccggggggtgtctggtctcagtaaccctcgctgtgtctga

SEQ ID NO: 121456 - DNA, 601 bp, Human
tccaagaatcaggaaatgaggagcaggaagggtgggtgccatttaggagcacgctagcacctcggccagcccccagcaggcttcctctgacctctcaaccttgctgcaggggaagggggtggaggggagttgcgaggagtctgccctctgctgctgcagggccaccgtccctagaaacagcaggagatgtgaggcgcatcccaggagctcccattcagctggcgcagtggctgagggcagagcctgttatttttgccccattgactggtgaggagaaggccacagaaccaccctgtgcccrctgcaggtcgcacaggtgggaagtcctgaccccagcagggctgactccggagccgtccacctgggtcactgccccagggcaccctggcctcatgtaaacaaatgtcagaaccaggaagtaagaggagggtctggggtcacatccaactctctgaaggacagaatcccagtcaccggggggtgtctggtctcagtaaccctcgctgtgtctgagctgaggcagagctcagctgacctgttccttgaggggccggaacctaagagccaagagaggaggggctgctctaaatctggtgggagt

SEQ ID NO: 121457 - DNA, 601 bp, Human
gagcacgctagcacctcggccagcccccagcaggcttcctctgacctctcaaccttgctgcaggggaagggggtggaggggagttgcgaggagtctgccctctgctgctgcagggccaccgtccctagaaacagcaggagatgtgaggcgcatcccaggagctcccattcagctggcgcagtggctgagggcagagcctgttatttttgccccattgactggtgaggagaaggccacagaaccaccctgtgcccactgcaggtcgcacaggtgggaagtcctgaccccagcagggctgacyccggagccgtccacctgggtcactgccccagggcaccctggcctcatgtaaacaaatgtcagaaccaggaagtaagaggagggtctggggtcacatccaactctctgaaggacagaatcccagtcaccggggggtgtctggtctcagtaaccctcgctgtgtctgagctgaggcagagctcagctgacctgttccttgaggggccggaacctaagagccaagagaggaggggctgctctaaatctggtgggagtgagggtaggagtgagggtgggtgggtaccccctgggagccagaggc

SEQ ID NO: 121458 - DNA, 601 bp, Human
aggagctcccattcagctggcgcagtggctgagggcagagcctgttatttttgccccattgactggtgaggagaaggccacagaaccaccctgtgcccactgcaggtcgcacaggtgggaagtcctgaccccagcagggctgactccggagccgtccacctgggtcactgccccagggcaccctggcctcatgtaaacaaatgtcagaaccaggaagtaagaggagggtctggggtcacatccaactctctgaaggacagaatcccagtcaccggggggtgtctggtctcagtaaccctcrctgtgtctgagctgaggcagagctcagctgacctgttccttgaggggccggaacctaagagccaagagaggaggggctgctctaaatctggtgggagtgagggtaggagtgagggtgggtgggtaccccctgggagccagaggcaggcaaagttctcatcacggtgggccccagaccccagggggcagacccctgggagtgtgtgcctgggaggccagaggggtggaggacagaccccaggagtgaaaggactcccaccccggcctgccagctgcacctgccctggttaaagtgtccgac

SEQ ID NO: 121459 - DNA, 601 bp, Human
gggaagtcctgaccccagcagggctgactccggagccgtccacctgggtcactgccccagggcaccctggcctcatgtaaacaaatgtcagaaccaggaagtaagaggagggtctggggtcacatccaactctctgaaggacagaatcccagtcaccggggggtgtctggtctcagtaaccctcgctgtgtctgagctgaggcagagctcagctgacctgttccttgaggggccggaacctaagagccaagagaggaggggctgctctaaatctggtgggagtgagggtaggagtgagggkgggtgggtaccccctgggagccagaggcaggcaaagttctcatcacggtgggccccagaccccagggggcagacccctgggagtgtgtgcctgggaggccagaggggtggaggacagaccccaggagtgaaaggactcccaccccggcctgccagctgcacctgccctggttaaagtgtccgacgaacaagcccccaattagaatgggcccatcccacaccctaccaatggctgtctctcagggaagagtgtaggagtgtcctgcagggggctgaaggcaggagagggtggcgggcacca

SEQ ID NO: 121460 - DNA, 601 bp, Human
ggtcactgccccagggcaccctggcctcatgtaaacaaatgtcagaaccaggaagtaagaggagggtctggggtcacatccaactctctgaaggacagaatcccagtcaccggggggtgtctggtctcagtaaccctcgctgtgtctgagctgaggcagagctcagctgacctgttccttgaggggccggaacctaagagccaagagaggaggggctgctctaaatctggtgggagtgagggtaggagtgagggtgggtgggtaccccctgggagccagaggcaggcaaagttctcatcayggtgggccccagaccccagggggcagacccctgggagtgtgtgcctgggaggccagaggggtggaggacagaccccaggagtgaaaggactcccaccccggcctgccagctgcacctgccctggttaaagtgtccgacgaacaagcccccaattagaatgggcccatcccacaccctaccaatggctgtctctcagggaagagtgtaggagtgtcctgcagggggctgaaggcaggagagggtggcgggcaccaggaggcttcagggacaaggcgagcaggcaggctcaacaggcatcca

SEQ ID NO: 121461 - DNA, 601 bp, Human
gagtgtgtgcctgggaggccagaggggtggaggacagaccccaggagtgaaaggactcccaccccggcctgccagctgcacctgccctggttaaagtgtccgacgaacaagcccccaattagaatgggcccatcccacaccctaccaatggctgtctctcagggaagagtgtaggagtgtcctgcagggggctgaaggcaggagagggtggcgggcaccaggaggcttcagggacaaggcgagcaggcaggctcaacaggcatccaggaagcccgacgtggccggagggcggcaggtgcgkgaggtgccaggcagggcggggccccccatgaggcctgtccaagtctgctggactgagcactggggggcaccagcatcctccgcacaggggtgcatggagccaggctggagccacagggacaggcccagctttcaccgcccggtggccacatcccagtgcccagcagggcccctgggcacctcacacctggagggcagcagcccccacagagcttgacgacaaccccagtggtgcgggctccaggcccacggtgcgacagcctctttagcctctttcctctcttgcggcagtgccctcact

SEQ ID NO: 121462 - DNA, 601 bp, Human
ccccaattagaatgggcccatcccacaccctaccaatggctgtctctcagggaagagtgtaggagtgtcctgcagggggctgaaggcaggagagggtggcgggcaccaggaggcttcagggacaaggcgagcaggcaggctcaacaggcatccaggaagcccgacgtggccggagggcggcaggtgcgtgaggtgccaggcagggcggggccccccatgaggcctgtccaagtctgctggactgagcactggggggcaccagcatcctccgcacaggggtgcatggagccaggctggagcyacagggacaggcccagctttcaccgcccggtggccacatcccagtgcccagcagggcccctgggcacctcacacctggagggcagcagcccccacagagcttgacgacaaccccagtggtgcgggctccaggcccacggtgcgacagcctctttagcctctttcctctcttgcggcagtgccctcacttcagctcatttgctgacgagctcactgactacaagacaaagaatatgctggccacacccatcatgaatggcaaagacgtcgtggcggtgatcatggcagtgaacaagctcaa

SEQ ID NO: 121463 - DNA, 601 bp, Human
tgcccgcgtgttctgtgctgcgcgtccacctccttacctgcctgcccgcctgcccgcgtgttctgtgctgcgtgtccacctccttacctgcctgcccgcctgcctgcgtgttctgtgctgcgcgtctgcctccctgcctgcctccctgcccgcctgcccgcgtgttctgtgctgtgcgtccacctccttacctgcctgcctgcctgcccgcgtgttctgtgccacgcgtctgcctccctgcctgcctgcccgtgtgttctgtgctgtgcgtccacctccttacctgcctgcctgcctgccygcgtgttctgtgccacgcgtctgcctccctgcctgcctgcccgcgtgttctgtgctgcgcgtctgctgggctgctgggctccacgtgctcatctgcacatcgctgtgctcctgtgtgtctgtgcacacctgtctgtgtgtaagagagagagatagcttgcgtgcccaccctgtgcacctgagcttgtgtgtgccaatccatgtctgcctgtggggcacagcttcctggcgtgtctgggcaccctcaggcgagcatgtttctcctgcaaaatacccacgggggcacatgtctgaaaactgg

SEQ ID NO: 121464 - DNA, 601 bp, Human; identical to SEQ ID NO: 34002

SEQ ID NO: 121465 - DNA, 601 bp, Human; identical to SEQ ID NO: 34001

SEQ ID NO: 121466 - DNA, 601 bp, Human; identical to SEQ ID NO: 34000

SEQ ID NO: 121467 - DNA, 601 bp, Human; identical to SEQ ID NO: 33999

SEQ ID NO: 121468 - DNA, 601 bp, Human; identical to SEQ ID NO: 33998

SEQ ID NO: 121469 - DNA, 601 bp, Human; identical to SEQ ID NO: 33997

SEQ ID NO: 121470 - DNA, 601 bp, Human; identical to SEQ ID NO: 33996

SEQ ID NO: 121471 - DNA, 601 bp, Human; identical to SEQ ID NO: 33995

SEQ ID NO: 121472 - DNA, 601 bp, Human; identical to SEQ ID NO: 33994

SEQ ID NO: 121473 - DNA, 601 bp, Human; identical to SEQ ID NO: 33993

SEQ ID NO: 121474 - DNA, 601 bp, Human; identical to SEQ ID NO: 33992

SEQ ID NO: 121475 - DNA, 601 bp, Human; identical to SEQ ID NO: 33991

SEQ ID NO: 121476 - DNA, 601 bp, Human; identical to SEQ ID NO: 33990

SEQ ID NO: 121477 - DNA, 601 bp, Human; identical to SEQ ID NO: 33989

SEQ ID NO: 121478 - DNA, 601 bp, Human; identical to SEQ ID NO: 33988

SEQ ID NO: 121479 - DNA, 601 bp, Human; identical to SEQ ID NO: 33987

SEQ ID NO: 121480 - DNA, 601 bp, Human
gagtcgggggtttcaatgcgggtatgaaggtacagagggactgagccctgcgacccagggccagggttgtgggtgatgcaaacattgtgtcctgagaaccaggcctggggggcagggataggagggtgtggttaggggttaggatggcagtgatgacgatggacaggagaggtgagggaactcagggacagagaggaaagcccccagaggtccccctgagcgtacgcgggccaccgcagcagcccagccacacaccaaccctgaaatatactctattcattctctgatatttatttttttattttatttttatttattttttattttttgagatggagtcttgctctgtcgcccaggctggagtgcagtggttcgatcttggttcactgcaacctccacttcctgggttcaagcgattcccctgcctcagcctcccgtgtagctgggattacaggagcctgccaccatgcccagctaatttttgtatttttagtagagacagggtttcgccatgttggccaggccagtctcaaactcctgacctcaggtgatccgcccgccttggcctcccaaagtgctgagattacaggcgtgagccacc

SEQ ID NO: 121481 - DNA, 601 bp, Human
gacagagaggaaagcccccagaggtccccctgagcgtacgcgggccaccgcagcagcccagccacacaccaaccctgaaatatactctattcattctctgatatttattttttttttttatttttatttattttttattttttgagatggagtcttgctctgtcgcccaggctggagtgcagtggttcgatcttggttcactgcaacctccacttcctgggttcaagcgattcccctgcctcagcctcccgtgtagctgggattacaggagcctgccaccatgcccagctaatttttgtatttttagtagagacagggtttcgccatgttggccaggccagtctcaaactcctgacctcaggtgatccgcccgccttggcctcccaaagtgctgagattacaggcgtgagccaccgtgcccagcccattctcctgatacttattgacatgtaacatggatgaggcggcatcctaaatgcaggtcccagaaacagaccaagcaaagatcccagcccttgaggggcttgctcggctttcacttgcttgtttatttagcagccatgaactgagctccgctctgcgagaggactaaggggcacgt

SEQ ID NO: 121482 - DNA, 461 bp, Human
ctgagctccgctctgcgagaggactaaggggcacgtggcctgaatcaggcatgagcccttcactcctgccccccaccccatactaggaactcgcagtccaggagagagacaaggcaggcaccgcccgtgacagcatgagcccaagcgggagccaggcaggaagaaaggcaccccggcctaactgggcatgtgttggtagaggcattcgaggcagggggaggtgcccaggcagagacacaaccccagcccagcccagagtgtgcccaggtgacagcaggtcatttactttggccgaagcaaygggtgtgtgaggacagcaggttgtgggaatgatgtggctgcagagaaaggctggagtccagggggatgccttgagtgccagaccaaggatgccacgagggagcttttgcagtctcctcctgggtcctaagccacctgtcagggcatccccagagctgatg

SEQ ID NO: 121483 - DNA, 601 bp, Human
catgacagccatcagctggagaaaatgagcaatgccctctttagacaaagtgtgtggtgcctcgtgccaccgctccatgctgtcttcctctcggtgagcctcactgcctgttcccctcagcctagggccaaggtccctctatttagagatggggcagcacagcaatgttctgggccaggcccccacccacccatcactggcctcgtggccttcatccaggcctccatcctgccgtgagggcacgccatggcatagtgtgccatggggcctggcacctgcggtgctcagggctggttggccmctcttgtcccctacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcaggggtgaggcccccacccctcgccctcctggcccca

SEQ ID NO: 121484 - DNA, 601 bp, Human; identical to SEQ ID NO: 33986

SEQ ID NO: 121485 - DNA, 601 bp, Human; identical to SEQ ID NO: 33985

SEQ ID NO: 121486 - DNA, 601 bp, Human; identical to SEQ ID NO: 33984

SEQ ID NO: 121487 - DNA, 601 bp, Human
ccacactctaaagttagctcaaaaatttcccttataacatgggtaaaaacttttttttttttttttttttgagatggagtcttgctctgttgcccaggctggagtgcagtggcacaatctaggctcgctacaacctccgcctcctgggttcaagcgattatcctgcctcagcctaccgagtagctgggattacaggcacccaccatcatgccgggctgatttttgtattctgtagagatggggtttcaccatattggccaggctggtcctgaactcctgacctcaggtgatccaccccccmctcggcatcccaaagtgctgggattacaggcctgagccaccaggcctggcctaaaaacttttaatcacagtatcccatggattctcctcagtacttatcaatgtgaaaagaacacactaaagttccaatgtcttcacaaaaactcctcttaaacgtattccaacacagttgatctcccaaaaggatcaaaaccactcagctgccgaaaatctaacatacagttccttccaaaggttaatatcaccaaaaaaaaacaaaaagttagaattgataccagaaaaagtaaagaggaacttgctc

SEQ ID NO: 121488 - DNA, 601 bp, Human
tatttgtgtgacttcagcaagttactgaaatctcttttatgcctcagtttcttcacctgtaaaataacagtagctatttcactgctggtactgttatgttattaataactaactaacctaacagtagctagttatgttagaggattaaatgagttaatatatatacagcattaaaataacgcctggcacatagtaaataaacactttaataaataaactcaccattaactaccacactctaaagttagctcaaaaatttcccttataacatgggtaaaaacttttttttttttttttttttgagatggagtcttgctctgttgcccaggctggagtgcagtggcacaatctaggctcgctacaacctccgcctcctgggttcaagcgattatcctgcctcagcctaccgagtagctgggattacaggcacccaccatcatgccgggctgatttttgtattctgtagagatggggtttcaccatattggccaggctggtcctgaactcctgacctcaggtgatccacccccccctcggcatcccaaagtgctgggattacaggcctgagccaccaggcctggcctaaaaacttttaatcaca

SEQ ID NO: 121489 - DNA, 601 bp, Human
cactccagtctgggcaagagtgagattccgtctcaaaaaaaaaaaaaaaaaaaaactgtgcagctgattgtacttaaacagatactattttacaaacatatctctgagttatttttaaatttctgaatttttgaagaataaatctgctaagacaaaattaattcctaaccagatttacaattaatccacctcaatgacttgttagtaacaaatttttatttctaggccactgctcctggtacatttggagtcacaaacaaatggtataaacaatgatgtcagaaatgtacggcatgggccrggcatggtggctgacgcctgtaatcctagcactttgggaggcggaggtgggcggatcacctgaggtcaggagttcgagaacacaactggccaacatggtgaaaccccatttctattaaaaatacaaaaattaggtaggtatggtggcacacgcctgtaatcgcagacagcaggaggggagaggcagtagaattgcttcaacctggaaggcggaggttgcagtgagctgaaactgggccaccgcactccagcctaagcaacagagcaagactccatctcaaaaaaaaaaaagaaaagaaat

SEQ ID NO: 121490 - DNA, 601 bp, Human
ctttttcttccagcattaaggtagctcaacatgttccccttctaatatttagccaacaacataagaaaaccttgattcctctaacttgggccataagaaagcagtcttttcccaaaaagttgtttcaaaactctaacaagagtgtatagctattttcacacactgaaatagcagatttatatatttgtggtttacgataccaccaatattctctagacaaggtttattctatggtttccattaaggaagagaattctaactaaattattttaggctcactgctctctaatactataaagcagtactacagcataatgaaaaaagcacaaaattgagaagggcctgaccaattcttccagatggtattaactggctgtgtggcactggacaagacacttcaacctctttggctctcaaatttccctattatttgtgaaatcagattagaatcactgtgatccaagattgctactggctgaacattctacacaatgcagaagatacaagtctttttttctaataatctatgtttcgtaagcataatacaattcaaccataaaagatacctcaatcaacactacagccagacttacttttcctt

SEQ ID NO: 121491 - DNA, 601 bp, Human
ggtccaaagtgtgttcatgagggtgtgtgtgaagcatgctatttcatcatttgtttgaatgtcaattatgaggttaaaaagtacctgcttcttctgtcttctgactctcttagccagtccccactacagagatgttggttctaagcattagagcaatggttctcaaccccagctgcacatcagataaacattcttaaaaaaataaaaaataaaaaaaactgaaacctgggcctcactactagtcaaatttaattagtttggtatttattttttaagcttcctcaggtaatgctaaagtgawtttagtgccaagtaccactgctttccaaagaataaggctttggatttatgttacagaattaaagaaaaactgagtggcatggaaaaaagtaaggcaggaaaatggtgaaagagggtttaaatagtaagttagatatttaaagatgccctgaatagaaaaattgggaaactattaaagtacagaatcacactccacacacaaaaatagtaataatgtttctgagagttctgttaaaggttctagaaaactcaggagttaaatgcttcactgtacccaatgactaagaaaaaaggaacctag

SEQ ID NO: 121492 - DNA, 601 bp, Human
tcaaagagagcaaaaggtgagtttttattttactaaaaattatataaagtctcaaaaagacaaaagcaaatattcagtagcaaattaatagttggagcttacacagcacattaacgaatgccacgttactcttacaatggagggctaatgagaacaggaagtgggatggcatcaacaagagcaaaaagagccaatacacagtgaggctaaaaaagtgacaacagttgtggctggcacactggctgccttcagccttcctaatgatatgctttctcaatggtctaatgcttatttaaaaccytggctttttttttttttttttttttttttgagatggagtcttgctctgttgcccaggctggagtgcagtggtggtcatctcagctcactgcaaactctgcctcccaggttcaagtgattcttctgcctcagcctccaagtagctgggattacaggcacctaccaccacactcggctaatttttgtatttttagtagagacgttcaccatgttggccagggtggtctcgaactcctgacctcatgatctgcctgtctcggcctcccaaagtgctgggattacaggcgtgagccactgtgcc

SEQ ID NO: 121493 - DNA, 601 bp, Human
gtatttttagtagagacagggtttcaccatgttggtcaggctggacttgaactcctgacctcaagtgatctgcttgcctcagtctcacaaagtgctggaattacaggggttaaccactgtgctccgcctctccgttaaaatcttatgggacaacttttgtatatgtggtctactgttgactgcaacattgttatgaagtgcatgagcatatattgttaagtggtgagaaaaaaaaagtaagatgcaaaagagtatgttaaggtatgctgccaaatgcaaaaaaaaaaaaagggggggggggacaggagaaatgtatacataaagtgatcatttgtatacacatacaatcatttcaaaaggtacaaaagaaacatacagctcaccggctgcctcccagaggggagccaagtagctagggaataagacttagaataatacttttcacagaattctcgtttttgtactttttgaattttacacagtgatgaatacattacctattcagaaaagtgtttttaacttttaaaaatattatatgggtaatacaaaacaaatactatcttgaaggaagtggcaaatggtacttttcagctgaggtatc

SEQ ID NO: 121494 - DNA, 601 bp, Human
ttgttgttgttgtatttttagtagagacagggtttcaccatgttggtcaggctggacttgaactcctgacctcaagtgatctgcttgcctcagtctcacaaagtgctggaattacaggggttaaccactgtgctccgcctctccgttaaaatcttatgggacaacttttgtatatgtggtctactgttgactgcaacattgttatgaagtgcatgagcatatattgttaagtggtgagaaaaaaaaagtaagatgcaaaagagtatgttaaggtatgctgccaaatgcaaaaaaaaaaaaagggggggggggacaggagaaatgtatacataaagtgatcatttgtatacacatacaatcatttcaaaaggtacaaaagaaacatacagctcaccggctgcctcccagaggggagccaagtagctagggaataagacttagaataatacttttcacagaattctcgtttttgtactttttgaattttacacagtgatgaatacattacctattcagaaaagtgtttttaacttttaaaaatattatatgggtaatacaaaacaaatactatcttgaaggaagtggcaaatggtacttttca

SEQ ID NO: 121495 - DNA, 601 bp, Human
atctagttttattccattttggtctaagaaaatacatgatatgattttggttttaaaaaatttgttgagacttgtttggtctatcctagagaatgatccatgtgctgatgagaagaatgtgtattctctggctgctggataaaatgttctgtaaataccagtcaggtccatttggtgtaaagtgtggtttaaatccacagtttttgctgattttctgcacagctgacctgcccaattctgagcgtgaagtgttgaagtccccaactattaccatattggagttgttctctccctttagatstaataacatttgctttatgtatctgggtgctcctatattgggtgcgtatatatttaccattgttatatcctcttgctgtactgatccctttatcactatgtaatgacccatgttatctctttttgcagttttcgacttaatgtccactttatctaatagaagtatagtactcctaatcacttttggtttccatttgcataaaatatcttgttccatcccttcactttcggtctatatgtcttcataggtgaagtaagtttcttgtaggcagtatataattgggtcttaaaaaaaatcagt

SEQ ID NO: 121496 - DNA, 601 bp, Human
ggtagaatggtatcttattatagttttgatttgtatttcccagatgattagtgatgctgaggtttttttttgttttgttttgtttttgagatggagtttccctcttgttgcccaggctggagtgcagtggcatgatctcggctcactgcaacctccacctcccaggttcaagtgattctccagcctcagccttccgagtagctgggattacaggtgcccaccaccatgcctggctaattttttgtatttttagtagagacggggtttcgccatgttgggtaggctggtctcgaactcctasacctcaggtgatccgccctcctcagcctcccaaagtgctgggattacaggtgtgagccactgcacttttggctgggcatttttttatacacctgttggccatttgtatgtattcttttgagaaatgtctattcagatcctttgccaacttgttaataggattatttggttttcttgtctttgagttgagttccttgtacattctagatattagtcccttgttggatgaatagtttgcaaatattttctcccaatctacaggttgtctcttcattctgctgattgttttctttgttgggca

SEQ ID NO: 121497 - DNA, 601 bp, Human
aggtagaatggtatcttattatagttttgatttgtatttcccagatgattagtgatgctgaggtttttttttgttttgttttgtttttgagatggagtttccctcttgttgcccaggctggagtgcagtggcatgatctcggctcactgcaacctccacctcccaggttcaagtgattctccagcctcagccttccgagtagctgggattacaggtgcccaccaccatgcctggctaattttttgtatttttagtagagacggggtttcgccatgttgggtaggctggtctcgaactcctacacctcaggtgatccgccctcctcagcctcccaaagtgctgggattacaggtgtgagccactgcacttttggctgggcatttttttatacacctgttggccatttgtatgtattcttttgagaaatgtctattcagatcctttgccaacttgttaataggattatttggttttcttgtctttgagttgagttccttgtacattctagatattagtcccttgttggatgaatagtttgcaaatattttctcccaatctacaggttgtctcttcattctgctgattgttttctttgttgggc

SEQ ID NO: 121498 - DNA, 601 bp, Human
caaatgtgtatttttctcttttaatgactctaccagcatctacattctaatatactacggcaaatcgtttgacctctatgagccttcaacacagacaatcttctttaaagagttgctgtgatctaaatataatacctagcatataatatgtattcaaaattatacaggttttcaaatacaggtactacataatgggcacttaaaaagactgacaaacctatcagtatcaaacctgatactgtatcaggtttgtaaaatactgtacgtaaaaagttacactgtggtaaggttaacagaaatytatcaggtcactgctttcaaatcagacccagcaaaaaaacctagatatttctaaagcaacatagtaacagtttaaaaaaaaaatttgattacctctaagaactgtacattttttttggaaaatcagggttaaaatagcctaacagtacaaatacaaattagatgttgtctttggtcattaggctggaagagcaaactcccctgtgagtgaaagcatgtagtcaaaagtgggtaacgatttttcacttgtcagactgccaaaaataaaaaaatttacagtgtgttgcaaagggtataggga

SEQ ID NO: 121499 - DNA, 601 bp, Human
tgtttgaagccaggagttcaagaccagcctggccaacgtggagaaaccccatctctactaaaaatacaaaaattaggctggctaattagacacctgtagtcccagctactctgcagattgaagtacaagaatcgcttgaacctgggaggcagaggctgcagtgagcagagatcgtgccactgcactctaacctgaacagagtaagactctgtctcaaaaacaaaacaaaacaaaacaaaactcagttaatacttttaattattgcacaagtttaacaatttcagtttatctcaactccaartgtgtatttttctcttttaatgactctaccagcatctacattctaatatactacggcaaatcgtttgacctctatgagccttcaacacagacaatcttctttaaagagttgctgtgatctaaatataatacctagcatataatatgtattcaaaattatacaggttttcaaatacaggtactacataatgggcacttaaaaagactgacaaacctatcagtatcaaacctgatactgtatcaggtttgtaaaatactgtacgtaaaaagttacactgtggtaaggttaacagaaatctat

SEQ ID NO: 121500 - DNA, 601 bp, Human
gaatgtctgaaaataagcatatgatttaagataattactcaagagtaaaagatgggttagtgctacagaaacgtgctactcaaaactgtgttttgtgcagcactgtaatactggggagctttttaaaaatgcaaaatctcagacctcaccaaaaatctggaacttcattttagcaaaatccccaaaggaaaacttgagaagcagtgctatacaacacagtgcttaattacattacagtcactagtttcattcctaatatgaaccaggccactttgcatggggaaaaaacagctctgtaacktgatccttaccctaatcttgagctttcaagatataaaataaagacttattttaacaacttaacaatggggggggtactctgcttgttgttgttgttgttgttttttatgaggaagtttgctgtccttgttactgttcttttattgaggaaagagagatatactgttacttccaaatagggccaaactgagggggaataggaatattgtttaaatattttgcctttcccaaaggaatatgatccaaaaaatccatcctaatttaaatagattataaaacgtgacaaatggttttatgttat

SEQ ID NO: 121501 - DNA, 601 bp, Human
atttaaaagactgtatgctgtgaaaataaggaagctgtcagccttacagtggactcatctgaggacagattatctatgtatctctatcactggcacatagtaataagcactccactaatttaaagggttactgaatgaatcccccgcacgttgtcaggttgacagcattgagatagtagaagtctgggctattcattcatttgttcaattaatatttcaaaccactatgagccaggccccttgagagacactgaaaaataaacaaaaaagcagcctttgcctttaattctagtaggacaggcagataaatgaacagactatcataatacagggagaaaaacgtcatagtatcagtatgcctaatggaccatgagaatatatttgtttataaaggaagggagtcatggcaccaaagcagagaggtagtagtgggtaagtcaaagaggcttaaaagatgaatattcgctatttttgtttttgtttgttggggtggggggatctaaaggaatgaatttgcagacagaaatatatgtataaaaatgttaagacagtgtggtgccaacaagggactacagtgtgctggaaggcagagggttaagaa

SEQ ID NO: 121502 - DNA, 601 bp, Human
taattagaaaaataaaattttatcagccttcacatttttaaagatactaaaaacttaacaaacacagtttttcaaaatatattttatatattactaaactatccaaatgactctggatctctgagggatgcaaaaaaaaattagcactacatacacttttattttccccaaatttttatcaatatctcttcaatagtttaagccactacttcaataaaaagatactctcaacacttgtttagatacttgatagagactacttattagttttctaataaatatataaaaaatttaaaagacwgtatgctgtgaaaataaggaagctgtcagccttacagtggactcatctgaggacagattatctatgtatctctatcactggcacatagtaataagcactccactaatttaaagggttactgaatgaatcccccgcacgttgtcaggttgacagcattgagatagtagaagtctgggctattcattcatttgttcaattaatatttcaaaccactatgagccaggccccttgagagacactgaaaaataaacaaaaaagcagcctttgcctttaattctagtaggacaggcagataaatga

SEQ ID NO: 121503 - DNA, 601 bp, Human
atgttgtgacaagtgtccctagagaagcagaggaacaggtgacacacacacaaaggagaagacatgatgtgaagaggcagagatgggagtgatgctgctgctgaccacaagccaagaaatgccaagagccaccagaagctcagaatgcctgcaggggcaatgtgtccctgccaacactttgagttcagtccagaaatactaatttcagacttccgaccctcaggatagtgagggaataaatttctgctgttttaaagctatccagtttcgcaattttttacagcagccacaggaaactacygtactatattcacacaaaaacctatatatgaatgtttatagaaagcttattcataattgccaaaaactgaaaccaaatgtccctcaataggggaagagataaacaaactatggtgtacctaccacaccatggagtactactcagcaacaaaaaggaacaaactattgacaactacatggatgaatcccaaatgcatgatgccaaatgaaataagccaaacttaaaaaactatacttgattccatttatatgacagtctggaaaatgtaatattatagggagaataatagctcagtggttt

SEQ ID NO: 121504 - DNA, 601 bp, Human
gccctttttactcaagggcttcagtcacttgcaaccccagacctaacatgccccttacatgttaatttagattatattttattttctgagaaagtctatcaaaagccagaaaagaacccaagtctaatatacctagttttagaaactcagaatgaaaagctaattcttccctctaaaaccactgatacattttgcagtctagatactcaactttataaaaaatcttgaaaataagaaccccaactttcaagttcctacattaccttctttaattcaatagactagtaaatgagaccatttkttctagaaatgagtattcacaatgctgatcgacagttaaaaatcactacttcggccgggtgcggtgactcacacctgtaatcccagcactttgggaggctgaggtgggtggatcacctgaggtcaggagttcgagactagcctgaccaacatggagaaaccccgtctctactaaaaacacagaaaaatcagctgggtgtggtgatgcatgcctgtaatcccagctacgcaggaggctgaggcaggagaatcgcttgaacccaggaagcagaggttgtggtgagctgagattgtgccattg

SEQ ID NO: 121505 - DNA, 601 bp, Human
agcagagataagaggagataatccaggcaataatctaattcccagatcagttgtccccaaaaaccaattccatccctatcattccttacagtttggtcctatgcactaacaaatcgccctttttactcaagggcttcagtcacttgcaaccccagacctaacatgccccttacatgttaatttagattatattttattttctgagaaagtctatcaaaagccagaaaagaacccaagtctaatatacctagttttagaaactcagaatgaaaagctaattcttccctctaaaaccactgayacattttgcagtctagatactcaactttataaaaaatcttgaaaataagaaccccaactttcaagttcctacattaccttctttaattcaatagactagtaaatgagaccattttttctagaaatgagtattcacaatgctgatcgacagttaaaaatcactacttcggccgggtgcggtgactcacacctgtaatcccagcactttgggaggctgaggtgggtggatcacctgaggtcaggagttcgagactagcctgaccaacatggagaaaccccgtctctactaaaaacacagaaa

SEQ ID NO: 121506 - DNA, 601 bp, Human
caagaccagtctggcaaacattgtgaaaccctgtctctactaaaaatacaaaaattagcttggtgtggtcgcgcacgcatgtagtcccagctactctggaggctgaggcaagagaatcgcttgaacccaggaggcagaggttgcagtgagccaagatcgcaccactgcactccagcctgggtgactggtattgtcaataccatctattgacaataggccagaagactgcagatcagacactctatgtacttgttgagtaaacattgtatcagagcacagaactagtttcctatgagaaagyagaaattgggttcagattctaggacttcaactttatccataaagcaataacatttactaattagggcagatctacagaaatcttgggttgcctcaaaaagattcaagaaaacccagagctctgcctggctttcttccacacacacgtaggcaagtctcttcacgattccaaaccctcagcctcagggcgccctactgtgcaacaagtctgattatcacctccccatcactggggtatgtgagacagcccaagtttacatctgttgtcctagtacttcccttcatctcaaaagtgatctgg

SEQ ID NO: 121507 - DNA, 601 bp, Human
tggctcatgcctgtaatctcagcatttggggaggctgaggtgggagggttgcttgagcccaggagttcaagaccagcctgggaaacatatgaagaccttgtctctacaaaaaattttaagtattagctgggcatggtgacatgcacctgtggtcccagctacataaaaggctgaggtgaaaggattacttgagcccagaaaacagaggctacagtgagccatgatcacagcacctacagcctggcgacaggacaaagccctgtctcaaaaaaaaaaaaaaaaaaaccaaaaaaaaacaaaaccacaatcctttgtaaaaagcacaggtctcattaaagaaaaagtacagatttacccaacagaaaaaaataaataaataaataaaacaggatagtcgcagtagctcacacctgtaatcgcagcactttgggaggccaaggcagaggcagatggatcacttgaggtcaggagttcaagaccagtctggcaaacattgtgaaaccctgtctctactaaaaatacaaaaattagcttggtgtggtcgcgcacgcatgtagtcccagctactctggaggctgaggcaagagaatcgcttgaaccc

SEQ ID NO: 121508 - DNA, 601 bp, Human
gcagtggctcatgcctgtaatctcagcatttggggaggctgaggtgggagggttgcttgagcccaggagttcaagaccagcctgggaaacatatgaagaccttgtctctacaaaaaattttaagtattagctgggcatggtgacatgcacctgtggtcccagctacataaaaggctgaggtgaaaggattacttgagcccagaaaacagaggctacagtgagccatgatcacagcacctacagcctggcgacaggacaaagccctgtctcaaaaaaaaaaaaaaaaaaaccaaaaaaaaamaaaaccacaatcctttgtaaaaagcacaggtctcattaaagaaaaagtacagatttacccaacagaaaaaaataaataaataaataaaacaggatagtcgcagtagctcacacctgtaatcgcagcactttgggaggccaaggcagaggcagatggatcacttgaggtcaggagttcaagaccagtctggcaaacattgtgaaaccctgtctctactaaaaatacaaaaattagcttggtgtggtcgcgcacgcatgtagtcccagctactctggaggctgaggcaagagaatcgcttga

SEQ ID NO: 121509 - DNA, 601 bp, Human
ataagagatcaggaaagcgaggctgaagcagccagcttggtttcatgctgcaaatttttggcagacattcaactccttctgctgttttcctagccagcacatttatctatgtaatgtcaccagatccagagagggagtgaggttggaaggagggggaagaggagaaaaactgttttacaggctgccagcccttccacacatgctgttactatacaaaggatgtctagaaagccaatgtgctgcacatattcaaatgctgcaagcaaatacacacacacacacacacacacacacacacacwcactcactctctttctccccatccatccatccatccaaagaacaactgcagaaaagggaactgcctttgaaaaaaagcccataattaaagtcttgatccagaagcaatgactcccttctgaaaatgatttcagttcttgggggaagaaggtggggatactaaccctatggggaaataacctgtattctgcaaaaaagcctgagctgatctggtccctgacaactacaagcatatgctaccacagaaataaacaaagtttctgtgaagcaaaagtataccatcaaataacaattaccttat

SEQ ID NO: 121510 - DNA, 601 bp, Human
ttgctatctcctatcctgccactggaaccctagcattggccctttccgaggagaaacggttgtttccagtcttcagcttccttcagctctcagaactagacttcccatgcgccctcagaaagcccaacagcagcagggcaagacatctttttgagagatctgagacccaactttgtggggcctctcgctcaagtctttgaaagcaatcaggcagcgggccttcctcctaagtctgaatctcagctctgtggagcccctcctccaagcttccaataattcaaacctctttttttttttttttgtttccccagcccatggggttgtagctgattcaggaagttattaccttggtgttacttcaattttccattttgcatttcagttctccagcatctgctttatcaattccctatacatcattttctttactgaagtatctagtgtggattctatttaatatcttagcaacttggcatacctacctatcttcaggaggtcattgttacaggctaaattttgctccctgaaaaattcatatggtgaagccctaattcctcaatgtgactctatttggagagaaggcctttaacagaggtaattg

SEQ ID NO: 121511 - DNA, 601 bp, Human
ggaggaaggaggctttacaggtagaaaatgctcggtttctattattggtaaatagtgatactaacataatatagtgtagaatggtttaaacttggatatttaaaacaaatactgaccagaggttctctgctgccttcctcaaagaacagcattattcatagcaaaaagaaatcaatctttactccctttttccactcccagagaattattaagaaaggggaaaagatagacaaaaatatggaaccaaagcaggttcctaaatgtaactaataagaccttttattttaacacagcacattastgtctctgtaactaagtaagacaaaaacttttctgcctaagaaactaagacaaggcattgagagggtcaagaaaggtggaaggaggttgaaatgtagagtaagtggcagctagtgacaagttcctaaaggcaacatggtcaagggacttttcaaaaaactgtctaagactacattctaaaatttttctatgctacaataaaaatcttgaaacttgcagcccactaaaaaaacaagtatgtcatttttcagtaattttttaaaaggcatggggcttaagtttgattctgtgcagtgcagag

SEQ ID NO: 121512 - DNA, 601 bp, Human
aagaatcacctcagcagcacttagaaacaaactgggttctgccactgtggcatcactttaagcaagttacttaagtgttgaaaagtacaacatacctgcctttcaagttaatgtgaagattaacagataaagttatggctgtgtaattcaaatgtaagaaacacctagtaagtgctagtttctgctacacctttttcaaaactgtatctatccttcaaagcttatttttgttaactgactgattgccacttcttaactcagggcaagttttagttctattttaacttcctgaaataggcargttcattaaaatttcctgtggcctaagaaattttctatatatggtatttacttatgcaactgcattaagagttttaaagtctttgtacatacacatttgccacactgcatattacccacttaaaaaaataatttagtggtacttgagtataagagcattagcaaaagaatatttctatgctaaaatatatacagaagtgatggttgccaggcccggtggctcacgcctgtaatcccagcactttgggaggctgatgcgggtgcatcatctgaggtcaggactttgagacctgcctggcca

SEQ ID NO: 121513 - DNA, 601 bp, Human
tgaggtagggctaaaactatattgggttcaccataagatttgaatctgaaatgcactaaggtggttataggaaaaatagaagagatattcaaagcattttccaagaaaaactctacaagctgatttcaattgctctgtatcacaaagacaaaaactactgataatcagtgcaaaaatctgtgcagagacagaaaatatgccatatatttctctcagacctatccaagcttctttcttataccttattgttcccatgatctatataaagtaaacctgttcctacaactaataaaagaaaaamggttgtagcaaatgactttacacaccattaaacacagcagccacagtgaatctgttaaaaggtaaatcaaagcatgtcattcagctgcccccaactctccagtccaattgcttccatctcagattaaatgccacatgaactacaaggtactgtgtgatctgtactcccctgctttccccctcagttacctgcctgacctcatcttctattgctctctccctctacactccactccagcttccttgcttaggttttcaaggcagtggttacaggcacagggcctttgcatttgctttcctt

SEQ ID NO: 121514 - DNA, 601 bp, Human
tcaaatagcactgctaatcagtacaccatgatttgttttacaatatgccaaactatattgttaaaagcatttaaaaattataactccaggtcactctcattcccaaactattaatgagcatgaaaaccagtgaggtagggctaaaactatattgggttcaccataagatttgaatctgaaatgcactaaggtggttataggaaaaatagaagagatattcaaagcattttccaagaaaaactctacaagctgatttcaattgctctgtatcacaaagacaaaaactactgataatcagtgmaaaaatctgtgcagagacagaaaatatgccatatatttctctcagacctatccaagcttctttcttataccttattgttcccatgatctatataaagtaaacctgttcctacaactaataaaagaaaaaaggttgtagcaaatgactttacacaccattaaacacagcagccacagtgaatctgttaaaaggtaaatcaaagcatgtcattcagctgcccccaactctccagtccaattgcttccatctcagattaaatgccacatgaactacaaggtactgtgtgatctgtactcccct

SEQ ID NO: 121515 - DNA, 601 bp, Human
aagagaagcctactttaggacagggaagctagagggaagactgagaacagtatcgcaactcaaactaaattaccaaaattaacatatttaagtatagcaaagtacttggccaatctactatacttctcagggacagattagatcactttattactacttaacgaagcaaacataaaagggaaaaaaaggagaaagtctggaaaacaaattattgttattcttcagcataggaaacctgtcttcaaacatgtgtctttatcatccagaacaagacagtaaagtttctaactgcaaaaaaaaatggtattcaaaatcataactaagaaaccgctagcaaaattgtccctctatgtccctgtatattccctgtaatattactactgttaacacttcttttatatatgatcagtttcacattactagactttgtctaccccaaaccaaattagcttcagccattcaaacctattcatcaaagtgaagggttgaggcacagtgattcagaccaactggctgtgttgttacttagagctggatagacagtttaaccaaattattctagcacttatcaaataatcccagtcttagaccgtgcttactc

SEQ ID NO: 121516 - DNA, 601 bp, Human
ggaaagactaaacctatttaaatgtagaagagaagacaaatgtaataaaagagattggacctattagaggcagtgaagatcaaatgatgtgtcaactcttcttcctgggcctctctccactacaccatcttttataaaacaggggtgagagcatggaaaagtcattctcctcgagggatatgtacacaattcaatgtaatgacctatgaatggcaggtcacagtaccaggttcacatataaagctcattgtatcactttagcagtctggattaaaaaaaggaacaaagttgggtttagagsaatcactgaagagaagcctactttaggacagggaagctagagggaagactgagaacagtatcgcaactcaaactaaattaccaaaattaacatatttaagtatagcaaagtacttggccaatctactatacttctcagggacagattagatcactttattactacttaacgaagcaaacataaaagggaaaaaaaggagaaagtctggaaaacaaattattgttattcttcagcataggaaacctgtcttcaaacatgtgtctttatcatccagaacaagacagtaaagtttctaactgc

SEQ ID NO: 121517 - DNA, 601 bp, Human
tgagagggtgaggtgggaggatcgcttgagcccaggaagtcaaggctgcggtgagccatgatcatgccactgcaccccagcctagcaacagagcgagactgtctttaaaaaaaaaagaaaaaaaaaggtatttactagattctgcaactgagaaatagttgaaggcatcactgtgagagagcccttgtcagtgacagaataagaactaaagtcacaggaccaacaaactgccatgaacggacagagagcagacaaaaggtagctaaaaagaaattgcaataggttttaatgtattctaagkgttcaagatgggaaagactaaacctatttaaatgtagaagagaagacaaatgtaataaaagagattggacctattagaggcagtgaagatcaaatgatgtgtcaactcttcttcctgggcctctctccactacaccatcttttataaaacaggggtgagagcatggaaaagtcattctcctcgagggatatgtacacaattcaatgtaatgacctatgaatggcaggtcacagtaccaggttcacatataaagctcattgtatcactttagcagtctggattaaaaaaaggaacaaagtt

SEQ ID NO: 121518 - DNA, 601 bp, Human
actgtgcaggatggcaatggaaaaccctcaagatgcattcattcattggttcattgatttgcttgcttccccaaggacaaagtatcgagatgcttttagtctactggggagaacagataaagtacaataaaatgtttgtaggtaccatgatagaactatagtaatagaaaacaggaggaaagtggggaaggaggtactttcacaaaagtaccctttgacttaagtttttccagaagtatttaacaggcagccccaccaggttcaaaaaggtgttcaaaaaggtagaaaatacacaatcagrtttgggaagggaaggtgagcttagtttggggcttactgagcttaaaaatgcttatgtagccgggcacagtggctcacgcttgtaatcccagcactttgggaggccgaggcgggcggatcacctgaggtcaggagtttgagaccagcatggccaacatggtgaaaccctgtctctattaaaaatacaaaaattagccaggcgtggtgacatgcatctgtaatcccagctactcgggagactgaagcagaagaatcgcttgaacccgggaggtagaggttgtagtgagccgagatcgcacca

SEQ ID NO: 121519 - DNA, 601 bp, Human
ctgctctggctgggcctttacaactggtccttgttatgaccatttagaaactttactccaaaaaatcctatcccagtcatgttcatcacttagaacctaaatgatacagtgtggattttaaaaagcaaacccttaagattgaaaaattcaactggaataagttcaagaagacacagtgtaagcgctgaaaaagcatgtgatctagtacaagagcagtaagatatatacaagtaaacagacacagtgactcctcggcagaagacattaagtgagagaaacagtaagtgttttctagcagtamgaaaaagaaattccaactgtggtgtggaggaagggaaaggttgaaaggggaaaacaacatgtactaagcatcagtattatgttttgggatctttagaaacttgtccaaggacagtagctaacaaatgttaagagtggtttgtttaatctatgttcctcctaagagtgatggagagaaggcaatagaggtagtataagtagcatagacttaggtgtgcagtctggtaaggccaatgcttaaagcacatagcttctgctataagggaggggaaaaaaaataaaagaaagaagctagataagt

SEQ ID NO: 121520 - DNA, 601 bp, Human; identical to SEQ ID NO: 35218

SEQ ID NO: 121521 - DNA, 601 bp, Human; identical to SEQ ID NO: 35219

SEQ ID NO: 121522 - DNA, 601 bp, Human; identical to SEQ ID NO: 35220

SEQ ID NO: 121523 - DNA, 601 bp, Human; identical to SEQ ID NO: 35221

SEQ ID NO: 121524 - DNA, 601 bp, Human; identical to SEQ ID NO: 35222

SEQ ID NO: 121525 - DNA, 601 bp, Human
gaggtggggtgagctgcagactacacccacatggctataaatggggagcctctggctgctgctcactcagcctcccttccccagccgtgacagcactggagcctttcggacacctggaccatggaccccagggaatgtgtctgcatgtctggtgagtaaagaagccctccctggggtctgggaaccttggaccagcttcctacagggagcctgcaggtccctgatgaaaacttctcttccctctaattaggagccaccaatggggttcgtcctgggagccgacaggtggactggccacctstggggcagctcccactctctgttggctcccagcctgattttctagaatcgatatcctagctcagggaatggctgagagggggacttgcaaactttggtctttctagcgttggcccctaagggcagtcaccagggtgaggagaagagctctaaaccagaatctggcaacctggtttgggtccattgctgcggtcccctccctggcgcttattctttctggtcctcagtttcctcacctgtagactgaggttccttattcccagccaaccacatcccagagctgctatgaaagtgctaaaac

SEQ ID NO: 121526 - DNA, 601 bp, Human
cagaggttgcagtgagcagagatcacaccattgcactccagccttggtgacaagagtgaaactcagtcaaaaaagaaaaggaaggaaggaagaaaggaaggaaggaaggaaggaagagagagagagaaagaaagaaagaaagaaagaaagaaagaaagaaagaaagaaagaaagaaagaaagaaagaaagaaagaaagatcccatccccaccctcaatcctccagccatggtggattggggcttgtggggagggggtctagatgccttttacccatctgggagagatctgaaatgagaacyatgtagagacctatggcaggtctctacccagggataagggcatccacagtgtttggagcaggaagaggactgaggggaagttctgtcctgcccagtggtaacagggatagagcactggcctggagtcatgagccctaggttctagtcttgcttttgccactgtctcatgaccttggcaaaccccctcccttctgtgggcttctgatggactctagatggtccctgggatcccttccagttctaacatgcctcaacctcctatctcagcatttttgctaatgtggattgaaacctcatgca

SEQ ID NO: 121527 - DNA, 601 bp, Human
ccttttacccatctgggagagatctgaaatgagaaccatgtagagacctatggcaggtctctacccagggataagggcatccacagtgtttggagcaggaagaggactgaggggaagttctgtcctgcccagtggtaacagggatagagcactggcctggagtcatgagccctaggttctagtcttgcttttgccactgtctcatgaccttggcaaaccccctcccttctgtgggcttctgatggactctagatggtccctgggatcccttccagttctaacatgcctcaacctcctatcycagcatttttgctaatgtggattgaaacctcatgcacacacccctcttttcctacttcctctaagtagtgggaggggcagtggtgagatggaagtgttgacccacagcggatctgcgcatctcctgactctttcaggctgctgtccctgctgccccccgggctgtgccaaatgtgcccggggctgcatctgcaaaggaggctcagacaagtgcagctgctgcccatgaaagccatccatcgtgcccaccccttccaaggagagaaacctgggaagtgtctgtacagtgcatgaatcgaga

SEQ ID NO: 121528 - DNA, 601 bp, Human
gtaggtcggtgggtaaatatcccagcatctttacccctcaaaaggaacaactctgagactcattctatgctgtctcccagaagtctctagaagcactgagcttcaaaagctcacagcagtaacctgctcattaatgtaacctacggtggcctccttccttgcctcacctccccagttccccaccattgctttctgggatctccacccaaagaaactacttgtacagggtccgctttctgggtaacctaatcttggccaggctctcctggcatagcccagaatgcctcattgtgcaaatgtkgctgtttaatgggcttgagcatggaatcagtcatgaacggaggctgtgtgtatctaaaggaaatctccaaggtcaagacattgagggcattagctgccctggtttggttatttggatcagtctttaggactggatgacctggaaggcatgaaccaggaagaagatggtggtggaggtgcagaaacagcatcctaagcagaccccctaggagatgactttttggctaaacagctgagaaagctgaagtccctggaggttggcactggggactgggggtgatccccagctctcacccacacc

SEQ ID NO: 121529 - DNA, 601 bp, Human
ggaaggcatgaaccaggaagaagatggtggtggaggtgcagaaacagcatcctaagcagaccccctaggagatgactttttggctaaacagctgagaaagctgaagtccctggaggttggcactggggactgggggtgatccccagctctcacccacaccaccatcctcaacacagctgaagacaaacccaagctctgagatcattttcattcatgccatcaagggcctgaactagggcccatcagagaccagagcggcctcctcctccaccagcctctgtcaagcaaccatcagatacargagtgggtgagaatagagcctttgccaaggtcacagagcagccccaggttgggctgggctcagctagcaggatttactgcatgcttcctggaactgatcactttcataatccacactgtcattatccctgtttggaacttagctggggcttccctaggaagattttcaccctctgtccatgagttgtgccttagacacagaatcatagtgcagtggaaacagcttggccctgggagtcagacactctacccctccctggcaacatgaccttgaccaagtcatttaaccttttgaggctca

SEQ ID NO: 121530 - DNA, 601 bp, Human
ggctcagtttcctaatctgtgaaatgcgtctccttcacagagttgtagagagaaactgtagcacagaatctgtgcacatagcagtgccccattaacatagattttagcagagctacagcctgtcctagccttctgtttattgatctctgaaaaggcccctaccaagccattctctgtcattgcagagctcttaagcaccttgagaaggacacaacgcaagggattataccttccagcggacagaacagtcccttgtgcctccagcaagcaggttggacactcaccctgcaacctcggcctyggtacccactgggatgccaactcatctcatccaaatgcctttagagttggtacttctgcacgatctcacttactcccatcacaaccttgaaaaggagattcagccttcagattcttatattaataataataatattaacaactaatagttattgagcacttaatatggattcaacacctaataagtgccaagcattgtcctaagcagtttataaacatcatttcatggactctgcactatcaggaccacttcagagccagacaaccagggccctgctctgggccctctgccttagaggac

SEQ ID NO: 121531 - DNA, 601 bp, Human
attgcagagctcttaagcaccttgagaaggacacaacgcaagggattataccttccagcggacagaacagtcccttgtgcctccagcaagcaggttggacactcaccctgcaacctcggcctcggtacccactgggatgccaactcatctcatccaaatgcctttagagttggtacttctgcacgatctcacttactcccatcacaaccttgaaaaggagattcagccttcagattcttatattaataataataatattaacaactaatagttattgagcacttaatatggattcaacacytaataagtgccaagcattgtcctaagcagtttataaacatcatttcatggactctgcactatcaggaccacttcagagccagacaaccagggccctgctctgggccctctgccttagaggacctggtcttcctgtccccacaggagaggagtccgagggtcccacgagatctgtccaactagaactcatgctcattcctcccccaagtcccccatctagcaccatctagacaatgctttgggtacctgggaccccaaaggctagttctagggtctgcgtaggccccctctcccagcagtc

SEQ ID NO: 121532 - DNA, 601 bp, Human
tgagaaggacacaacgcaagggattataccttccagcggacagaacagtcccttgtgcctccagcaagcaggttggacactcaccctgcaacctcggcctcggtacccactgggatgccaactcatctcatccaaatgcctttagagttggtacttctgcacgatctcacttactcccatcacaaccttgaaaaggagattcagccttcagattcttatattaataataataatattaacaactaatagttattgagcacttaatatggattcaacacctaataagtgccaagcattgtcytaagcagtttataaacatcatttcatggactctgcactatcaggaccacttcagagccagacaaccagggccctgctctgggccctctgccttagaggacctggtcttcctgtccccacaggagaggagtccgagggtcccacgagatctgtccaactagaactcatgctcattcctcccccaagtcccccatctagcaccatctagacaatgctttgggtacctgggaccccaaaggctagttctagggtctgcgtaggccccctctcccagcagtctgtccttccctaaggtgcacca

SEQ ID NO: 121533 - DNA, 601 bp, Human
ctaagcagtttataaacatcatttcatggactctgcactatcaggaccacttcagagccagacaaccagggccctgctctgggccctctgccttagaggacctggtcttcctgtccccacaggagaggagtccgagggtcccacgagatctgtccaactagaactcatgctcattcctcccccaagtcccccatctagcaccatctagacaatgctttgggtacctgggaccccaaaggctagttctagggtctgcgtaggccccctctcccagcagtctgtccttccctaaggtgcaccwtgtcatcagtctgtacactcctgggcccgaacgatggccaagggtagaggtattcagagacgggaggatgtgtgaatagagattggacacatgagtttttatgtctacatagagtggagaagtcagtgtgggaagagcagggggtgaagtgcacctaggcctccattcttgcttttgccccaggctctgcaagtgttaggggcaggcctgcactaacaaccctagaagacaatcctgttacataataggatcctgttagatcccccactttgcagatggagatgctgaggctccaggaaa

SEQ ID NO: 121534 - DNA, 601 bp, Human
aagtgcacctaggcctccattcttgcttttgccccaggctctgcaagtgttaggggcaggcctgcactaacaaccctagaagacaatcctgttacataataggatcctgttagatcccccactttgcagatggagatgctgaggctccaggaaagtcaatggctgaaagtcacaagacttccagggggcagaactgggaactgagctcaggtctgcctgacccagaggccatgctcttgtctatgcgatatggatgaggcagagaggaggctgcaggcaatgctgccccagacccaggggygaagagtctttgcctggggccttgtactttagagagcacacacaccacaagcacacaaatgtgttaaggcagcggcccccgacctttttggcaccagggaccagtttcggtggaagacaacttttccacggacagtgcagtggggcagcgcgagatggttttcggatgaaactgtagttagattctgataagtagctcaaacctagattcctcgcacgtgcagttcacaataaggttctcattccaatggaattccaatgccacttctgatctgacaggaggcagagctcagacggtaac

SEQ ID NO: 121535 - DNA, 601 bp, Human
aattaacaaactcatcaaatcctcctcaaaaagcatgaacgcaacagactctcatgtcacaccatcatttcccatgagtgtgacttgtccattttcttgcttttctttgtgttccaatttgtgtttccagaatatttatgattttatgctaattgcagaagctgcacaaggcaactgaggaatgttttgtaatattaagcaattcatattattcatataaattcatattactcttaaattggtgtagatagagctatagctacagataaatatacagatatacatactatggactgaatggctgtgtgccctcaaaattcgtatgttgaagcctaaatccccaatgtgatggtatttggaggaggggcttttaggaggtaattaggttgtaaggcagagtcctcatgaatagaatcagtgcccttataagaagagatgggccaggcccagtggctcatgcttataatctcagcactttggaaggccaaggcaggcagattgcttgagcccaggagttcgggaccagcctgggcaacatctctaaaaaatctctaaaaaaaatacaaaaattagccaggcatggtggcacacacctgtagtc

SEQ ID NO: 121536 - DNA, 601 bp, Human
actatggactgaatgtctgtgtgccctcaaaattcgtatgttgaagcctaaatccccaatgtgatggtatttggaggaggggcttttaggaggtaattaggttgtaaggcagagtcctcatgaatagaatcagtgcccttataagaagagatgggccaggcccagtggctcatgcttataatctcagcactttggaaggccaaggcaggcagattgcttgagcccaggagttcgggaccagcctgggcaacatctctaaaaaatctctaaaaaaaatacaaaaattagccaggcatggtgrcacacacctgtagtctcagctactcaggaggctggggtggaaggattgcttaagtccaggaggcagaggaggaggttgcagtgagctgtgtttttgccactgcactccaggctgggcaatagagtgagaccctgtctcaaaaaaaaaaaaaaaaaaaaagaggcatgaagtgatctctctgtctttcttttcactgtatgtgaggatacaaacagaaaacggccacctataaacaagaaagtgggctctcaccagacaccagatatgtctgtgccttgatcttggattttccaacctcca

SEQ ID NO: 121537 - DNA, 601 bp, Human
aggcccagtggctcatgcttataatctcagcactttggaaggccaaggcaggcagattgcttgagcccaggagttcgggaccagcctgggcaacatctctaaaaaatctctaaaaaaaatacaaaaattagccaggcatggtggcacacacctgtagtctcagctactcaggaggctggggtggaaggattgcttaagtccaggaggcagaggaggaggttgcagtgagctgtgtttttgccactgcactccaggctgggcaatagagtgagaccctgtctcaaaaaaaaaaaaaaaaaaaaagaggcatgaagtgatctctctgtctttcttttcactgtatgtgaggatacaaacagaaaacggccacctataaacaagaaagtgggctctcaccagacaccagatatgtctgtgccttgatcttggattttccaacctccagaaccatgagaaataaatttctgttgcttaagccacctagtctatagcattctgttatagcagcctgaattgactaagacatacataaatatgtgagctatacctttctatatgtagatagaatttttaaatatttcaactggatgaacatcaagtt

SEQ ID NO: 121538 - DNA, 601 bp, Human
aggagttcgggaccagcctgggcaacatctctaaaaaatctctaaaaaaaatacaaaaattagccaggcatggtggcacacacctgtagtctcagctactcaggaggctggggtggaaggattgcttaagtccaggaggcagaggaggaggttgcagtgagctgtgtttttgccactgcactccaggctgggcaatagagtgagaccctgtctcaaaaaaaaaaaaaaaaaaaaagaggcatgaagtgatctctctgtctttcttttcactgtatgtgaggatacaaacagaaaacggccrcctataaacaagaaagtgggctctcaccagacaccagatatgtctgtgccttgatcttggattttccaacctccagaaccatgagaaataaatttctgttgcttaagccacctagtctatagcattctgttatagcagcctgaattgactaagacatacataaatatgtgagctatacctttctatatgtagatagaatttttaaatatttcaactggatgaacatcaagttctagaacaatgaatcattttattttaataaaaatatttaataaaatttcattaaatccttaagaaatt

SEQ ID NO: 121539 - DNA, 601 bp, Human
agatagaatttttaaatatttcaactggatgaacatcaagttctagaacaatgaatcattttattttaataaaaatatttaataaaatttcattaaatccttaagaaattaaataggccaggcgtggtggctcaagccggtaatcccagcagtttgggaggtcaaggtgggcagatcacctgaggtcaggaattgaataccagcctggccaacatggtgaaaccccatctctactaataatataaaaattagctgggcatggtggtgcatgcctgtaatcccagcaccttgggaggccaasgttggcgcatcacttgagatcaggagctcaagaccagcctgggcaacatggtgaaaccctgtctctacaaaaatacaaagcttagctgggcatggtggcacgtgcctgtaatcccagctactcaggaggctgaggcaggagaatcgcttgaacctggaaggcagaggttgcagtgagctgagatctcgccattgcactccagtcatagcgacaagagtgaaactccgtctcaaaaaaaaaaaaaggaagaaagagaaagaaagaaagaaattaaataatacaggacattgaagctggatg

SEQ ID NO: 121540 - DNA, 601 bp, Human
tctctacaaaaatacaaagcttagctgggcatggtggcacgtgcctgtaatcccagctactcaggaggctgaggcaggagaatcgcttgaacctggaaggcagaggttgcagtgagctgagatctcgccattgcactccagtcatagcgacaagagtgaaactccgtctcaaaaaaaaaaaaaggaagaaagagaaagaaagaaagaaattaaataatacaggacattgaagctggatggagaaacgtagatgatcttggcggctttcttaagcacgtgcatctctgggatgaccacttcrgctgcctcataacagtagaaaaataaacccctatttagggtttcagccactgttcagctaaaagcaatctgatatattgtacaaacatgagtaagtcttccatgctctgtctcttaagttgttatgaaatttggaataaaataaaatttgaaataaaatgtcaaataaaattttaaagccagatgtggtggctcatgcctgtaatctcagcactttgggaggctaaggcaagaggatcgcttgagcctaggagtttgaggctgtagcaagctatgatcatgccactgcactccagcctga

SEQ ID NO: 121541 - DNA, 601 bp, Human
tgcctcagcctcccgagcagctgggactacaggcatgtgccaccactcctggctaattttgcatttcttttttagtaaagacggggtttctccatgttggtcaggctggtctcgaactcccgacctcagatgatccacccgcctctgcctcccaaagtgttgggattacaagcctgagccaccgcacccagcctggagttatttcttgaatcactctgatgagttaaacggttttaatttcttattgttttctctttttttggaggtccaaacaaatatttattaaattcctattataagycagattttatactctgacctagggataatatattgttaagttttccttgaattatttctgcttctttgagctgaaagcagactctgtgggtgagtggagtttgctgactggcaagcttggttttagcatgcccaggtggggagatggtagccaagtttggccaccccttggggtcaaaacaagaagggtcatcttctgtggagttgacccacctctggaagccctggctcctcctaggctggttattcgatttcttcagagaaaatcttgcagtctcagaccgggggaaaatggtggggc

SEQ ID NO: 121542 - DNA, 601 bp, Human
gacccacctctggaagccctggctcctcctaggctggttattcgatttcttcagagaaaatcttgcagtctcagaccgggggaaaatggtggggctgcccaaactagggtacaggaggtaagtgtgacaaacacatgtcagttctacagccagaccttccattagctgccatcttggtttttactcctccttcctcttctgctttcttagcctcacctcaccccaccaaaataaaacaaagcaccccaaaatctcctatagacttccgcacttcttgatttgagctgtggctttctctacwcccatttacccataaatgtgatttaactcattccagtattccagaaatggtaaaatctctgatctcttgatgtactgtccaagccatctcccccaacacagctcttttattggtttttcttttttcctctttatccttccttactttctttcagtgtatactcaggaggaggagaggaaaatccatgtgctcggcctctcatctttagccaaaaatctgagccagacttttcattggtaggattttgaatctttacaataactctgcaggatagagattattgtccattccacaggtgag

SEQ ID NO: 121543 - DNA, 601 bp, Human
gcaccccaaaatctcctatagacttccgcacttcttgatttgagctgtggctttctctactcccatttacccataaatgtgatttaactcattccagtattccagaaatggtaaaatctctgatctcttgatgtactgtccaagccatctcccccaacacagctcttttattggtttttcttttttcctctttatccttccttactttctttcagtgtatactcaggaggaggagaggaaaatccatgtgctcggcctctcatctttagccaaaaatctgagccagacttttcattggtakgattttgaatctttacaataactctgcaggatagagattattgtccattccacaggtgaggaaaactgagactcaaggaagtgagagaccttgtcccaagctcaagcagaactagctggtagagaagcttgaaggccatgagggaaggtgagatggaggggaagaaaggccacagggataagtgagcagagcggctacgtgtggccctgagggataacacttgagcattaagaggaaacaccaaggaaacagattttaggtcaagaaaaagaagagctctctcatgtcagagcagcctag

SEQ ID NO: 121544 - DNA, 601 bp, Human
aaaaaacaaaaacaggccgggtgctatggctcatgcctgtaatcctagcactttcagaggccgaagcgggcagatcacttaaggtcaggagttcgagatccacctggccaacatggtgaaacacctgtttctaccaaaaaataccaaaaaaaagtagccaggagtggtggtgcacacctgctactcggggatgctgaggtgggagaatcgcttgaaccctgggacagaggttgcagtgagccgagatcgtgccactgcactccagcctgggcgacagagtgagaccttgtctcaaaaaaamaaaaacaaaaacacagaaaatggttatagcaaaacctaaacagataataggccataaattagttatgcagtagtttttcaaaaagaagccacatagaatacaaaatatactatcctaaatgtcaacagggattgtgttcagatcacagtaaaagataatttttacttttccttctttctgtgttttagaattccccaaaattttctgaagtagcatgttttaaaataaataaatacattctgaaaaggaaaaaaaatagtgtgtattctttgagccagaaattttactttaagaaatgtt

SEQ ID NO: 121545 - DNA, 601 bp, Human
ccagcctgggcgacagagtgagaccttgtctcaaaaaaacaaaaacaaaaacacagaaaatggttatagcaaaacctaaacagataataggccataaattagttatgcagtagtttttcaaaaagaagccacatagaatacaaaatatactatcctaaatgtcaacagggattgtgttcagatcacagtaaaagataatttttacttttccttctttctgtgttttagaattccccaaaattttctgaagtagcatgttttaaaataaataaatacattctgaaaaggaaaaaaaatagtrtgtattctttgagccagaaattttactttaagaaatgttgtatggaaaggaaaaaaacaaccatgaatatacacatacaaatgctcccaagatgtttatcatggcatggattataatagtgaagatttggaaacaatcaaaatgtctcaaagtagggtactgggtaagtcaattatggaataaatctattaaaataaaattatagaagtgaaattcatgtcatggatgttcataatctactgataagcaagaaataaagtcatttataaatcagcgtgtactgtgggcttctaattttat

SEQ ID NO: 121546 - DNA, 601 bp, Human
gctcactgcagcctcgacctcccgggctgaagggatcctcctgcctcagcctcccaaatgcctgggaccacaggcacgtgccaccacacagctaattttttgtagagacggggtttcaccatgttgcccaggctggtcttgaactcctgagttcaaacaatccacccgcctcagcttccccaagtgctaggattacaggcgtgagacaccacacctggcccatgtgttgatcttttattaagcagctttctctttacccaggctgtgggttcttgaagaaggacatttcttactaatcttygtatctggcattcctaacacaaagtctggattaaggtgatgctcaacagatgtttgtggtctgaaatgaaattcaccaccatgttactcttttaagccaagcaggatggtgggggctacagggtaacttcatggctctgtatttaactaagcctgactcttcatgactcaaccttcaaggggtcccacaaaaataattagcccaaagtcagactcactcaattctcacaggcattcattcactcaacattcaaaggacatttcaggtactcagggaactttgctaagcacaggagtgggg

SEQ ID NO: 121547 - DNA, 601 bp, Human
gctggtctcaaactcctgatcaaggcggtgatctgcccgccttggcctcccaaagtgctgggattacaggcatcagccaatgcgcctggcctgaaatttcttttaaaaggaaatctcatatcactactgtagaagagatgctgaatcatttgccataaacaggaggtaaccatggagacaaatacagagaacataaagccaagttattaaatgtctagctagatactgtggcatggtagggctcccctgttctttcctgactcctcagcccattctctgttaaaaaggggagctggggtcrggcacggtggctcatgcctgtaatcccagcacttcgagaggttgaggcaggaggatcacttaagcccaggagttccagaccattctgggcaacatggtgaaaccctgactctaccaaaacaaacaaacaacaaaatacccagaaaaccacacacacacaaattagccaggcatggtggtgtgtacctgtggttccagctacttaggaggctgaggtgggaggatcgcttgagccagggacgtcaaggatgcagtgagccatgattgtaccactgcactccagcctgggtggcagagcaag

SEQ ID NO: 121548 - DNA, 601 bp, Human
actttgggaagctagaccagtggaatcaggcttggagtcaagagacatggttcaggtaccggcttcattacaacattgctgtgtgactttggacaaaatctatgctgtctctgagtttccttatctactaaaataaggcagatggtactcatgggatgagttttcagaaagaatctcaggatccctactcaaaccctggtgtaagtggggcaaggatgtcataggtgagcgacagctatctgggctagggatgcgggggtaaaggaatttaccaagacagttgtagataaaggaaggcagrtttattaaagaaagtatgaaaatacattgccggggagcaactggcaaaaccagcagaagaggaaccgactgcaaggaagcaaaggctttctgaggattttatagaatggaacttgggctgattgataacaccaatgcagcagggagcttaacttgcattctttcctcagcgggggtgtttgataaattgaggtgtttgatggtaagcaggaagtctgcgagttatgtacgttatctgcatgggagggccgtatgtcctgggccaaggtagacctagaacttatttgctttatctctttgc

SEQ ID NO: 121549 - DNA, 601 bp, Human
aaagaaagtatgaaaatacattgccggggagcaactggcaaaaccagcagaagaggaaccgactgcaaggaagcaaaggctttctgaggattttatagaatggaacttgggctgattgataacaccaatgcagcagggagcttaacttgcattctttcctcagcgggggtgtttgataaattgaggtgtttgatggtaagcaggaagtctgcgagttatgtacgttatctgcatgggagggccgtatgtcctgggccaaggtagacctagaacttatttgctttatctctttgctctctckggtcccaccagtctgaccccttttccctaattaggattccacaaaggataggacaggggaggggggcattttgccaacttgagggcaagatctcggagcatcaatgatccagtgaaaattgggaagacaacatcacaaaagacctaaaagaatgtaggctcccggaagctagttcctgtggctcacagtgactgcactaagctcagagatttggtctcctccagataagtgctgggaccccgttgttgtgggctggaacttggtccgggccaggatctgcttggaatggagaatctacct

SEQ ID NO: 121550 - DNA, 601 bp, Human
tctcactctgtcacccaggctggagtgcagtgatgcaatctcaactcactgcaacacctcccgggttcaagtgattctcctgcctcagcctcccgagtagctgcaattacagatgcccgccatcacgcccagctaattttggtatttttagtagaggcaaggtttcaccatgttgggcaggctggtctcgaactcctgacctcaagtgatccacccgctttggcctcccaaatgctgggattacaggcgtgaaccaccgcgcctggcctaaagtcagtgctttgatgttctcttgtgtggraaaccacatacactatcacaggccaggctgtgggctgagtcaggactgtgcaggtcatgtagggcctgaatggggcatttccagaggtcgaggacctgccttatgggtagagagaggaggcaggatgactttctttgttgcagatgaagattccgcaattccgtaaagtttgcttggggtatcaaagcattatcaagtatccaggagcctggcgggtagcatgcctaataactagaattcatagtggattgaattaaagacatcggggcaggctgaagagtaatgcacttagatttaagt

SEQ ID NO: 121551 - DNA, 601 bp, Human
ctcccgagtagctgcaattacagatgcccgccatcacgcccagctaattttggtatttttagtagaggcaaggtttcaccatgttgggcaggctggtctcgaactcctgacctcaagtgatccacccgctttggcctcccaaatgctgggattacaggcgtgaaccaccgcgcctggcctaaagtcagtgctttgatgttctcttgtgtgggaaaccacatacactatcacaggccaggctgtgggctgagtcaggactgtgcaggtcatgtagggcctgaatggggcatttccagaggtygaggacctgccttatgggtagagagaggaggcaggatgactttctttgttgcagatgaagattccgcaattccgtaaagtttgcttggggtatcaaagcattatcaagtatccaggagcctggcgggtagcatgcctaataactagaattcatagtggattgaattaaagacatcggggcaggctgaagagtaatgcacttagatttaagtccagggtctgcctccaggacaagccactgaatctgagcctcgatttcctcccttgcaaaagggagttagcaatgcctaccataagggta

SEQ ID NO: 121552 - DNA, 601 bp, Human
gtgagaaccaatgtggtgaggaccctgctccaagtcttttcccaatgccatcccatttaagtccctgacaaatctattaagcaggaactattattactattagtattattttcgttttaccattgagcaactcaaggcacagaaatgttaagttgacctagctagtaacttgctatggtgtttgtttgtttgctttagagagagaaggggtcttgccatgttgccctggcttgccttgaactcctgggctcaaatgatcttcctacctcagccttccaagtagctggaactacaggtgcaygccaccatgcctggctgccgtattactattaagcggcagagtcacactgtaaactcaactagcatgacctcagactcattcattcattcactcatcaagtaaatgtgtcctgaatgtctaccacgtaccaggcactgttataggcacttcagagacaccagtgaacaaaaacagtgatccttgctctttcttgcttaaattctagcaggagacagacgacatataatcattacaaataagtaaattatttagtttgctagtaaatgttaaatgctatggaaaaagggaagatagagcaag

SEQ ID NO: 121553 - DNA, 601 bp, Human
ttaagcaggaactattattactattagtattattttcgttttaccattgagcaactcaaggcacagaaatgttaagttgacctagctagtaacttgctatggtgtttgtttgtttgctttagagagagaaggggtcttgccatgttgccctggcttgccttgaactcctgggctcaaatgatcttcctacctcagccttccaagtagctggaactacaggtgcacgccaccatgcctggctgccgtattactattaagcggcagagtcacactgtaaactcaactagcatgacctcagacwcattcattcattcactcatcaagtaaatgtgtcctgaatgtctaccacgtaccaggcactgttataggcacttcagagacaccagtgaacaaaaacagtgatccttgctctttcttgcttaaattctagcaggagacagacgacatataatcattacaaataagtaaattatttagtttgctagtaaatgttaaatgctatggaaaaagggaagatagagcaaggtaaaggagatgaaaagtactggggcatcgaggcatgcaattttacgtagtgtgatcatgatgggcttcacagaga

SEQ ID NO: 121554 - DNA, 601 bp, Human
caccagtgaacaaaaacagtgatccttgctctttcttgcttaaattctagcaggagacagacgacatataatcattacaaataagtaaattatttagtttgctagtaaatgttaaatgctatggaaaaagggaagatagagcaaggtaaaggagatgaaaagtactggggcatcgaggcatgcaattttacgtagtgtgatcatgatgggcttcacagagaaagcagatttgaacaaagacttagaagtaaagaaaggagtgacttgcatggttatctgtggaaggagaatcacaggctayggaaacatagacaaaataactttgagctgttttttgtttgtttgttttttgagatggaatctcgctcagtcgcccaggctggagtgcagtggtgcgatctcggctcactgcaacctccgcctcctgggttccagtgattctcctgcctcagcctccaagtagctgggattacaggcacccgccaccatgcttggctaattttttttgaatttttagtagagacgaggtttcaccatgttggccaggatggtctcgaacccctgacctcaagtgattcgcttgcctcggcctcccaaagtg

SEQ ID NO: 121555 - DNA, 601 bp, Human
tttagtagagacgaggtttcaccatgttggccaggatggtctcgaacccctgacctcaagtgattcgcttgcctcggcctcccaaagtgctgggattacaggtgtgaaccactgcacctggccacttcgagatgtaagaattaacaaggggtcagagaggataaaggtaggggagaaagggacctcctggagcgatagacctgcacggcatgctcctcatggaggcttagaacggaaggccacatggaggatgaggggtagggggtatcagaaagatgctgtggttttcagacccctcaawatcctggccacccttggggcaggaaggaggttgctatgccagctctgaagcctcaaccccaaagaaatctgacagacctgagggagattgcaggggaggcagcttcagttgagtgcatcccaagcgtgaaggtcctagatacagaaaccctgaggttcagggcctagggcaaagaagttaagaggccagagtgcccttaggcaaaatggaagcaaagaaacagatgactggctgatgctagagttggggaactctgagatctgatattccaattgtccagtggctggaacctacactgtc

SEQ ID NO: 121556 - DNA, 601 bp, Human
tgaaggtcctagatacagaaaccctgaggttcagggcctagggcaaagaagttaagaggccagagtgcccttaggcaaaatggaagcaaagaaacagatgactggctgatgctagagttggggaactctgagatctgatattccaattgtccagtggctggaacctacactgtccgtgtgagagcctacacttgaatatagcctctgactctccatacaaggctctattttggaccttggttagccttggctggcctggctacccctctcccgtggtagcacagcattcagctgctctcgycctgcacagtgcgggctttgctttaaaaattctcatctcaggatgaatttccttattgggttactccagtgtgactagttctttgtcaaacacctcctctgtccctgccttcatttgggggccatcttttttgcgggggaggtacagggtcttgctctgtcatccaggctacagttcagtggtgttatcatagctcactgcagcctcaaactcctgggctcaagcaatcctcccaccctggcctcccaagtagctaggggtacatgtgatccccaccactactggctgattttttaaatt

SEQ ID NO: 121557 - DNA, 601 bp, Human
ccctgctcagtcacaaatgattctccttggcagcttagacctcttttcctttcattttgcacccaaatcccttatattcatataaacattgatcaatcttattttacctaggctctcttttctttttgagacagggtcttgctctgtgacccagattggagtgcagtagtgcaataaggcttacttactgcagcctcctcaacctcctgggcttaagcaatcctcccgcctcagcctcccaagtagctgggactacaggtgcatgccaccacatccagataatttttttttttttttttttagatggagtttccctcttgttgcacaggctgaagtgcagtggtgcgatctgggctcactgcaacctccgcctcccagggtcaggtgattctcctgcctcagccacctgagttgctgggattacaggcacctgctaccatgccgggctaattttgtatctttagtagagatggggtttctccatgttggtcaggctggtctcgaactcccgacctcaggtgatccgccggcctcggcctcccagagtgttgggattacaggcgtgagccaccacgtccggcctcctttttataaatagaaa

SEQ ID NO: 121558 - DNA, 601 bp, Human
cagcggggaaatggaacacgccccttgccagtgacactcggagggcgcaagagtcagtgtcgggctcatcgtgagcaggttctttctgcccccagttcagcaacccgtctgaacagatctggcgtcctggagaattctagaatgaaggggaagagaggcagggaagagctgggaaatacgcaaagcgcctttttctccactttcggagatggtacgtgcgcgcttccacgcagtggcggctgctgcggcgagcacgtcccctgcgggacccacgcggggagtgggctggcagtgcgcgcayagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctg

SEQ ID NO: 121559 - DNA, 601 bp, Human
catggtgaaaccccgtctctactaaaaatacaaaatttagttgggcatggtggcacgcgcctgtagtcccagctattcgggaggctgaggcaggagaatcgcttgaacccgggagtcggaggctgcagtgagccgagatcgcgccactgcactccagcctggcgacagagcgagaacccgtctcaaaataaataagtaaaataaaataaaataaaataaatagcagtaacaaccattttcgtcgctgacagcgtcaggcatcccccagtgaaccaacgagaaaatgggctcagagcggctmaagaagtcggcaggaggcggcgcagcgaggaggcgacaggagagggagggcctgacaggaccagacccgagatcctggggctgtggggaaagacctaacgccgacagccccgactgtcgcccgggcactgtccccgtcgttcgcgccctccagacatgcccaaaccggcactgctgctccccgctacgctgcggggcgcgaggcattctcaggaccacctgaggtcagctaggcagaaggggtcagcccacggcgcctcccgcgctcttccaggcccgttcctcaccatgatcccaagct

SEQ ID NO: 121560 - DNA, 601 bp, Human
aatttgggaggccaaggcgggcggatcacaaggtcaggagttagagaccagcctgaccaacatggtgaaaccccgtctctactaaaaatacaaaaaattagccgggagtggtggcgggcgcctgtgatcccagctactcgggagactgaggcaggagaatggcttggcttaaacctgggaggcggaggttgcagtaagccgagatcgcaccactgcactccagcctgggtgacagagcaagactccgtctcaaaaaaacaaacaacaaacaaaaaaagcaaagcctgtatgttaagacccrggatccttgcatgggccagtaactccaaaacgatacctatccttccttgcctgaaaaccccctcccaggccgggcgcagtggctcacgcctgtaatcccagcactttgggaggttgaggcaggcggatcacgaggtcaagagatcgagaccatcctggccaacatggtgaaaccccgtctctactaaaaatacaaaatttagttgggcatggtggcacgcgcctgtagtcccagctattcgggaggctgaggcaggagaatcgcttgaacccgggagtcggaggctgcagtgagccgaga

SEQ ID NO: 121561 - DNA, 601 bp, Human
ggaggtaagcccaacggccaattcctacacagagcacaagaaagaaggcacctcggagtcagtattcccctaggctctctaagtccttgcagttcccaggcagcagaaagccccgctcagggagccaggactcagaggcaagtgggaggccccgcatcctcacgttaaaggaatccacgctccacggagcagacagagcaggtccaaagctacgctaacccttgaggtaaagggtcagttataaggagggggaagagtgagaggaaggagagacagctggggttagggttcagggagaaaygcaccaccagatggtaaaggaagggacaggaagcaggatttattgaaacctgttttaaagctggtctgggccgggcatggtggctcacacctgtaatcccagcaatttgggaggccaaggcgggcggatcacaaggtcaggagttagagaccagcctgaccaacatggtgaaaccccgtctctactaaaaatacaaaaaattagccgggagtggtggcgggcgcctgtgatcccagctactcgggagactgaggcaggagaatggcttggcttaaacctgggaggcggaggttgcagtaa

SEQ ID NO: 121562 - DNA, 601 bp, Human
gatggtattttacttctgtgaatatatgttcatgtcccggtgaacaagggcttccaacatgcagactgcaggtatactgctccaaatatcaaccccatgtaggcaggatgtttgatcttggtactaaagcaatatgagaaggccagagaacaacatcattgttagcacatccctgctattcctcagatgcccatcccagctgactgcccagggcatccccccagcccaataaccctggatccataggcgtctacaggctacctccataattagagaacatcaggtcaggaaaggtgttgaragcatgcattcccatgttctcaatggggtgaggcccaggatcccaatagtgacactgcttggggagctgcagagaggctgtcccaccaagaagaggggtctttctgaaagccccaaggcccttcagatttcttagtatatgccttctgcactgctgtcttgagggaattctattcagctacccagtctaaacttgaggtgcctttaaacaaagttccctaagagggtcctattagagatctctttcccattaagcccttttcaaaagcaaatgtaacagccgaaatgtttgaacatgtgg

SEQ ID NO: 121563 - DNA, 601 bp, Human
caagttcctttaggtccagggcagaatggtgccctttaaagctgtgattgcattcttcttctggggaagtaaatgctgtggttcagttcaacccagctagtccttactgaatgcctgtcctaagtcaggtactgtattagatgctggccaaagggcagtgaataaaatggacacatcccttcccaacatggagcttacagttaatggtaaataagacctcaaacatgtatttacagatgtgttgcatcttaccaaagagaacaatgtcatgtaatacagtgctgtgaagggggaattgagrgagggtaccaagcctcaaggcagtccagcacatgtgcgtcaaccctgtacctcctaaccagacagctgggaagtccctgacacacagggagttggaccaaaggtcagcttgagcagggctgggacaactgtgtgcagtgctcttctttcctcacagccagctgacaaatctgcaaactcttgcttagggggttaccatcacctctgtgatatagatctcagccggcaatgctcagcttaccttagattttaaaagtgcacattagtacttaagcaagctgattagaatgagttataattg

SEQ ID NO: 121564 - DNA, 601 bp, Human
taaagatacaaaaaaaaaaaaaaaaaattagccgggtgtggtggcgggcacctgtagtcccagctactcgggaggctgaggcaggagaatagcgtgaacctgggaggtggagcttgcagtgagccgagattgcgccactgcactccagcctgggcaacaaggcgagactccatctcaaaaacaaaaaacaaaaaacaaaaaaaagcacttccagattcagttatctgacttaaagtgaagacaggttgtaaagtggtaggattatctctctaatgaggaaactgaggggcagagagactgkttcacttactcaacaagtatctattaagcacctactacatgccacacagagaggctgcttgcctgatacagttgtggtccagaaacatttgaattatcacatgtgccctaccctgggcagagagcaagagagcagcaatgcctcacccattaattcaagcaagaatttgttgggtaacaactatgtcacagataatgcaccagctaatgaagatatcagacaaagaactagcagggagacacacatgcccacccaactatgccacagtgccattagtcatataataaaggtagaaaaccg

SEQ ID NO: 121565 - DNA, 601 bp, Human
gctaaaggtggagtatcaatctgaaaatgagtggttttgcccacagatagtactatctgagcttaaagaagaataaattgcagtggctgtactccccatgcctagatgttcccagtgattgctgcttccaaagcacaatttcatagaatcccgtatttgtgcacttcccaagactgggcacatgaagaaacctctgagtttgaacacttgcaaatggcttgattgaccatactcttgctgtgggcagatgaccttaagttttctttaaaaatgtactctagtctaatccctaaaagagggyatttgcattcactttcccttttgtttcactgaccctttaagtcttcatcacctccaggagatatccccacctcaagtcttcatctgctgctttctagtataacagggcttgaaatctctgcccaaaggtactgataacagtctctgcgggcagcaacctgattactgaatcggggtgaatgttatgatacattgtaggacagttttctacttttcaccagaaagaaagcagtatgtactgagtccaggtcatcattggcaaactgagatgggacttttaggcattatccagacatttgaa

SEQ ID NO: 121566 - DNA, 601 bp, Human
cttatctcactgttatgaacatctggaaggtaataatagttcccggaagtactccagcatatatcagtttataaagcagcctgggtgtgacagctgaggggcacaattgcacaacacttccacagtttcacttttttacacacctgttgtctgacctagcatcaaagctcactcacttgggcagggctggggagaccatgtgggcatgtgtcagggagcggctcccagaacaagaggccatgaccaagccttcccaactgcttctctatgcttagatggcctggcccagctctcttttagrcagaatctgctaaattgcaggaccttaatgttcgcaatgtcattcaggcccccaccaagcactaagagacaggaattgctttccctgtagtcaggagtggaagtaaaaacccagagaagagaggacttgcgtgtggactcagggaagtggcagattgaattcaacccgcaattgttcccatgctaaagctggagtttttttctgccatgctacactgccaccacctcatttacctttctttaggtaaaagaaaattaataacaacacagaaacatgtattgagggccgaatatactttag

SEQ ID NO: 121567 - DNA, 601 bp, Human
tcaattacttctcacacaaccccgtgaggtctgaattactgccctcaatatgacagaccaggaagctgaggtagtacttgaaggatttgcttaacattagagataagaatgaagcaaagacaagataatgatgactattataagaaatattttggaagcacatactatcattgaattcttgcattaactctgcaatgtaggtaataatagacactttctaaagaggtgagaagggagcttggagaatttccttgcacaagatcaatgcagcaaatgtcagaattctgtttcaaaatcaaayctgcctgaccgcaaagcccattcctttttgattatcacaattaaggcaaatactctgggctcagatgcatgccacaatagagctagaaaaatttatttaatccacattgatggtattaatatttttaaaatatccatggattaagatttaaaaatttaaagctatgagagaaaagaataattattagactgtcatgagcagtaagagatgccagaagacaatggagtaatatcttttaagtgttgagaacaaagaactgtcaactattattcaagagtgagggcaaaataaagacataat

SEQ ID NO: 121568 - DNA, 601 bp, Human
atatcttaaagggcatctacaagtctgcagcaaacatcacacttaatggcgaaatgttagaaaatttcccatttctatcatgaaaagacaggaatgccttctaatatgatatctaataaatatgtactggaggtcctagccaatgccttaagaaaagaaaatgaaatagaagaattagaaaggaaaacacaaaattgtctttatttatagatgtcatgattgctggcaaaagagaatccacaaactaatagaaccaatgagaattcagtcaagttactgaatttagtttgtttttttttttgagacagagtcttgccctgttgcccaggctggagtgcaatggcacgacctcagctcactgcaacctccgcctcctgggttcaaaccattctcctgcctcagcctcccgagtagctgggattacaggtgcgcgccaccacacctggctaattttttgtatctttagtagagacggagtttcaccatgttggccagccttgtctcgaactcctgacatcatgatctgcccgcctcggcctcccaaagtgctgggattacaggcatgagccaccgcgcccggccctgaattcagtttttataa

SEQ ID NO: 121569 - DNA, 601 bp, Human
agtctgagactgagctttatgcctcctttgtactcagagcacttagcacaatggtaagcaggtagcagtagctctacaaactcttgttgtttgaaggattaaaatttagaatggaaaattaacagacaaactggtagctgatcagaggcattaatgaagagagcttgaaggcccatgtcaaatccgcactttccctaaagtaccggcttccaagttcagctctgatgttttctaagagtaatcttaggcaagtttcttcacctcatcagatctttgtttccttgtcttataaaacaagagratggtataaaatgatttctaagttgtttgttcatcctaaaactactggtttggatttttatcatccaagctttccatgctaattcattatttcatagtacatttctctctttctatccatgttgactttagatcaacatcccagcaagtaatttcttcattttggagaccctttccttatttgatgctatcttttgacttgtttgactctatgaacaaaacaatcatgtcatgagatcttagaacatagcagcaaaagggatcttagcaataataataatagctaccaattattaagcat

SEQ ID NO: 121570 - DNA, 601 bp, Human
agtcccagctgctcaggaggctgaggcacgagaatcacttgaacccgggaggcagaggttgcagtgagccgagtgtgcgccactgcactccagcctgggtgacagagcaagactccatctcaaaataagtaaataaataaataaataaataaacaaattaaataaagtgggcatatttatatacagaaattgccttgagtgtcatgatggtgatgggaaaccatcgaagagtttgacaagagagtgacatcacacagattagaataatatttcactttttaaagtcttttagagacacttrcctttacatttggttttaaaaacttaccctatctctatccacagcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggtaatggaaagtccttcaaaaactttgggtagttaatgtttgaagaaagggctttctgccagcctgggcaacatagtgagacttcatttccaca

SEQ ID NO: 121571 - DNA, 601 bp, Human
ggttaatactgggcgtggtggctcatgcctgtaatcccagcactttgggaggccgaggtgggtggatcacttgaggtcaggagtttgagaccagcctggccaacatggtgaaaccccatctctactaaaaatacaaaaattagccgggcatggtagcacatgcctgtaatcccagctactaaggaggctgaggcaggagactcgcttgaacccaggaggtggaggttgcagtgagccaagatcgctccactgcactccagcctgggcatcagagcaagactccatctcaaaaaaaaaaaaagttaatatggatatatattaccacaattaaaagtcacccaagcatccgtggaagcccaattccatgaaggaggaacaacaaacttaagaacagagagagtctatatccaaaggaatgaagttaataggacaacctgaaaagtattgttaagatgagaactaaaaagaaatcagccaggcatggtgactcaccctgtaatcccaacactttgggaggccaaggtggaaggatgttttgaagccaagagttcgagaccactctggccaatatattgagacccccatctctacacaagctttt

SEQ ID NO: 121572 - DNA, 601 bp, Human
tggatatatattaccacaattaaaagtcacccaagcatccgtggaagcccaattccatgaaggaggaacaacaaacttaagaacagagagagtctatatccaaaggaatgaagttaataggacaacctgaaaagtattgttaagatgagaactaaaaagaaatcagccaggcatggtgactcaccctgtaatcccaacactttgggaggccaaggtggaaggatgttttgaagccaagagttcgagaccactctggccaatatattgagacccccatctctacacaagctttttaaaaaasttagctgggcatggtggtgtgcacctgtggtggaggctgagatgggaggatcatttgatcgtaggagttcgaggctgcagtgagctatgatcagaccactgcactccagcctgggtgatagcctgtttaaaaaaaaaaaaaaaagaagaagaagaaagaaaggaaagaaagaagaaaaagaaatcatacccatgagagtcaagatcttcaaaaggaaatatataattgttgaaataataatttcaatagataggttgaatattagaaaattagattcaactgaaagagatcagtaaaccg

SEQ ID NO: 121573 - DNA, 601 bp, Human
ggtgatagcctgtttaaaaaaaaaaaaaaaagaagaagaagaaagaaaggaaagaaagaagaaaaagaaatcatacccatgagagtcaagatcttcaaaaggaaatatataattgttgaaataataatttcaatagataggttgaatattagaaaattagattcaactgaaagagatcagtaaaccgaaagactgagctgaggagttctctgataatgtggcaaaaagaaatagtaagtataaaagtgatgttaagaaaaaggactgataaactcagaaattctaatattcatttaataartgttccagagaaagaatagagagaaagtgaagatgtaatagctgagagttttataaaatggaataaagacaaggctttttagaccaaaagctctcattgaacatgtgctgaataaatggaaaaaaaaattacctctaagcccaatgaagaaaatcaaagataaaagaaatcttactagtttccccaaagaaaatgtatataacttccaaagaagagagaaccagactgatagcagacttctcatttgcaacattagattcaatacctgaaaccatacttttgaagtgtaaagaaaaaaac

SEQ ID NO: 121574 - DNA, 601 bp, Human
aaagaatagagagaaagtgaagatgtaatagctgagagttttataaaatggaataaagacaaggctttttagaccaaaagctctcattgaacatgtgctgaataaatggaaaaaaaaattacctctaagcccaatgaagaaaatcaaagataaaagaaatcttactagtttccccaaagaaaatgtatataacttccaaagaagagagaaccagactgatagcagacttctcatttgcaacattagattcaatacctgaaaccatacttttgaagtgtaaagaaaaaaactgcattgaaarctttggatctagaatcctatatatgtttattcatgtatatatgtacacacatgtatttttttttcccccgtgaggacattttatgtgccaagtcctgtgctgggtgctatgggaaataaatagattaatatgccaaggccttgctaccaagagggaacacaaggataaagaaaagtacagagacaagtgttatggaaggaagaatgtggtatatgcaataagtgagatataaactaatgctatgaggttcccaaggaaggagagattctatgtggctggaagtatcagggaagacctcac

SEQ ID NO: 121575 - DNA, 601 bp, Human
ctttttagaccaaaagctctcattgaacatgtgctgaataaatggaaaaaaaaattacctctaagcccaatgaagaaaatcaaagataaaagaaatcttactagtttccccaaagaaaatgtatataacttccaaagaagagagaaccagactgatagcagacttctcatttgcaacattagattcaatacctgaaaccatacttttgaagtgtaaagaaaaaaactgcattgaaagctttggatctagaatcctatatatgtttattcatgtatatatgtacacacatgtatttttttttcccccgtgaggacattttatgtgccaagtcctgtgctgggtgctatgggaaataaatagattaatatgccaaggccttgctaccaagagggaacacaaggataaagaaaagtacagagacaagtgttatggaaggaagaatgtggtatatgcaataagtgagatataaactaatgctatgaggttcccaaggaaggagagattctatgtggctggaagtatcagggaagacctcacaaagattccaggctttatggagtggagggcttggtcaggctatgataattaattcattaccttt

SEQ ID NO: 121576 - DNA, 601 bp, Human
gctttggatctagaatcctatatatgtttattcatgtatatatgtacacacatgtatttttttttcccccgtgaggacattttatgtgccaagtcctgtgctgggtgctatgggaaataaatagattaatatgccaaggccttgctaccaagagggaacacaaggataaagaaaagtacagagacaagtgttatggaaggaagaatgtggtatatgcaataagtgagatataaactaatgctatgaggttcccaaggaaggagagattctatgtggctggaagtatcagggaagacctcamaaagattccaggctttatggagtggagggcttggtcaggctatgataattaattcattacctttccatccaaacctgctctactaccctcctgttacccaggcaacaaatacgggagtcagcttcaaatctttcctctccctcaactcctgtattagttagggtaggctaagctggtgtgacaaatagatccaaacacgggtggagttaacacaacagaaatctatttcatgcttgaagacagtactgctagggtattcagtcataaaggaggctctctgtaatgcagtcatttggaaac

SEQ ID NO: 121577 - DNA, 601 bp, Human
agctggtgtgacaaatagatccaaacacgggtggagttaacacaacagaaatctatttcatgcttgaagacagtactgctagggtattcagtcataaaggaggctctctgtaatgcagtcatttggaaacacgtgctccttcaatattaagctcccacatagcccagggcagtatttcccaaactgatccacagaccagcagtatcagtatctcttggaaacttattagaaatgctcttatctggtcctgctgcagacccaatgaatcagaaactctaggagcagagcccaggaatcttgytcagcaaacttccaggtgattttgatgctcactaggttaaggaccactgcctgagggctttgttaagtctgcaaccagctggcagaaatggaaaaagggcacggaggatgaaaaccgactctcttaaaagccctggcctgaaggtggcacacgtcacttccacttatattccatcagcgaggacttaatcacatggcctcatgtaacagcaagacaggctgggaaatgtagaatagcatgtacccaggcagggaaaggggaacagctttgggggcaacagcgggcattctccatcacact

SEQ ID NO: 121578 - DNA, 601 bp, Human
ctggctttctttgaagcaatgtggaggcctcaagttatggcaggtgtgatagacaaggccacaggaatatcataaatggcttcagatatttctgtgcaatgtgttcaagagccataaacgtagcttcttagaaatacaaatgtgaaacaggttctcttcagatgattttaagctttgaagattttggcacattccagctttgttctcagatatctccatggggcattaaaaatgtcatcctatataagactatgtatgatatttttctcaagtaccacttttgaaatactccattgctaarttagactggatctgggcatgtaatgtgggtcatggtcttggagaaaagaaacccaatttcctaacaacatgtatgattatataggcatattatattataaagcacaaactatttacccatgctagaaacctaaatattaggaaatctattacggtaggcttcttaaattttcattgaacaatagtgtaaattgtaaaacaattatgtaaatcttataaaatgtatttgccatgtttctttttttaaaaaagtcaactcagcacatggttttcatgcccagttaatttttatttctatttt

SEQ ID NO: 121579 - DNA, 601 bp, Human
ggatctgggcatgtaatgtgggtcatggtcttggagaaaagaaacccaatttcctaacaacatgtatgattatataggcatattatattataaagcacaaactatttacccatgctagaaacctaaatattaggaaatctattacggtaggcttcttaaattttcattgaacaatagtgtaaattgtaaaacaattatgtaaatcttataaaatgtatttgccatgtttctttttttaaaaaagtcaactcagcacatggttttcatgcccagttaatttttatttctattttaaaattatcgcttgacttatatatcccatctactttccaaaaagttttgaagtagtttataataaaaacagaaaaatcaatttcgtaaaaaggaccaaaaccagaaagaaagaaagaaagaaagaaagaaaaggtgaggaaaattaaatgaaacaatggttagctttaaaaatttattaaaatcttattaatatgtgaaattttatgtgacccagttatttttttgggtttccagcatatcgttgatcagacaatgtaaatattaccaggtttgacttgttgagaatcaaggccagtcaagtacctgg

SEQ ID NO: 121580 - DNA, 601 bp, Human
tcgtaaaaaggaccaaaaccagaaagaaagaaagaaagaaagaaagaaaaggtgaggaaaattaaatgaaacaatggttagctttaaaaatttattaaaatcttattaatatgtgaaattttatgtgacccagttatttttttgggtttccagcatatcgttgatcagacaatgtaaatattaccaggtttgacttgttgagaatcaaggccagtcaagtacctgggactctttaacaaataaatgtcccactttggatggacacttctccatttttcagctgtgaaaaaggaacagtatyatgtgtgctcggtggcacaaagctaaaattaattcattgcacataaccttttggcatccttcgatacaaggactagggaatacaaggtagtacagataatgagttatgactcactaggaaaacagtcactctgcttatctgtagctacgtctagttccatgtccacatttctaaatatattttattgactgtacttattaattgtttttttaaatggggaaagaaagggaaatgaaataaatttcaggtacctaaaattaaacctgatatatggccaattttggttgggtttacggcaat

SEQ ID NO: 121581 - DNA, 601 bp, Human
ttacggcaatgtcatgataagaggctggttaaaggattccattccaacagatttccacaaggtaagatctagcctgtctgtccattttctccccaaatttgtaggcttgctacgctccctcatgacctggcaaagttggcaaagtttagaaaccttaactttctttaaggaaaactggctcctttcctccttgggagcatggcaggcagtgccaaactgatcagtctatttaacatgacattgggctgcaattctttaatggcatctaaagcaaaacgttaagctcctactctgtcccatygggccaccgaagggttctaaaacctcgtttatgatgtcattttaagtattccctccttcagcaatgacaataaaagttaactattaaactcatgttttcaacttcccaccatgggttccctgcaacacaaaaccagcaaattaaatcattgagatactaggatacttaatgaaataaaagcgaattcctcataaatggccctaactgtagaacatctggcctgcccagctgcattttctctacatcagttgaggatgtaacaaagataaccgacccttagtctttccaaataacaaaagc

SEQ ID NO: 121582 - DNA, 601 bp, Human
ttcatttaaatttcaatagccacgagtggctataggatagggcagagcagctctagaatcttgacacacttaaaggagcttacaaacaaaaggcgtaggttaggttaaaacttgagcaatatctgtgatggttcacagaatcctcctaaggaaaaggttaaagcagtggtctccaacctttatggcaccagggaccggttttgtggaagacaatttttctatagactggggaagaggtgggggggatggtttcaggataaaactgttccacctcagatcatcaggcatagactctcataargagtgtgcaacctagatcccttgcatgtgcagttcatagggttcacactcctatgacaatcgaatgctgcttctgatctgataggaggcagagctcaggcagtaatgcttgcttgcccaccactcacctcttgtgcggcccagttcctaacaggccacggtccggtactggccctggggttggggacccctgggttaaaggattcagtccaagatctgaaaaaaaagggtacagccaggtagcttgggaagcactctaaattttcagaagtctgtagcagaatctcaaagcttcaggttt

SEQ ID NO: 121583 - DNA, 601 bp, Human
ctattaatgatttatcaaattatcattaaaaaaaattctagcccaggagcggtggctcatgcctctaatcctagcactttggaaggccgaggtaggaggatcacttgagacctggagttcaagaccagcctggggaacatagtgagaccctgtgtctataaaaaatttaaaggccaggtgcggtggctcacgcctgtaatcccagtactttgggaggcaaaggcgggtgggtcacaaggttaggagttcgagaccagcctgaccaacatggtgaaaccctgtctctactaaaaatacaaawattagccaggcatggtggtgtgcacctgtaatcccagctactcaggaggctgaggccggagaatcactcgaacccaggaggtggaggttgcagtgagctgagattatgccactgcactccagcctaggtgacagagtgagactccatctcaaaaaaaaaaaaaaaaaaaattaaaaattagctgggcatggtggtacatacctgtagttccaactacttgggaggctaagggggaaggatcccttgagcccgggaggtcaaggctgcagtgagggccatgatcatgtcattgcactccag

SEQ ID NO: 121584 - DNA, 601 bp, Human
agacctgagctggcagagcccagtaatctacttatgtttgcttaaagcaatttgttggatccttaacacctgttgagttgagcgctgaaaagttaatttgcagtgcctatctgggctgtatttccccaggctttccttttccttctcgccctcccttcctttcttcctatccttcccttcccttttctcccttctaaaatttttattgagtgttttggcagtcaggatctgtactaagcactgggaatccattggtggccaaaataggccaggcccctaccctcatggtgctttctgtctrgtgagggggccattaatctaatcacattcactaatgggtgtaggattacaaattgcagtaggcaccacttaggcctacagtacagtgagggatctggcctagtctggggttaggaagaggacagctttttggactgtgagaggaagaatgagtgggtaataaggcagcagaaacagcacgtgcaaaggccctgagttgctgggaattgtggtactctggagacaatgaaagatactgtggctggaccagacaaaacaaagacaggggatgggggatgcctctggtgagctcagcagagtc

SEQ ID NO: 121585 - DNA, 601 bp, Human
gtgagctgagatcgcaccgctgaactccagcctgggtgacagagcgagacgccgtcttaaaaaaaaaaaaaaaagaaaaagaaaaaagatctaaagaggggtttccttagcagctattttctcaaagaacaggaagggtgctaccctttgctgagttcccacaatatcctgagcactgtattgtgtaatccccacaacaaccagggtaggtaggtaggtaagaaggtgttagtgaccccattttagatgaggaaattgaaacttgtttggttatcttccattccccaaggtcacacagctrgcacatggtagggcctaaactgagcaaatgtctgactccaaagcctgtgttcctccctctttactcctttaacgcctcagctgaaaacccctttcagcagttcccctgggtggctctttgtacacttcgcagaattacagagcttcatcttaggttcaagtcttttatgattccatttagagaagggcttccccacctgagggctggaggtccctttaggctgcagttattcatgaggttcaggggatttcccataggttctagcggtgttttatgccctggaaaaatgcatcatttgtt

SEQ ID NO: 121586 - DNA, 601 bp, Human
ctgaactccagcctgggtgacagagcgagacgccgtcttaaaaaaaaaaaaaaaagaaaaagaaaaaagatctaaagaggggtttccttagcagctattttctcaaagaacaggaagggtgctaccctttgctgagttcccacaatatcctgagcactgtattgtgtaatccccacaacaaccagggtaggtaggtaggtaagaaggtgttagtgaccccattttagatgaggaaattgaaacttgtttggttatcttccattccccaaggtcacacagctggcacatggtagggcctaarctgagcaaatgtctgactccaaagcctgtgttcctccctctttactcctttaacgcctcagctgaaaacccctttcagcagttcccctgggtggctctttgtacacttcgcagaattacagagcttcatcttaggttcaagtcttttatgattccatttagagaagggcttccccacctgagggctggaggtccctttaggctgcagttattcatgaggttcaggggatttcccataggttctagcggtgttttatgccctggaaaaatgcatcatttgttttgcccatatttttttctt

SEQ ID NO: 121587 - DNA, 601 bp, Human
ctttactcctttaacgcctcagctgaaaacccctttcagcagttcccctgggtggctctttgtacacttcgcagaattacagagcttcatcttaggttcaagtcttttatgattccatttagagaagggcttccccacctgagggctggaggtccctttaggctgcagttattcatgaggttcaggggatttcccataggttctagcggtgttttatgccctggaaaaatgcatcatttgttttgcccatatttttttctttttcaaatacgtggagtgatgttgctgtgatgaatgaacwacaaatccatacaaaagtgttacttgaatcctcatagctctttgccattatgcactgtctttatcaaaagacactaaccttacaatgtctaatgagcagtgatctgaaaagcacttatgatattaacaagagatcctgaccgggcacagtggctcacacctgtaatcccagcactttggaaggccgaggtgggtggatcacttgtggtcaggagttcgagaccagcctggctaacatgatgaaaccccatctccctactaaaaatacaaaaatgggctgggcgcagtggctcacacctgt

SEQ ID NO: 121588 - DNA, 601 bp, Human
gcactccagcctggcgacagagggagacttcatctcaaaaaaaaaaaaaaagaaaagaaaaattagctgggcatggtgggtgcctgtagccccagctactcaggagactgaggcaggagaattgcatgaacccaggaggcggaggttgcagtaagctgagatcgcgccactgcattccagcctggagaatagagcgatatactccaactcaaaaaaaaaaaaaaaaaaaagagagctcctaccatgtggtgcagtgggcctcaccactcacaggccaggttccaacagaccagttgtgggsgacatgggaggaggagggggaggatttctcaggtcccttccacagttggcccagcataatgcagcacggcggtgacctgacagtgggcacaggcctggatgttggtgtacttttccataggttcaagtgcccctgagcagtcaatcgggcaaccattattttctcagggggcctttgagagtatttccacacatttagaatagactctgaaaactctgtttcagagagatttttgattcagcagaaatagcagaaaaaatactcacatggtcataggtcagcatctttaccataaatatt

SEQ ID NO: 121589 - DNA, 601 bp, Human
ggaggcggaggttgcagtaagctgagatcgcgccactgcattccagcctggagaatagagcgatatactccaactcaaaaaaaaaaaaaaaaaaaagagagctcctaccatgtggtgcagtgggcctcaccactcacaggccaggttccaacagaccagttgtgggggacatgggaggaggagggggaggatttctcaggtcccttccacagttggcccagcataatgcagcacggcggtgacctgacagtgggcacaggcctggatgttggtgtacttttccataggttcaagtgccccygagcagtcaatcgggcaaccattattttctcagggggcctttgagagtatttccacacatttagaatagactctgaaaactctgtttcagagagatttttgattcagcagaaatagcagaaaaaatactcacatggtcataggtcagcatctttaccataaatattttactaagaagaacagtgataataataggctatgtctacacaggactttctggtttatggagtgtgttcacacatacgatcctcagaatgaccgtgcgcagcatttttatggatgtgagaaacagggtcatgaa

SEQ ID NO: 121590 - DNA, 601 bp, Human
aatagcagaaaaaatactcacatggtcataggtcagcatctttaccataaatattttactaagaagaacagtgataataataggctatgtctacacaggactttctggtttatggagtgtgttcacacatacgatcctcagaatgaccgtgcgcagcatttttatggatgtgagaaacagggtcatgaaagtcacacagctagaaagtcgtggagcctgatttagaaccagggtctttgatgcctgtttgaacacgccatggtgctctccccccaggagacagcttacagaaacccactayatccttccccatgatgtggaagcagaggcctgagtgatacaaaaacataaatctcacagtggtttgttttttgttatccctatttgatttcaggatacaacaggggttttaaacacagcaggagtagaggtttccatcactaatgatgtttggctcagggctagatttcatccctgaacgctggctggggggtaagggaggtatcttctaggtgttgagggagaaggaaaatcaacctggggttttaagttaaccataacaaggccacaagagtggaaatggtaagaatcaaaaagaaga

SEQ ID NO: 121591 - DNA, 601 bp, Human
ggtggtctctatgcctctaaaatgtgccccatctctggtccaccccctacactgctgctagaggaggctttcggaaaaaaacccaactgaccgtgacactttccctgtctttggcacatcattgctttccaggacaagttcaattctttagtatgtctcttaagactggttacctttctggcctactcacaaactccctccctccccgcagccatgccagcccacatgtggttgtcttggatgtgccgagttcctccatgtctttgcagaaattgttccctctggctgggtgtctcttccscagtctcttcggctgggcattcatgatgggcattcatggcaatcatattgccgtctttgtggcattcctgaaagtaccaccttgagtcctccaggaccttattaggtgccactccctgggtttcctctctcagtagcatttctcacaccctgttatcatcaccaactttcctgtctgacgcgcacggagaccctaagctccctgaaggcaaagatgaagtccagtatcctcaggtcacagcacttggcacctatcagaaagaggagctaccttctcctgaacacgtgttgtatgccaggc

SEQ ID NO: 121592 - DNA, 601 bp, Human; identical to SEQ ID NO: 17792

SEQ ID NO: 121593 - DNA, 601 bp, Human; identical to SEQ ID NO: 17793

SEQ ID NO: 121594 - DNA, 601 bp, Human; identical to SEQ ID NO: 17794

SEQ ID NO: 121595 - DNA, 601 bp, Human; identical to SEQ ID NO: 17795

SEQ ID NO: 121596 - DNA, 601 bp, Human; identical to SEQ ID NO: 17796

SEQ ID NO: 121597 - DNA, 481 bp, Human
gccgcccaggaaaggatgccatggggactcctgggtccccaggttgtgctggttcaccaggtcttccaggatcaccgggacctccaggaccgccaggtaaagatgtggaaggggaccccttttgtgcacagtgccaaatgacagatgtgtgcaaaccacgggcaacaaaccctcctcacagcttagccatcagtctgtgtggtttttatgagttacctttccaatggtcttcatttcactaactgtctgtgaaagaaactgatgcaatgactagttaacaaatgcagcaaagtcttagccygagtttcccagagagcagagtaggaggcagggacaaagagagtgatgtggggaaggatgggtggctatcaagttggccttgaccaattgcaactgcctgttcagccctggagactatctgtgccaggggagaaagaggcaagaatttatccatttgctcctagttcccatgggtcaaaga

SEQ ID NO: 121598 - DNA, 601 bp, Human
ttccaagtctcttttaagatggaggtttagtatcctctttttttctatgtcaaggctgacatacagagttcacagggctaatgaagctaaagctgggatctgggcccaggtgcttgcggctctctcccgaaggtgtcatgctccctctgtgcctgctacactctgtccaggggtctttgcttcctactttcccttcgctaagcaacacccatctgtccttcagacttcagcttcaagttcaagtccagcagaaagctttcagtgagtccacatcctgtaacctccaaggttatcccaactrtagaagttttcacattgccttctctttgtatttgtcagtttttcttacaagaatcaaagtattttgaggtcaaagactgtgtctttttggctgtttaagcccagtatgtagcatggggaacactgcaggtactcagatattttttgaattaagcattaattgagtatgaaaatgtataagtatacaaaaatgtatgaatgtagaagtattcatataagtctacactaagtattaaacttttatcagattgtactatttaaagatgaccttccaggtattttaaagatgcagaaaactgat

SEQ ID NO: 121599 - DNA, 601 bp, Human
tatcctctttttttctatgtcaaggctgacatacagagttcacagggctaatgaagctaaagctgggatctgggcccaggtgcttgcggctctctcccgaaggtgtcatgctccctctgtgcctgctacactctgtccaggggtctttgcttcctactttcccttcgctaagcaacacccatctgtccttcagacttcagcttcaagttcaagtccagcagaaagctttcagtgagtccacatcctgtaacctccaaggttatcccaactatagaagttttcacattgccttctctttgtmtttgtcagtttttcttacaagaatcaaagtattttgaggtcaaagactgtgtctttttggctgtttaagcccagtatgtagcatggggaacactgcaggtactcagatattttttgaattaagcattaattgagtatgaaaatgtataagtatacaaaaatgtatgaatgtagaagtattcatataagtctacactaagtattaaacttttatcagattgtactatttaaagatgaccttccaggtattttaaagatgcagaaaactgatcacaagatggtcattctgtgttccaacaaa

SEQ ID NO: 121600 - DNA, 601 bp, Human
agtattttgaggtcaaagactgtgtctttttggctgtttaagcccagtatgtagcatggggaacactgcaggtactcagatattttttgaattaagcattaattgagtatgaaaatgtataagtatacaaaaatgtatgaatgtagaagtattcatataagtctacactaagtattaaacttttatcagattgtactatttaaagatgaccttccaggtattttaaagatgcagaaaactgatcacaagatggtcattctgtgttccaacaaaattaaatggttccagtggtaccttgttyttctgaaatttgggacagctatggtagtgtttttaaatatttactttcatcaccattgccttcaacctgtaattgaaatggcaaagccaaaaattagattactgaacacaattaaccagtttaagagaaggagctgttcattgcaacattacagtagcagataatgtggaagctgagaagagctttcttagagacctgctttaaggatgacaactcaattgatgtggacaagcaacaaagagaaaacagatgataccctgagtcagaatccatttttcttttactcaatatatattaagc

SEQ ID NO: 121601 - DNA, 601 bp, Human
tggcaaaagcagaagcaaacatgtccttcttcacatgatggcaacatggagaagtgctgagcaaaatggggaaaagcccattataaaaccatcagatctcataagcactcattcactattacaagaacagcatgagggtaactgcccccatgattaaattacctcccaccaggtccctttcatgacacatggggattatagaactacaattcaagatgagatttgggacacagccaaaccatatcaacttggaataattggaaacaactaagtaagataaaataggttgattctgtgaccaaaaaaaaaattatacaatgagctttcaaagatcaactaccttaaaaataccacatctatgtaatatgaagggaagagctggtcaccatgctttctcagttgcagataaacttctaaagactaggcttccaatacaaagatgagagagatgcattttaaataatacatatattacaatacttgctaattgaaaaaaacacaaataaaaaattgtctttggtgctgtatttttataggtgacatcgtttttcgcaagggtccacctggagatcgcggactgccaggctatctagggtctcca

SEQ ID NO: 121602 - DNA, 601 bp, Human; identical to SEQ ID NO: 17797

SEQ ID NO: 121603 - DNA, 601 bp, Human; identical to SEQ ID NO: 17798

SEQ ID NO: 121604 - DNA, 601 bp, Human; identical to SEQ ID NO: 17799

SEQ ID NO: 121605 - DNA, 601 bp, Human; identical to SEQ ID NO: 17800

SEQ ID NO: 121606 - DNA, 601 bp, Human; identical to SEQ ID NO: 17801

SEQ ID NO: 121607 - DNA, 601 bp, Human; identical to SEQ ID NO: 17802

SEQ ID NO: 121608 - DNA, 601 bp, Human; identical to SEQ ID NO: 17803

SEQ ID NO: 121609 - DNA, 601 bp, Human; identical to SEQ ID NO: 17804

SEQ ID NO: 121610 - DNA, 601 bp, Human; identical to SEQ ID NO: 17805

SEQ ID NO: 121611 - DNA, 601 bp, Human
atttcagaactcagtgctgaaaacaccaaactgctgaaagaggtggccacagtacaaccattttgatgagaagttgaacagggtgaccatgcctctttggagaaataatcccctaggtctggaggcggcccaggatcctgaaggtgagtaccagtgctggtggaaaataaggagcattcaaagtgcattaagacccactccggggtctttaacttgttaacatggaaaacaatagcaaagtactgctggggccccctgctgtgtgtatagaatataccggaagactaagacatggagatascagctgggagctaccgcagagattcagacttgaggtgaagggctggccttaggggggcacgtgggtgtgtaggaagaactgctcagcaggccttagggatacatttgttgtgcaggtgcagagaggacacaggcatggctggggcgggagttcaggatgagaaccctgggacaggctgtaagatgatcgagccaggtgtgtgtgtgtgtgtgtgtgtgtgtgtgtgtgtgtgtgtgtgtgtgtgtagaggtataatgacatactgtaaaatgcaagatatgaagtgtagaatgagttttg

SEQ ID NO: 121612 - DNA, 601 bp, Human; identical to SEQ ID NO: 40564

SEQ ID NO: 121613 - DNA, 601 bp, Human
gcccggtggtccgcctctcaggacagaggtgcaacatttgggagtttatgcaaggtcaggaggctgccacacacttgaggggtgcttgaaatagcagtggtagagggggatgaagagatgggttggaaagtcctgaattctcctactacttttgctgctccttttggaccttcttgtcctcttcctgcttcctgaaactagaacttcttgtggattgtttctctaagtaacatcaccaccttcccaggcactcaaatcacaaaccatccagtctggcatttcagcccctggaacactgctsttactgtacaggctgatctgcctgggctgctctttgcccacctctctgcctggttaactcttgttcaatcttcagactgttgctcaatgacgcttctttcgagaagccaagcccaactctcccatactaggctaccctctctcatctgcctgcttaacatcctaaacttttctttattacacctgtcgcggtttgtaattatgtacggctggctaggattcatgtctgcttccctcactagtctgcaaactcaatgcaggtcgagaccattgctctcacccactattacacccatgcctg

SEQ ID NO: 121614 - DNA, 601 bp, Human
ggtttgtaattatgtacggctggctaggattcatgtctgcttccctcactagtctgcaaactcaatgcaggtcgagaccattgctctcacccactattacacccatgcctgatggtggcacatggtagctgctcagtaaatacttgttaaagagctctcggctgggcgtgatggttcacgcctgtaatcccggcactttgggagattgaggctggcagatcacgaggtcaggagttcgagaccatcctggccaacatgatgaaaccccgtctctactaaaaatacaaaaattagccaggcktggtggtgtgcacctgtaatcccagctactcgggaggctgaggcagaagaatctcttgaaccccggtggcggagattgcagtgagtcaagattgtgccactgcattccagcctgggcaacagagtgagacgctgtcacaaattaaaaaaagtctcagttttctctctctaactccatccactccccagtccaggaaaaccagtttcgtcgacttgagttcttgaccgttccagttttctcttttttgtcctcccagcttctcttcctgccagaacttccttctccccgacttgcccactc

SEQ ID NO: 121615 - DNA, 601 bp, Human
tgcaggtcgagaccattgctctcacccactattacacccatgcctgatggtggcacatggtagctgctcagtaaatacttgttaaagagctctcggctgggcgtgatggttcacgcctgtaatcccggcactttgggagattgaggctggcagatcacgaggtcaggagttcgagaccatcctggccaacatgatgaaaccccgtctctactaaaaatacaaaaattagccaggcgtggtggtgtgcacctgtaatcccagctactcgggaggctgaggcagaagaatctcttgaaccccrgtggcggagattgcagtgagtcaagattgtgccactgcattccagcctgggcaacagagtgagacgctgtcacaaattaaaaaaagtctcagttttctctctctaactccatccactccccagtccaggaaaaccagtttcgtcgacttgagttcttgaccgttccagttttctcttttttgtcctcccagcttctcttcctgccagaacttccttctccccgacttgcccactcagccagcccagcttgtgaatggctgccagattgctcttctctgagtacataccagctcaaccact

SEQ ID NO: 121616 - DNA, 601 bp, Human
tgttaaagagctctcggctgggcgtgatggttcacgcctgtaatcccggcactttgggagattgaggctggcagatcacgaggtcaggagttcgagaccatcctggccaacatgatgaaaccccgtctctactaaaaatacaaaaattagccaggcgtggtggtgtgcacctgtaatcccagctactcgggaggctgaggcagaagaatctcttgaaccccggtggcggagattgcagtgagtcaagattgtgccactgcattccagcctgggcaacagagtgagacgctgtcacaaattaaaaaaagtctcagttttctctctctaactccatccactccccagtccaggaaaaccagtttcgtcgacttgagttcttgaccgttccagttttctcttttttgtcctcccagcttctcttcctgccagaacttccttctccccgacttgcccactcagccagcccagcttgtgaatggctgccagattgctcttctctgagtacataccagctcaaccactttcagcagctcccctctgcatttaggatgaagcccaggctcagccttggattccaggtcctccctggtcaggctccagc

SEQ ID NO: 121617 - DNA, 601 bp, Human
tacaaaaattagccaggcgtggtggtgtgcacctgtaatcccagctactcgggaggctgaggcagaagaatctcttgaaccccggtggcggagattgcagtgagtcaagattgtgccactgcattccagcctgggcaacagagtgagacgctgtcacaaattaaaaaaagtctcagttttctctctctaactccatccactccccagtccaggaaaaccagtttcgtcgacttgagttcttgaccgttccagttttctcttttttgtcctcccagcttctcttcctgccagaacttccttytccccgacttgcccactcagccagcccagcttgtgaatggctgccagattgctcttctctgagtacataccagctcaaccactttcagcagctcccctctgcatttaggatgaagcccaggctcagccttggattccaggtcctccctggtcaggctccagcttttcttctcaattctacctctgagctccccgccacactcatttctttcggacaaactgttgggccttgtacatctcttgtactttcccttgtctttgcctttgctgacatcggctggtcaagaatgcccttcccctc

SEQ ID NO: 121618 - DNA, 601 bp, Human; identical to SEQ ID NO: 25846

SEQ ID NO: 121619 - DNA, 601 bp, Human
ggaaactgagacccagaaaggttgaataacttcctcaaagtcacacagccactaaatggcagaatcaacattagaatcttggttgttttgatgccaaaacctcttaaccccagattaaagtgcctctcaattgagttttcacatcacaatgcaacccttcacatacggagctaatattgcctctaattcatttatacataccagccttttctttttaccagattaaaagaaggcagtcaccacgtatacaaaagcagctcagcatggtctcacatacagtgactaattttgttctcttctmtgcccccatagtgcctcagtcagtgacgaaagggtttgatattcaaaagcagaaattaaaggacttatctgaaggcagaacatatttgtgtaccttaacccaggcagtaaaggagggctatattgttcagtattgtattgagaggtgaattgaaggatgggggttcaggtcaacacattgctttgtggctggtctagaaccccaggctcagtattaatattagcctaataaacataatgataactcccttttttggagcccttgatgtgtcaggcactgttctaagcactgaatttacag

SEQ ID NO: 121620 - DNA, 601 bp, Human
aaacagtcataaaatgtacaacaaagatggaagagaccttaaagatcatccaatctgattttctgatcttacaaatgaagcaactgtggtgtgggggcatgaaatagtttgtccaaacctgacaaaaacaagcaacagggaaaggattccctatttaataaatggtgctgggaaaactggctagccatatgtagaaagctgaaactggatcccttccttacaccttacaaaaaaattaactcaagatggattaaagacttaaatgtaagacttaaaaccataaaaaccctagaagaaaacmtaggcaacaccattcaggacataggcataggcaaagacttcatgactaaaacaccaaaagcaatgacaacaaaagccaaaatagacaaatgggatctaattaaactaaagagcttcttcacagcaaaagaaactatcattagagtgaacaggcaacctacagaatgggagaaaatttttgcaatctatccatctgacaaaaggactaatatccagaatttacaaagaacttaaacaaatttacaagaaaaaaacaaacaaccccatcaaaaagtgggcaaaggatatgaacagacatgtc

SEQ ID NO: 121621 - DNA, 601 bp, Human
aaaatgtacaacaaagatggaagagaccttaaagatcatccaatctgattttctgatcttacaaatgaagcaactgtggtgtgggggcatgaaatagtttgtccaaacctgacaaaaacaagcaacagggaaaggattccctatttaataaatggtgctgggaaaactggctagccatatgtagaaagctgaaactggatcccttccttacaccttacaaaaaaattaactcaagatggattaaagacttaaatgtaagacttaaaaccataaaaaccctagaagaaaacctaggcaacascattcaggacataggcataggcaaagacttcatgactaaaacaccaaaagcaatgacaacaaaagccaaaatagacaaatgggatctaattaaactaaagagcttcttcacagcaaaagaaactatcattagagtgaacaggcaacctacagaatgggagaaaatttttgcaatctatccatctgacaaaaggactaatatccagaatttacaaagaacttaaacaaatttacaagaaaaaaacaaacaaccccatcaaaaagtgggcaaaggatatgaacagacatgtctcaaaagaag

SEQ ID NO: 121622 - DNA, 601 bp, Human
gcaatctatccatctgacaaaaggactaatatccagaatttacaaagaacttaaacaaatttacaagaaaaaaacaaacaaccccatcaaaaagtgggcaaaggatatgaacagacatgtctcaaaagaagacatttatgtagccaacaggcatatgaaaaaaatgctcatcactggtcatcagagaaatgcaaatcaaaaccacagggagataccatcccatgccagttagaatggtgatcattaaaaagtcaggaaacaacagatgctggagaggatgtggaaaaataggaatgctttyacactgttggtgggagtgtaaattagttcaaccattgtggaagacaatgtagcgattcctcagggatctagaactagaaataccatttgacccagccatcccattactgggtatatacccaaaggattataaatcatgctactataaagacacatgcacacgtatgtttattgtgtcactattcacaatagcaaagacttggaaccaacccaaatgtccatcaatgatagactggataaagaaaatgtggcacatatacaccattgaatactatgcagccataaaaaaaggatgaactca

SEQ ID NO: 121623 - DNA, 601 bp, Human
gcaaaggatatgaacagacatgtctcaaaagaagacatttatgtagccaacaggcatatgaaaaaaatgctcatcactggtcatcagagaaatgcaaatcaaaaccacagggagataccatcccatgccagttagaatggtgatcattaaaaagtcaggaaacaacagatgctggagaggatgtggaaaaataggaatgctttcacactgttggtgggagtgtaaattagttcaaccattgtggaagacaatgtagcgattcctcagggatctagaactagaaataccatttgacccagcmatcccattactgggtatatacccaaaggattataaatcatgctactataaagacacatgcacacgtatgtttattgtgtcactattcacaatagcaaagacttggaaccaacccaaatgtccatcaatgatagactggataaagaaaatgtggcacatatacaccattgaatactatgcagccataaaaaaaggatgaactcatgccctttgcagggacatggatgaagctggaaatcatcattctcagcaaactgtcacaaggacagaaaaccaaacatcacatgttctcactcataag

SEQ ID NO: 121624 - DNA, 601 bp, Human
cctgttgtgggagggctcggggagggatagcgttgggagaaatacttaatgtaaatgatgagttgatgggtgcagcaaaccaacatggcacatgtatacctatgtaacaaacctgcacgttgtgcacatgtaccctagaacttaaagtataataataattttaaaaataataataaattttaaaaaaaataaaagccactatactttaaaaaaaaagagttggtgtgataaataagtgagataatacatatcaagtactccatgtaaatatacccatctatggtaaacaataaatagtatwataattgtttaaaaaaaaaaaaaagtttgtccgtagtgaattagtagcattggcagactcaaatccaagtttcctggcaatccctcttcctatagatagaaagaggaccacccatccaggaagaaataaggagggcagggaatctcagaggtccttcccagcccaagccctgaacaatgccttcattgacacctctcacctttcactcatcctgcctgacccttattccatcagccatcccagcgctggctgcagaataagatctcacctgacaagcctctaaagttcagacctcacctg

SEQ ID NO: 121625 - DNA, 601 bp, Human
cacaactcggaagggccggcccagcactggtgcaggcttccccagggctgcccggttctggccagaactctgaagtgtagcagtacgtgccctggaggatctaaaatccatctcaagttctcaaagcaaacagaagatgtgtttggtggttctgttggccagagtacactagcaccagctggaactgagacagacacccagcaaccctgtcccgttctccactgggccaagggaagccacaagccctgccccactctcaagggctcagacctggatatggaaagcactcgggggtagtgasagagaatccaaggtctcttgagggtaagtggggacaccaccgccaccaccgccacgggtgggaaggagaaagaagggctgctgtttccccaggaggctgcaccctgccctggggaggaggcagctccccagagatgacacttgaggacttggcttggcaccacgaaagcataccgctcagggttttgtttcccctttataaatggaggcaggcgaggaaaggaattctttggctgagtaacataatacttctgggtccagcccaccaggcttggccctgggaagagcaaacaagctgcct

SEQ ID NO: 121626 - DNA, 601 bp, Human
aggcctgaggggtccaggcagacatgggtgcagaccgtacctgaccttgctggcccaggggcaggcggctagcccagcccctcccccggcaggtgccccttcaccttcccgcgcctgcccctccagtccacacacccaggcaaggcgccctcgagcgagcgccgtttgttttgctgagagtttccgttggctcgcgtgtgggtgtttgttgtatttctccggcagatggcagacagcatgccctccccaccatcaccccgccccaccatcaccctgccctggggctgtgtggcaagcagaygctgcagggcagaacaaaagcctagcaggtgaacagccctgtctgcggagacttttatccaacccaagtcgcagacaatatctttataaaattcctttcaactccctcatcatctggaactcttcctgcctggctcccaacctgctgcagcccccagcagcccccaccctcagaagaacatctgctcctctgacagggcacaggacacggtgttccaaagagcaattttttctttggcttccatccactacaccccctcagagcccagagaccccctgctcccagaagcttcctgcaaaa

SEQ ID NO: 121627 - DNA, 601 bp, Human
ggcctgaggggtccaggcagacatgggtgcagaccgtacctgaccttgctggcccaggggcaggcggctagcccagcccctcccccggcaggtgccccttcaccttcccgcgcctgcccctccagtccacacacccaggcaaggcgccctcgagcgagcgccgtttgttttgctgagagtttccgttggctcgcgtgtgggtgtttgttgtatttctccggcagatggcagacagcatgccctccccaccatcaccccgccccaccatcaccctgccctggggctgtgtggcaagcagacrctgcagggcagaacaaaagcctagcaggtgaacagccctgtctgcggagacttttatccaacccaagtcgcagacaatatctttataaaattcctttcaactccctcatcatctggaactcttcctgcctggctcccaacctgctgcagcccccagcagcccccaccctcagaagaacatctgctcctctgacagggcacaggacacggtgttccaaagagcaattttttctttggcttccatccactacaccccctcagagcccagagaccccctgctcccagaagcttcctgcaaaac

SEQ ID NO: 121628 - DNA, 601 bp, Human
cagaacaaaagcctagcaggtgaacagccctgtctgcggagacttttatccaacccaagtcgcagacaatatctttataaaattcctttcaactccctcatcatctggaactcttcctgcctggctcccaacctgctgcagcccccagcagcccccaccctcagaagaacatctgctcctctgacagggcacaggacacggtgttccaaagagcaattttttctttggcttccatccactacaccccctcagagcccagagaccccctgctcccagaagcttcctgcaaaacgggaggagygtattgatctgtggaatggaggagatcattctcctcctccagtgctcagaactcctcagcaaaaatgaccctcagtttttaccacccctgaaaaaccccagatgagtccagggactcctgccaggaactgggttgggggatgagggggatgctggaaagggatggagtttctcaatttctaaagctattgtttctcattcccaaatcaccatgctccaatctgggcccaagagctgtgctcaacttgaggactggtgtggctccctctgcaagaaggttaggccaatgccagtgaaccag

SEQ ID NO: 121629 - DNA, 601 bp, Human
cctgaaaaaccccagatgagtccagggactcctgccaggaactgggttgggggatgagggggatgctggaaagggatggagtttctcaatttctaaagctattgtttctcattcccaaatcaccatgctccaatctgggcccaagagctgtgctcaacttgaggactggtgtggctccctctgcaagaaggttaggccaatgccagtgaaccagccactgaaggctggaggggccggagagcctctgagcatcctcaccgccttgcctgaggctagagctacaacagcgagtgcctagacycccacctgtatccccattgcatccccaccactacccagcagctcaggagcaggctcttccctccactcctaggcgacactctgcagtttccatcctggggtctcttacttgcttctgctactctgcccagtttctcgtgttgatagcttagctactcagccttcctgggttttcttttcagccctggtcatatctttaatgatctctatcctcaacatgtctaatagcccaaggaccaagctcattccactctcatcctcaacccagatctgcaggaccccagccaggcccatagccccc

SEQ ID NO: 121630 - DNA, 601 bp, Human
attgtttctcattcccaaatcaccatgctccaatctgggcccaagagctgtgctcaacttgaggactggtgtggctccctctgcaagaaggttaggccaatgccagtgaaccagccactgaaggctggaggggccggagagcctctgagcatcctcaccgccttgcctgaggctagagctacaacagcgagtgcctagacccccacctgtatccccattgcatccccaccactacccagcagctcaggagcaggctcttccctccactcctaggcgacactctgcagtttccatcctgggrtctcttacttgcttctgctactctgcccagtttctcgtgttgatagcttagctactcagccttcctgggttttcttttcagccctggtcatatctttaatgatctctatcctcaacatgtctaatagcccaaggaccaagctcattccactctcatcctcaacccagatctgcaggaccccagccaggcccatagccccccaagcagaggggaactgacagctatgactctgactatactagacaacattctacacccaccaggaagtagagccttggagatgtccaagctgaccctgtt

SEQ ID NO: 121631 - DNA, 601 bp, Human
agacagggggaatgccccagacttgtcccatccagcccttgcagaatggcaccagcaacaagcacctgctgtagagaagggttgtcactatgttgcagctctgagactctacagaagtcagaggtgggtcatggagatgaggggacaaggagagtgaggaggggataggtgactatctgccacaccacttaggtactgagtcacatcaacatgtatgcaatacctggtcagacaggcacccgcagacccatctggcccagaccagctgcactttcccaggcttaggctgggagtggcagtyatctggcagagtcttggttcctggagtgagggcacaaggtcacacaggccagggccagagaccgctctcttttctttttttttttttcacaaatacatttcaaatgttattatgaaatatgcaagccatacaaaaaggaatgaagaatacaataataaacacccatgtacccacaacctaacttaagaaataaaatattagcaaagaaaatctcataatgtaatatctcagggctctggggagtaggggagagaacagggtctgctcatgttcccacaggaaggaaggagtattgagaag

SEQ ID NO: 121632 - DNA, 601 bp, Human
tgcatgtgaattcttcctttgctgaatgtctcaagtctctttttttattgaaatgatagcaccagccagacccttaccagaacaggctggtctccccctgactcctcccctgccctgtttattgctcatttccccgcccctgcccttgtcttctggcccatttccaaaagggtcacagccaaaaacctgggcatggttcaccacaacgaagtattaaccaaccaacatgaaccagcactcctccctccccctccccgcccccagcccagtgacagtcggtacccctgcctcccgggccacsgagactttggagagccaatgggctgtgtccagtgggaacacaggagctgcaaggacggagccactggaatcaggaggggctatgtttgaccaaggctcagtggaatgaccactgtgcccacgaggtaggagaatgcccatctattatgtccttggccttcctgcccctccaccctcccattcaaatgtccaccattccagccactgggctcattccattgcccctctctggaaatatagaggtcagtactttgcactctcaggcagttcctagaagcagctggagagaatgaggaagagc

SEQ ID NO: 121633 - DNA, 601 bp, Human
tgaagaggtctggctggccaggactcctgggggagattgtgctgctcctggggctttgagtaaagccagacaagcgacatcttaaccactccacaagaccacctctccaatcccctataagtgggtcttccattcctgtttatgataagcattctaatagttgctaagatgcaaaggtgacaaaggtgcagtttcaagcctccagggcttgaaacaaatacatgtcagcaaatataatggagctagctaaagcatgtccagggtgcacaccaaggcaggagttgactgttctccctggagrgggtggaggtcaggacagactttccggaagagttgatccctgaatgaggtttgaaacaggagaattattaatataatgtggtccctgtactaccagagggttggtaagttgaggagggggtacgcagtggggaggaggaacagagatgagaaggggagtattgtgagcacagcaagcacataggcatgaaacaacacacatctcctctggtgaccaaacggggtttcccatgactggagctgaggtgtgaggacaaggataaggctggaactgggagggagactaaaatgggatggcctc

SEQ ID NO: 121634 - DNA, 601 bp, Human
ctgggggagattgtgctgctcctggggctttgagtaaagccagacaagcgacatcttaaccactccacaagaccacctctccaatcccctataagtgggtcttccattcctgtttatgataagcattctaatagttgctaagatgcaaaggtgacaaaggtgcagtttcaagcctccagggcttgaaacaaatacatgtcagcaaatataatggagctagctaaagcatgtccagggtgcacaccaaggcaggagttgactgttctccctggagagggtggaggtcaggacagactttccrgaagagttgatccctgaatgaggtttgaaacaggagaattattaatataatgtggtccctgtactaccagagggttggtaagttgaggagggggtacgcagtggggaggaggaacagagatgagaaggggagtattgtgagcacagcaagcacataggcatgaaacaacacacatctcctctggtgaccaaacggggtttcccatgactggagctgaggtgtgaggacaaggataaggctggaactgggagggagactaaaatgggatggcctccaggccctgctaagaagtttggactc

SEQ ID NO: 121635 - DNA, 601 bp, Human
taaggagaggccgatctcaccaagactctgacgcccccagggttgaggggggtcctggtgagtgacaggtgggctagaatcccagaggcacccccaaatccaactagccagctcctgcttcttttttccatcttccaagattgctcaattctcaattcctcttcattcatccactgatttgctcaaaaaatcttttctgagtggtactgtatgtcataacactgccgggcactaggcataggcaatatagagcaggaaagagacatctaaacacactttccaaaagaaacatagtataacygtgtacaaagcagccaagttacacagtgaccagtactatctagaggagcaagttgcagaaggtatttattgtatgtcacgctgaagggttccccttctatccttgctactcacagcatggtcctcagacagccacactgggatttgtttgtgctcctagaactttaatgtagatatgaatttcctggggatcttctgcttcagtaggtcttggatgaggcctgagattctgcatttctaacaaattcctcagtagcactgatgctccttacccaagaactacactttcagtagcaagact

SEQ ID NO: 121636 - DNA, 370 bp, Human
agcaggcagggttgtctctgacccaggctgctgaggcagctgcctgggctgcagaagagaaggccagccrgaggaggcacctggcaggcgagtacgcagccagccttcgtcaccaactcaagctccttcgccaaaacctcctcgggaggcaggagcagtgggcctctttctgctccacgctgagggaggttcagcagcagctgaaagcacagatgggctccaggtcagagaaatcctctccggctgggcagaacccagaaaagtgtggatctggccaacctggatcagacttagggagacatgaaatggggaggagagaatgtggctgcagggggtcccggaactggccaaaacaaaacgtccttttccc

SEQ ID NO: 121637 - DNA, 601 bp, Human
ctgggaatcccgtagcccccctgtaggctgttgccaccatttcccgaggcttttccagtctctgccggcctgcgcaatgatatcacaatggcacgtggaatactgctctggagttagcaaagatgagacccctgccccctcaggagcacaatgtctgtggaggctggggaggagttctcaccagctccttccagtcaccagccaagggagtccccgcatgttccctctcccaccggcccccagcccagggctaagcaggcaatgattgctttcctgcagccccagcaggccctcctggtgmtgatgacatcagtgtgaaccccgtcaccaagttgatggtccctggccccaactccttgatgcttccagccagcggccacgcaggctccataccccctggctacttcatccaccctgacactgggagggtgctgcccgaggctggacacctgggatatgatctgctgagagctaccctggtgcccactatggacaccaatgccggtgagcccctggcccactgactatccccaactcagctctgggcttcagagatgaggcagggcttgctgggactctcaggaatgagctcccagggagc

SEQ ID NO: 121638 - DNA, 601 bp, Human
accaacagctccctgtatccctgtccaggtggtgtccgaacatcagaagctgccatcctgccctatgtgccctacccaaccagtcccaccacaggttcccctccagccacgcacctgcccatcctgcagccaagaaggacgtccccgctgggggctctcatgacagaccccgtcacaggcatcaaggtgcccgtgctggctgtgaatctgcacccccaaacaaggcagtggctcactcttgggaggacatactgcaatcctctcaccaagaccttggcccctctggagatggggggcccawggaggatccagtcacaggaggcatctcgcccatcctgggagtcgggttggatgaaaacacaggtctcccggcagccctcagcattgtcctccctcgccctcctccatgcctggcctggcctcccagtccccttcctctcagccccctacaccctccatgttctgatctgagccacaaactccacccacgaccctctttccacccttcatcctctcagcctcttacccccaaccttccctctccccttccccatctctactccagtgcccctggggaggggaagagaagcaaggtacttct

SEQ ID NO: 121639 - DNA, 601 bp, Human
acaaactccacccacgaccctctttccacccttcatcctctcagcctcttacccccaaccttccctctccccttccccatctctactccagtgcccctggggaggggaagagaagcaaggtacttctataaagttaatggacacttttcaaccaaaaaggaccatttctccacctgccaccaccatgctctaccccctgccccctccctctccccctcctccttccctcccacagctcacttccacccttgtgccctagttccccttatgccacacctgcctacatccctgctggttcccyctcccaccttgcccccttggtttctttcttccagctcagctacttgtactgggagggctgcgagatgcttcggggaacctcttgctgcctggtgacagctttgtggagccactgagcaggaagacagtccggctccagggggcttcctgacgagagggccagacattgccccatatgggagggccacaggccctgctggacaccaatgtgctagtggcccagaggcaagtgattgcagtgcttcagccgtgccaggagagtccagagtcgggtgtacaggaaactctggaggctgccatt

SEQ ID NO: 121640 - DNA, 601 bp, Human
cttggtttctttcttccagctcagctacttgtactgggagggctgcgagatgcttcggggaacctcttgctgcctggtgacagctttgtggagccactgagcaggaagacagtccggctccagggggcttcctgacgagagggccagacattgccccatatgggagggccacaggccctgctggacaccaatgtgctagtggcccagaggcaagtgattgcagtgcttcagccgtgccaggagagtccagagtcgggtgtacaggaaactctggaggctgccattaaggacatgagacagscactggccttgactctgcaccatgtcctgcagcaggctcagaggctggagaggcagctggtgacagcagatgacattgaagccagtggtggcaggataggtatggatgaatctgggccagaggctctcaggccccgatatctcgggcccagaatgacctggtgctttgatgctcctaggcccataagctcagggacagggctgcagccctactggccatgcacatgcgtgaccaagggaagagagaaggaactccatgacttcataccccgaccccatgagtgcttgactgcctccctgt

SEQ ID NO: 121641 - DNA, 601 bp, Human
ccctaaagctcaggaggggtacccatgtgccaagggaaggggtcattctggtcttctgctagggctgctgagacccaaaattaaaggtgcccaaagattccaaaaccccaggaccataaatcatgtatgtctcccctagattattgggtcctttcaaagaccagcacttcagaaactcaccacccacccccacgccagggctgtggccaccaggagccctataatccagcttagagccctttgaagggcaaaaggaggtcaggggctcttctggcttcctttttgccagaaaaaggacctkccttccttccccatctctggtttctaaagccagtggtgggcttggcatcccacaggtctaatcccaatctcgattggggctcaagccatagacccctggactagaaagcctggtcctgtcattggagctcaaacggatctctctgccagagtggtggtgcccgttgtccaggtgctggaggctttacctcggggagtgagagaccctggtctggtatgtaggggggtttattgtattcatttattcattcattcattcactcagcaactacatattgagagctgtgttccaggcaacatg

SEQ ID NO: 121642 - DNA, 601 bp, Human
ccccaggaccataaatcatgtatgtctcccctagattattgggtcctttcaaagaccagcacttcagaaactcaccacccacccccacgccagggctgtggccaccaggagccctataatccagcttagagccctttgaagggcaaaaggaggtcaggggctcttctggcttcctttttgccagaaaaaggacctgccttccttccccatctctggtttctaaagccagtggtgggcttggcatcccacaggtctaatcccaatctcgattggggctcaagccatagacccctggactagraagcctggtcctgtcattggagctcaaacggatctctctgccagagtggtggtgcccgttgtccaggtgctggaggctttacctcggggagtgagagaccctggtctggtatgtaggggggtttattgtattcatttattcattcattcattcactcagcaactacatattgagagctgtgttccaggcaacatgttaggcattgagatacaaggacaactagatagggctcccaaggaactggctggccatgggtcccaaacagtgggtggttcacaagggtgttaagaaagctcaggg

SEQ ID NO: 121643 - DNA, 601 bp, Human
agtccccacccatctgccaagattgcacagttttctctttgaaagtttggagtccttttctccctcaaccatgggaatgaaatccatctcagaaaagacacagtcccaagattccccagccccaggcccaagatttcagtcacccctaagtatctaagcaggacagaggtaggggaggaaaagcaaacaggagccccacccagagctcctgccttcccctccgaggcccattcctttgtcccttctgtcctacatagctgaaggctgaagaggaggcctgccaggcccttgagtcccgctrcctgcaggagatggagagaagagccagggctctgagcacacacagcagcccagagcggggcctgctctctcaaggtgggaaagcatctcctaggctcagatccccacagcagaaatctccagggagtgcatcaccacagatagctgccccgtggggagcccctcctgccctctgaatgtgctcagctctcccaggctcagccaggccctggctcttacctgcaggttcccctgactccgataatctattgtcttttcttctcctccctacccctggtggtggtcgctgccatgtggcctt

SEQ ID NO: 121644 - DNA, 601 bp, Human
tgaaatccatctcagaaaagacacagtcccaagattccccagccccaggcccaagatttcagtcacccctaagtatctaagcaggacagaggtaggggaggaaaagcaaacaggagccccacccagagctcctgccttcccctccgaggcccattcctttgtcccttctgtcctacatagctgaaggctgaagaggaggcctgccaggcccttgagtcccgctgcctgcaggagatggagagaagagccagggctctgagcacacacagcagcccagagcggggcctgctctctcaaggtrggaaagcatctcctaggctcagatccccacagcagaaatctccagggagtgcatcaccacagatagctgccccgtggggagcccctcctgccctctgaatgtgctcagctctcccaggctcagccaggccctggctcttacctgcaggttcccctgactccgataatctattgtcttttcttctcctccctacccctggtggtggtcgctgccatgtggccttttctctgccatttgcagcagagaggagtgggaacaggaggcacaggtggtgctaggtatgcagaaggtcctgcagtt

SEQ ID NO: 121645 - DNA, 601 bp, Human
ttagggcaggcagcagaaaagcttaggcaagcagctggccggctgcagggccaggaggaggagatgcggctgcagcaaagcaggaatcagagcccacaggtctggaaccgccccaggaaggtgacgctctgaggctgacaagggtccccacatgtgatgagcacatcctcccacatcatcagatgtggctcttcagggcaatgtaatattcaggggtaggtgggctcaaggaaccttggatgtgccagaaggggagtgagaagaaagaaggctcatcttaacttggccattacgttccctrtgttgtaggtggttcagcgtccctctgatgagtttcagtgggtggtgagggagagacagaacttcctggctaaggccctgggtcagctgcagtaccgacgggagtggagctgcctccagctgttgcacacccaggtgctgatccctggactggacttggctgaggagatctgtatttccatctttgatagggggcctcagaaagagactcccaaggcaaccacgtgggacaggtggggaccaagcatggaactctgtgctatttcatcctagatgattgcctcaagaacccctgtgtgtt

SEQ ID NO: 121646 - DNA, 601 bp, Human
gtactattactcatcttatagatgagggaactgaagctcctggataggtcaagaaagtattcaaagatcatattgctagtgagtagttcagctggaattcaatccccaagagtctttccccagaccctgtgctcctcacgtgcttcctcaaatgaaaagttgttcaacactatgaaggcagtgccaaaagaagatgcaggtaacacattttggtgagttcccaggagggcagatcacttgcttttctggaccagagaagcaagagaaggctttgtaggagaatgaggccatgcttctaccrtgaggaaagggaacactaactttgaaccctaattttggcttttggctaacaaagcctaaaatacttactatctggccctttccagaaaaaaaaagtttactgactccagagaacttgaccaatctcattattaattcctcctttctttgggtgaaactaggaagggaatggcagagaaatgagctctcctttaagggttcccagccccacttcaaccttcgtcttgccattatactggccttgtaattttgagagtaattttatatacattatcttgtttatatcttctagttctagaag

SEQ ID NO: 121647 - DNA, 601 bp, Human
ttcccaggagggcagatcacttgcttttctggaccagagaagcaagagaaggctttgtaggagaatgaggccatgcttctaccgtgaggaaagggaacactaactttgaaccctaattttggcttttggctaacaaagcctaaaatacttactatctggccctttccagaaaaaaaaagtttactgactccagagaacttgaccaatctcattattaattcctcctttctttgggtgaaactaggaagggaatggcagagaaatgagctctcctttaagggttcccagccccacttcaacyttcgtcttgccattatactggccttgtaattttgagagtaattttatatacattatcttgtttatatcttctagttctagaagatagtagaaggttattaattactttttaatagatgagaactgatgctcaaagaagttcagtgactttcttggggtcttatagaacctgggccagaacacaggtcttctgactgctacttcagcagtcttccctaaactttgctaccaatccattctttattgttctctcaaaaacaattaaaaaaatagaaattttaaatactcaaggccattacag

SEQ ID NO: 121648 - DNA, 601 bp, Human; identical to SEQ ID NO: 38592

SEQ ID NO: 121649 - DNA, 601 bp, Human
tgtatactaagcctacttaccctgttgcaatttaaattaatgccccaatgcatttacttctcatcaatttggctgatgccacgtagctgagatgcatgagaattttttagcaaaaggataggtttggttttgttttttattcttttcaggctccagaaatcaccctgaagatttcttctcatcttcctgccatggaagcccaaggcagtgccttccaaggtgccttcttctaccaggtgctgcaaattcattcccagatgtgggttataaaattctggggtccagtatagataaatgaaarcaaaaagaacaaattttataattttttcctaaaatcctgacatattttattccctcctggaaataagtcatttagctaaggcataataaatgtcacagtgtaagagctttctctaatcagtaaaatgaatatgttctggcttgtgcccagagaagcataatagcttggtgccctttaatagatctctgtcattatcaaagccagaggttccaggctggtatttcctataagagtcatggttccagcttcagaaaatcctggacaatcagcatctttctacagaaaaggatctaaattgtt

SEQ ID NO: 121650 - DNA, 601 bp, Human
ccagagaagcataatagcttggtgccctttaatagatctctgtcattatcaaagccagaggttccaggctggtatttcctataagagtcatggttccagcttcagaaaatcctggacaatcagcatctttctacagaaaaggatctaaattgttcctgtcctggcagttcttcagatatgtagattggaagtgccttgctggtaactgccttaaacactgatgacagtctattgctaaacaattctgagaggagaaactgctcatcgatactggagggttagaaaaaggtttatacttgaytagtaggttgttggggggtttaataaaaccagaaactactcacatatggtactctccacacatttcacttgatcctcaaagcaactcgatgaaatagacgagaatttaatcccattttatggatgggtaaacgaactcaggttgtggtgcaagtgccgtgtgccaggaactcagccaggtgccttacaggcatggtctcatttacgactcacaacactatggggtacttttgttatctttgttttagaaattaggaaattgaagcccagagaggctaagtaacttccccaagatcacaga

SEQ ID NO: 121651 - DNA, 601 bp, Human
cttcagaaaatcctggacaatcagcatctttctacagaaaaggatctaaattgttcctgtcctggcagttcttcagatatgtagattggaagtgccttgctggtaactgccttaaacactgatgacagtctattgctaaacaattctgagaggagaaactgctcatcgatactggagggttagaaaaaggtttatacttgactagtaggttgttggggggtttaataaaaccagaaactactcacatatggtactctccacacatttcacttgatcctcaaagcaactcgatgaaatagaygagaatttaatcccattttatggatgggtaaacgaactcaggttgtggtgcaagtgccgtgtgccaggaactcagccaggtgccttacaggcatggtctcatttacgactcacaacactatggggtacttttgttatctttgttttagaaattaggaaattgaagcccagagaggctaagtaacttccccaagatcacagagttagcaagagttaaaactcgagcccaggtgtgtttgacaccaaaaactcataaccatgagtctatgcagctgccactcacagctgagtcaaaggatag

SEQ ID NO: 121652 - DNA, 601 bp, Human
ctttgcaacatttcaaatctacttgagtccccttgtggcctttggttcctcctgcctggccaggaagaggattttcctaatcagatttcccgtggcagcatatgacaaaatgcacgtaccactgcttcacagaagtggttttcctatgagcacagcatctcagctttctgtggctgtttaacagttcacacataaactgcaccagaactgctaaagacaatgataacccatggtgagggcaagtaaagatgagaactctcaagccccatttttctttcaactattattttaaagctttaayagcaattgtatagaagccctactgatctgtcccccttgccttctcttcccttgaccaagggcctggaggcctatttcagggaagcattccctatcacactgagaatggcagcagtttccagggacagtaaacttgaccaaagcataagtgctatcctgctggaagagcagcccatctctgacagagaaagggatcttctgtctaaactcattgaaatgaagcatgtatctcccttggagccagaatcactagaagaggtaactaactttatcatgtgtatcacatggtcttgactaaaat

SEQ ID NO: 121653 - DNA, 601 bp, Human
tgtagagacagggttttgtcaggttgcccaggctggtcttgaatgcttgggctcaagcaatccacctgcctcagtgttcccaaagttctgggattacaggcatgaaccatggcacctggcctcatgacaataaaaatcctattctacagggcagacagtagttacatgactgagtcatgaggagtacaaatgtgggctaacttcatgtctcactaatgtattatcaataattaagcagaatcccatctgtaaaactgtgactcatactaactttagatgcccaagtggcagcatgtttacycaaacttatggtgtgctgttttctgtgcaagcttgataatgatattcttaatatcttgttaaagcacttttgccaggtgcagtagtttacacctgtaatctctgcactttgggaggccgaggcagaaagatcacttgagcccaggagtttgagaccagcctgggcaacacagtgagaccccatctctacaaaaataaaataaaaataaattagccgggcatggtggcacatacctgtagtcccagctattcaggaggctgaggcagaaggatccattgagcccaggagtttgaagctgag

SEQ ID NO: 121654 - DNA, 601 bp, Human
tcatgacaataaaaatcctattctacagggcagacagtagttacatgactgagtcatgaggagtacaaatgtgggctaacttcatgtctcactaatgtattatcaataattaagcagaatcccatctgtaaaactgtgactcatactaactttagatgcccaagtggcagcatgtttacccaaacttatggtgtgctgttttctgtgcaagcttgataatgatattcttaatatcttgttaaagcacttttgccaggtgcagtagtttacacctgtaatctctgcactttgggaggccgasgcagaaagatcacttgagcccaggagtttgagaccagcctgggcaacacagtgagaccccatctctacaaaaataaaataaaaataaattagccgggcatggtggcacatacctgtagtcccagctattcaggaggctgaggcagaaggatccattgagcccaggagtttgaagctgaggctgcagtgagctatgatcacaccactgcactctagcctgggcaacagagtgagatcctatctcaaaaaatacaataaaacacttttttgaaagtatctcagcattttaactattaaaaat

SEQ ID NO: 121655 - DNA, 601 bp, Human
attgaaaaagaagataaggaatttgcccaaagttataaagctatttgtagtggtggatctgagactagattctagatttcctgaatcctgctaagtaattgtcccgtacacatatctccatcattgaatctctattagttactaaggcagatttattttgtgggtttgataatgatgtcggtaatccagaccacagaattctgttggaccccaattcccacaaatcacagagaacagtccattttctgtgctcatccatcagcagcatttgacatatctgaccatattctcctccttgacmtatttttttcatttggctcccaagacactggcctcctctggttttcctccttctctgattgttccttctcagtcttctttgctgatccctgctcttttctccggcctcttaatgttggagggccaggactcagtcccgtccccttctccagtctatattttctgcccttgaaggtctcttctagtcttccagctttaaatctcatctatatgtcaatgaccctcaaatttctatcttcaaccccaattctctaacccatacctccaactgtttattggccatctccacctgactgtttca

SEQ ID NO: 121656 - DNA, 601 bp, Human
atcttttttactgttttcatttttctggtgtgtggtatctcaatgtagttttaaatttcccagatgaccaatgaaactgagtgtttttcatgttgatataccatttagataccttctcttgtaaagtgcctaatccagtcttttgcccattttccattagattgtgcctattttttttcttgctgatttgtaggaattatttattctgcaactatttcccccattttgtggactgtctttataaaacaactatataatgtttattttttccattttatttttagatctagaaagaaaatgrtaatctcatttcagtctgcattattaaaaggtcttaaatacatcactacaacatctgatgaagctgataagaattattggaaaatctataatattcatggtaaatcacataaatgtgtatcatagttttaagtgtatatataataggggctaatatttgccacagaggttgaggacccctgctcactgtgactaaaattttcagtgtgactaaaagatcattagatcacgtatcttattaaaatatgtattaaagatattgactaaaactttctgggaatgtaaaacttgtatatgtcat

SEQ ID NO: 121657 - DNA, 601 bp, Human
aaggcaaatgaggagcaaagtcacatcttacatggcagcaggcaagagagcttgtgcagcggaactcccatttataaaaccatcagatcttgtgagacttattcaccaccacaagaacagtatgggggaaaccaccccccatgattcaatcacctccactcgaccccaaggaaggatctcttaacacatagggattactacaattcaaggtgagatttgggtggggacacagccaaaccatatcatgcaccaagagaagtaccagaatagatacacacacacacacacacacacacacaccaaataaaacatttgttaacaagtctcctaagcaatgcaaggaagatagacgatagactactaaagaattaaagctttctttttaaaaatattatttgggtagataatgaaagatgactaatttatgaattcagtgtccatctggtattcaacatttttagctctgtaggtcttttgtcataattaagagacatccatacatggctgaggatttagctgtcaatccaactgatgaaaatactaatggtagattactttcaagaaaataaaataaaaacagtgaaataacatgaaaagaaga

SEQ ID NO: 121658 - DNA, 601 bp, Human
ggaagatagacgatagactactaaagaattaaagctttctttttaaaaatattatttgggtagataatgaaagatgactaatttatgaattcagtgtccatctggtattcaacatttttagctctgtaggtcttttgtcataattaagagacatccatacatggctgaggatttagctgtcaatccaactgatgaaaatactaatggtagattactttcaagaaaataaaataaaaacagtgaaataacatgaaaagaagatttacaattaagttaaacaaggatttttaaatcaagctaycaggaacatctgctcagaatcaagtcactacatctaactcctctattttgagttttttgttgttagaattggctacttagtcatcttaattcagctcacatagttagattagtcatcaggtaagtaccaaattagacagccttaaaaatacctcattagttaccattttgattgaaatcgtgctttcatggcacagatactaataaaatggtaaaatagtcattgcccataagacgggctatgagggagctgtcctcccatttattccattaacagggaattcttaaacagagcacgccc

SEQ ID NO: 121659 - DNA, 601 bp, Human
gcaaacattaatcaaaagaaagcaggaatggctatattaatatcagataaagccgacatcacagcaaagtagattaccagaaacaggaacattacataatgatgaaagggtcaatctaccaagaatacatagcagtcctaaatgcttatatacacaacagaactgcaacacatgtgaaacacagagaaacggacaaatcacaattatagttggagacttcaatacctcctctcagcaatttatagaactagacagaaaatcagcaaggatataaaagaactcgacaccatcaatcaacatyatctaattaacatttatgggacattccccccaacaacaacaggatgtacattcttttcaagtgcccacaggatatgcatcaaaaatcatatcctggggcataaacaaacctcaacaaatttttttaaattgaaaacatgcagagtgtattgtccaaccagaacagaaccaaattagaaataaataacaaaaaccggtaaatctccaaacacttagaaactaaacaaaatacttctaaataatccaatggttaaagaagtcttagggaaataaaagatacattgaaatgaatatcaaagaa

SEQ ID NO: 121660 - DNA, 601 bp, Human
cagtttcaagatttacacagctacagtaatcaaaactgtgtggtgttggcagaagaataaacacacaggccaagaacacagaacacagaaatacacccacagtgatatactcaactgaattttcacaaagatgcaagaacaatttgatggaggaaagatagtcttttcattttaacaaatggtgctggagtaagtggatattcatagaggagaaaaaagcactttaatctaagtctggtatctcatacaaaaaattaactcaaaatagatggcaaactaaatgtaaaacataaaactttaaaaaaaaaaaaacttcaggatctagagctaggcaaaaagctctaaaacttgacaccaaatcatgatctataagagaaaaatgaatgaattcgacttcatcaaaattaaaagattttgatctgtgaaagacgtcattaagaggataaaacacaacgtagaagtctgagcaagatggcctaatagaaccctctagcaagcatccccctacaggaacaccaaattgaacaactacccatgcaagaaagcaccttcgcaagaaccaaaataacccagcccaccaaggcagttcctcaaggagcca

SEQ ID NO: 121661 - DNA, 601 bp, Human
cagcagaaattgcagcattcctgtgcttagggtacaccccagtgctgatacacctgcagtgaccacaagcttagatcacaacactcaatccccttttaatatgtggaaagccttctcaagaagggcaggtacaaataaatccagattacaaagattggaatacttaattcttcaatgcccaaacattgatgagtggccacaagcatcaacaacatccaagaaaacatgacttcactaaataaactaaattagacaccagtgaccaatcccacagtgatgaagatatcatctttcaaacagrgaatcagaatcaccaccttgaggaagctcagcaacatagataaaaagataacagagaaggaattgagaattctttcagaaaattcaacaaaaagattgaaataatttgttttaaatcaagcaaaaattctggagctaaaaaattcaactgataaactgaaaaatgcatcagaatcaacagcaaattgaccaagctgaagaaagaatcagtgagtttgagtcaggctacatgaaaacagacagtcagagaagagaaaagaataaaaaagaagcacacctacaagatctagaaaatagcctc

SEQ ID NO: 121662 - DNA, 601 bp, Human
agtcaactcattttcaacaaaggtgcaaagaatatacactagggacagtctcatcaataaatagtgtggggaaaactggatatccatacacgaaagaatgaaactagaccactatctcttgccatatgtagaaatccagtaaagatggattaagaacttaaatataagatctgaaactatgaaactactagaagaaaacattgggaacatgttctagaacattggtctgggcaaaggtttcttgggaagacctcaaaatcaggcaaccgaaacaaaaatggacaaatgagatcacatctcrctaaaaagctttgcacagcaaaggaaataatcaacaaagtgaagagacaactcacagaataggagaagatatttacaaactacccatctgacaggtattaactgctagaatagataagaagctcaaacaactcaatagggaaaaaaattcaatttttttggacaaaaaatccaaacaggcatttcttttgttctctttgtttttatttggctcagaaggtactgaatagagatttcttaaaagaaaacaaacaaggccggccacggtggctcaagactgtaatcccagcactttgggagg

SEQ ID NO: 121663 - DNA, 601 bp, Human
aagatctggtacttagtaatacaataggatgaccatagtcgataagttactgtacatttttaaataactgaaagtggccgggtgcagtggctcatgcctgtaatcccagcactttgggaggtcaaagtgggtggatcacatgaggccaggagtttgagaccagcctggccaacatggtgaaatcccatctctactaaaaatacaaaaaaaaaaaaaaattagctgggcgtggtggcgggcacgtgctactcgggaggctgaggcaggagaatcgcttgatactggaaggtagaggttgcarggagctgagatcatgccattgcactccagcctgggcaacgagagcaaaactccatctcaaaaataaaaaaaaaataaataaaaaactgaaagtgaaattgagatgttcctaacacaaagaaatgatcaacgcttgaggtgatgaataccccaattaccatgatttataacacaacatgtgcctctatcaaaacatcacatgtactccacatatataactattatgtacccataataattaaaaataaagaactttttaaaatacaaggtacaaactggaagaaaatagtttcaggccaca

SEQ ID NO: 121664 - DNA, 601 bp, Human
tagtaatacaataggatgaccatagtcgataagttactgtacatttttaaataactgaaagtggccgggtgcagtggctcatgcctgtaatcccagcactttgggaggtcaaagtgggtggatcacatgaggccaggagtttgagaccagcctggccaacatggtgaaatcccatctctactaaaaatacaaaaaaaaaaaaaaattagctgggcgtggtggcgggcacgtgctactcgggaggctgaggcaggagaatcgcttgatactggaaggtagaggttgcagggagctgagatcrtgccattgcactccagcctgggcaacgagagcaaaactccatctcaaaaataaaaaaaaaataaataaaaaactgaaagtgaaattgagatgttcctaacacaaagaaatgatcaacgcttgaggtgatgaataccccaattaccatgatttataacacaacatgtgcctctatcaaaacatcacatgtactccacatatataactattatgtacccataataattaaaaataaagaactttttaaaatacaaggtacaaactggaagaaaatagtttcaggccacacatctgacaaagc

SEQ ID NO: 121665 - DNA, 601 bp, Human
ataaactaccaatacatgcagcaacctggatgaatctccaaagaactatgcttagtgaaaagagccaattccaaaaggttacctacagtatgattaatttataacatttttgagatgacaaaattaaaagaacagggggaagattagtggttgccaaggggttaagaaagggatgggagtcggaggaagtgtgtgcaactatagaagggcaacaagaggaattcttgtggtgatggaagtgttctgtatcttgactgtagcaatgtcaatatctggttgtgatactgtactaaagttttgyaaaatgttaccaagggggaaaactaggtaaaagaatgcatgcaatctatgttatttcttacaactgcatgtgaatttataattacctcaagataaaaatttttctaaaaagagaaggccaggcatggtggctcatgcctgtaatccctgcactttgggaagccgaagcgggaggatcccttgagctcaggagttcaaggccagcctgggcaacatagcgagacctcgttctctactaaaaatcaaaaattagccaggtgcctgtagtcccagctactcaggaggctgaggcaagaggatg

SEQ ID NO: 121666 - DNA, 601 bp, Human
gatgactcaagccagggagtcaaggctgcagtgagctatgattgcaccactgctctccaacctaggtgacagagtgagacctgatctcaaaaaaaaaaaaaaaagaaagaaagaaagaaaagaaaagaaaaataagtggtacatactcatcatagaaaattttcaaaatgtagattaggaagatctaatttggttattatacaaatagactaatagatatgacattaatatatttaggggcttttcaagtatattgactactttttatcacaataaaaatatatagttgattatattttttcccctacacatttgctcagagcctcctgagaggctctaaaggattacacagggatcatatgctcatggatggctgcctctgagccaaaccctagcacattgtggaattggtttcttcctgagtaccaatttggaacaattaattataatggtcatctcaagtactgtgctacaagaattatgaggcaatctctgaacccaaatcagaacactgtgattgactagcagtgtccatcagcagcatggggttcaggggtacagtgtcacctctgctggctggaagaaatgtttttaaaccaac

SEQ ID NO: 121667 - DNA, 601 bp, Human
agagaaaatgaaatgttaccagaaattctaacttgatggttaaggattaaactaaagtacattcacatacatgccagcatcctaaagcctaatacttacacccattgctggtagtcttgtttctgccccattatctggagaccagaattcacccacacacgtatggaggctggcaaacatcacaaccacctccaggagatggtttgctgaggggccagtaaactagtgttgtggttgccttgagagaaatctagggaggttcacaacaactcccacactatagtagaaagctcttcaagasaggacaaactcacttttcagcagagaaacttgacctcatatgccattaagggtaggtgagtttgtcccacaaaataatgctgctatgtgccctaatgaaccatcgtttctagaaaaaaaagaaaaaatgattactaagagctgcacccaaagtaatgaggctagaatcaagctccctcccccttcatcagcactagcatgactgctggcatgtcgtacccaagttgggactcaaggtcacaactttttgtatccactcagagccactggcccaaagcacaagtctactcacaagagaacc

SEQ ID NO: 121668 - DNA, 601 bp, Human
cagtgtagccggggttacacacgcagcgcccattctcacagcgccccctctgactgcaaccgcgagggcagctcctcatgccacagtcgtcaccagtgtagcctgggtcacacacgcagcgcccaccctcacagcgtcccctctggctgcaacctcgagggcaggagcgctggctgcagtcggggcctgagaagcctgcccggcacacacacacgccctgcacgcagcgcccacggccttggcagtccccgggacaggatggccagccacagctggggccagtgtagccgggaaagcacaygcaacgaccacggacacagcgaccctgatcattgcagtcatctgggcaggaccccgaggctgagggtggggaagagggagggatctcagcatctgtggggtctgagcaggtgggcccaccccagcctggctcacaggaacaggtgcagcggctcagatcaaacacaccatggagactgcagagggtccgcacatctgtctgacctggagtaggaggggagaggcaagtctcagtctctctcctgggagagaggctgagcctatgtagtgctcctatgtgcaggcccctagccaggctagc

SEQ ID NO: 121669 - DNA, 601 bp, Human
cacaccgcaatcctcgccagagtagccgtcctcgcacacacaccgcccatctaggcactggccgcggcctcggcagcccccggggcagctgcgcgtgctgcagtcttcccctgagtagcctgcgtcacacacgcacacgccatcctcgcaaaggccgtgcccacggcagtccccgggacagcgacggctcccacagtcctcaccggtgaagcccgggttgcacacgcagcggccatccacgcagcgcccgcgcccgcgacagtcgccaggacaggcgcgcgtgccgcagtcccggcctgtgtaccccggccaacacatgcagcggccactctcacagcggccccggccacgacagtccccaggacagctgcgcacaccgcagtcctcgccgctgtagcccgcattgcaaacacacacgccgttctcgcagcgcccgcgacctctacagtcgcgtgggcaggcgcgcgagccgcaatcggttccagtgtaccccggccagcacacgcagcggccgtcctcgcagcggcccctttggttgcagtcgccagggcagctgcgcacgccgcagtcgtccccgctgtagcccgtgtcgcaaatgcat

SEQ ID NO: 121670 - DNA, 601 bp, Human
tagccttcccaacagatgcacacaccgtcctggcacacgccgtgctggctgcagtcattcgggcactgcctcacaccgcaatcctcgccagagtagccgtcctcgcacacacaccgcccatctaggcactggccgcggcctcggcagcccccggggcagctgcgcgtgctgcagtcttcccctgagtagcctgcgtcacacacgcacacgccatcctcgcaaaggccgtgcccacggcagtccccgggacagcgacggctcccacagtcctcaccggtgaagcccgggttgcacacgcagyggccatccacgcagcgcccgcgcccgcgacagtcgccaggacaggcgcgcgtgccgcagtcccggcctgtgtaccccggccaacacatgcagcggccactctcacagcggccccggccacgacagtccccaggacagctgcgcacaccgcagtcctcgccgctgtagcccgcattgcaaacacacacgccgttctcgcagcgcccgcgacctctacagtcgcgtgggcaggcgcgcgagccgcaatcggttccagtgtaccccggccagcacacgcagcggccgtcctcgcagcggcccc

SEQ ID NO: 121671 - DNA, 601 bp, Human
tgctcaccttctccgcagtcttcgccagcatacccatctttgcagacacagctgccatcgtgacactctcctcggccacggcagtcccctgggcatgtctggatggcacagtcagggcctcggaagccctctacacacacacactggcctgcccggcacagttcccggggcccgcagcctccagggcaggcgctggctggaggctcttcctgcccgcagtcctcaccgccatagcccacgtggcacaggcacactccttgcacacaccgcccacgtccccggcagtcagccgggcacatgygggtggcacaggtagggccggtgtagcctgggtcgcacaggcagcgcccttcctcacagcggcccctcccgtggcagttggaggggcaggtgcggatgctgcagtcctcactcacgtagccttcccaacagatgcacacaccgtcctggcacacgccgtgctggctgcagtcattcgggcactgcctcacaccgcaatcctcgccagagtagccgtcctcgcacacacaccgcccatctaggcactggccgcggcctcggcagcccccggggcagctgcgcgtgctgcagtcttcccctg

SEQ ID NO: 121672 - DNA, 601 bp, Human
aaggggcgaagaaactgggaggttttgcctgaggaatgaagacatcaggctggtgtctccaaatacctgaaggcctgtggtgtaggacacagggaaagcaaaaaacattccagctgctgatgaatacccagctagggccaacggacaggtgctagaataggggcagacggattctgcaacaatgataacagctaacagtgatgaccaacaatggactggacagcctcaggaagtactgagctctctgttaccaggtgttccaactgtgtgggaccaatgcttgctggagatgctgcagagrcctcagtgcccagtgtcaagcaggctaagaaagcctttacagcagcttcaggtacccagccatctggactcaaccaatgatcacctggaacttcctccaggaggtgagccctgcccccctgtcctgcccactcagtcccctcctggagcctggcatctctctcaccgtggggatgaactgaatttcataggcatccacggggccaggagccggggtccactctgtccgaactgttgtctcctccaagagatgcatcctcatgccctcaatggttggcacctctgcccaagagaatgggtt

SEQ ID NO: 121673 - DNA, 601 bp, Human
aaaagtgtatatagttgaatgttgtcttctttccttccatcttttttccctgctaatctgtattttctaagttttctgcacggggcctatattacttttataattaaaagttacttaaaaaaccaaatatgaccaaaacagctgcctgcttgtgtgactacaaattgctatacgccagctctgagaaaagtgtccataaattcagagtaagtcagtgggcccctctctgtccccacattttgggggcacatgaaaaaagcaagaatcacaggaaggtaaaggattcagagaataaagactkagggaaaaggggcgaagaaactgggaggttttgcctgaggaatgaagacatcaggctggtgtctccaaatacctgaaggcctgtggtgtaggacacagggaaagcaaaaaacattccagctgctgatgaatacccagctagggccaacggacaggtgctagaataggggcagacggattctgcaacaatgataacagctaacagtgatgaccaacaatggactggacagcctcaggaagtactgagctctctgttaccaggtgttccaactgtgtgggaccaatgcttgctggagatgct

SEQ ID NO: 121674 - DNA, 601 bp, Human
gattcttccttagcctcccaagtagctgggattacaggcatacaccaccatgctcagctaattttgtatttttagtagagatggggtttcactatgttggtcaggctgttctcaaactcctgacctcagatgatccacccactttggcctcccaaagtgctgggattacaggcatgagccactgcgcctggcctgcttcactgattttgttcttgggaagttttagagtttatctcaatattaacctcgtggctccagatgaactctaccttggctggtccttggagcttatctcaccctcattgctgtttttagactagacccaagcaaaaacttctctgaggctgtgaggttttgagtcccagtgaacacttagcctagccctgatttccaggctgcaggacacacccagacaaggaatatctgaacctctttctcattcaggaactcatctccctcagtttccccatgctttctctcacattcatagtggagctagcactttgcaaaatagcaacattccttcacttagggggcctcaggctggaggggcatcagaatcacctggagggcttgttgcaatacaggttactgggctctg

SEQ ID NO: 121675 - DNA, 601 bp, Human
cttaactgactggatcaggcagcatctcctattcacttctctccctggggccattcctttcataggctaacctgtaaccttcctacaggactccaggcatctgagggctctgtctccccagtggcctcaggacagagcaaggcccccagcaggtgcctcgagactgccacacacctgccagaagcattcagaggagtctgtgagccctgagcctgggctcctgaggaggaggatccaaggctgggaaaccagggcccttccctaacctctggccagccatacctgtgttggccctgacagmagctgggtagctgactgcccggccccgctccgctgtgacagtcaccacatattctacgcctggcatcaggtcagtcagcagcgtcccgtctgcttcagggggcacttccagcctcaccctctggttgccggcactgacgtaggacaccacaaatcggtccacctcagcctggggacgcagccagccaagctccagtgttgtcggtgtcacagccaccactcggaggtcctggggcccatcgatcactagccaggttaaagaggaggactcaggtgggtgtctggttcttcaatcatcatc

SEQ ID NO: 121676 - DNA, 601 bp, Human
ccactctcaccacagtgagtcagaacgggaatcactgttttcaattcccagcccactcaaactgctccagtgaatctttgcaggtgccccaaccacatcaccctctattgcctaaaataacaatcctggaagtgtcccgggaaaccccaaagaaggcgctgccttgaccttaggcatccacaggatggatgccaggaccctggggtggggacgtcttctagggacaatggactcgtgctttgtcctgggggccccctggagccccggccaggtagggcctgaaggtagaagggggcagtgrggggtggcagtgggaggaattcatgaatgcaggctccaacggcaggtgaggctggacaagggataggtgtcccgtggccccagcccacactacctgtggtggtgatgaaggcgtaggacttggaggtctgccccgcccgcaccccgtggacctccacgtggtaggtggtgccgggcctgaggtcgggcaggctgacggtgcgcgtggtgcccggcacagtcagctcaccgccggggccctctgcaggcggctgaggccgccagcgcagcaccacgcgctcgaactggccgcggagcccgt

SEQ ID NO: 121677 - DNA, 601 bp, Human
cagtttctccatccctcacaaggtcttggtctctctgcacaccaggatctttgcgggggtttcaggtccccctggttctgaatgagagtttcaagcctccctgctgcagcatcagagcagtctgaaagctcctctgcccacctgagctgctgtctctcttaccaccctctcttccagtggtgagcttgacctggagctgggggatgagtcagccaccctggtcccacagagaggaacaaagaggggatgtgaaagccaggtaccccaggacctgtctttcactggtcctgcaaacctcatycatgtctgaagtcctgatggctgtggagccccctgccccaaggagccttcacccccagcagaaactggctgatgggaccatggactgctgtccactgcaaaccaggctcccagggacgaggtattgggggctgagggtcagtgtccagaggccttcccatgcccaccctgaaagatttatagggcagggaagggcagaggagcaaccgaagagtgggggcaggggacagggcaaggaaagctgcaggtggagggccagggaccttcagcctctctcctggaatctctgtcccaccctcgg

SEQ ID NO: 121678 - DNA, 601 bp, Human
gaagactctatctgcccacccctcagtgactagctcttctggaagaggggcatttccctctcaatctctgcttcttcccttgtgacagtttctccatccctcacaaggtcttggtctctctgcacaccaggatctttgcgggggtttcaggtccccctggttctgaatgagagtttcaagcctccctgctgcagcatcagagcagtctgaaagctcctctgcccacctgagctgctgtctctcttaccaccctctcttccagtggtgagcttgacctggagctgggggatgagtcagccaycctggtcccacagagaggaacaaagaggggatgtgaaagccaggtaccccaggacctgtctttcactggtcctgcaaacctcatccatgtctgaagtcctgatggctgtggagccccctgccccaaggagccttcacccccagcagaaactggctgatgggaccatggactgctgtccactgcaaaccaggctcccagggacgaggtattgggggctgagggtcagtgtccagaggccttcccatgcccaccctgaaagatttatagggcagggaagggcagaggagcaaccgaagagtg

SEQ ID NO: 121679 - DNA, 601 bp, Human
tgaggagctgagagaagagatagaggcataaagggctgctggctttgctgctgctgcccacagatgacagccatggaaatgcccttacgctgtgggctcaggggctctgtagcctttgtatttgccattcggtcactcacggatggagaaggctgagacagcccttgccccatcctgctctggtgggttctgtgggggtgaggggtctcccttcgtgtctgagaaaggagctgagatgggaagagaggaagcctctgagggttcttccaaaccacgttcactgacagtgctgacctcagasagtgaggagggcagtgaggcctcttcctacctgtgccctccccagggcactctggctgccccacccctcatatgaggatctgaccatggaatgtgctcttgctgtggcctccccaggcagccctgcccctccctcccctttaaccccaaggaatgaattgctaaggcagggctccaggcatgagtgggagaaaaattctggggtgagtgggatccaaggagagacatgtccttccctggctggctctggaatcacagccctgtgggcacctacccgccccctacagttaggtctctgctg

SEQ ID NO: 121680 - DNA, 601 bp, Human
ggatcatctgaggtcagaagttcgagaccagcctggctaacatggtgaaaccctgtctctactaaaaatacaaaaattagccgggtgtggtggtgggcgcctgtaatcccagctacttggggggctgaggcaggaggactgcttgaacctgggagccagaggttgcagtgagctgagatcatgccactgcactccagcctgggtgacaaagcaagactctgtctcaaaaaaataataataaaataaaaaaataaaaatcatacagctgagaacagaggaagacaggaaggaactcagtttstcagattcccaaactccatttatctctactgcaccgacttggtcagtgcctgacagagcccatccttaccccagggaccaggcacagggcctcacagagcccagtgtgggtccctgggacagagcggcagagggagggtcactccaggagcagacttggcagcatgtctgggcctggcaccagcctccaccctacaacctcaggccccaaggacagccactcagggtggctttgccgtctccctcttctcagggctgactgaggcaaagaaaataaattgagggtggaaggttctggaaa

SEQ ID NO: 121681 - DNA, 601 bp, Human
acaattataacgattcatgactctggcagtccccatgctgcatgtgggacagtccttttccaatttagaagtgtgtctaatgagctccacgcacctctccccctggcaactgcactgtgtgtgctgccagacacagcccccagcttggcggactccagctgcttcgtccttttgctgctctgataatgcgcactgatgcccatttctttcctaaagggcctcatctattttatccaggacgtgtaaaatacatgtttcaaaatatccagcattagaacatggatatacagggattccctcrcgggaaggtctgagcaaaagatgaatgagctgagaagatgccagacatgttacatcaccacctttaaccgtgacaacaagctgggcagcgtttactccctcctgaatatgaggaagctgaggttccaggagaggaggtaagtttttcaagatcatacagctggctgggcacggtgcctcacgcctgtaatcccagcactttgggaggccaaggcgggtggatcatctgaggtcagaagttcgagaccagcctggctaacatggtgaaaccctgtctctactaaaaatacaaaaattagcc

SEQ ID NO: 121682 - DNA, 601 bp, Human
aatattttgataactgtctataaatataatgtttcctttgtaatcctatacagcttattttacagatttaaaaacattgccttcaggtggggtaggggtttcaccagatgccacagcacaacaatcatggagaacctgtgcccaggaagccatgaggggcaggaaggagcccagagcaagagtgaggcagcctcctggagagatgaaaactctccagggctgggatggaatgcagtgcaggcaggtggcagaggactcctgagaagggactcaggatgtaaagcacttcgcctcaacaaamaagggcagaagcaggaggtggcagctgtgtccaagtcacagcagggttgtaaagagaaggggtggaaacagctgtgggcagtcggagagggggagagaaagtctgtggctggatttaggccaaatggaaataagacattcccctgggcggggggcagagtggagatggggaaggagctggagggctgagaaggctctagccctgggaggagtaaaggggtcagggaacagaaagactggcagggtcaccgagccagggcctgaggggatctagcccctcagtgagggtgcggtggtacca

SEQ ID NO: 121683 - DNA, 601 bp, Human
ggcaggagaattgcttgaacttgggaagcggaggttgcagtgagccgagatcgcgccattgcactccagcctggatgacaagagcaaaactccatctcaaaaataaaaaagaaatattttgataactgtctataaatataatgtttcctttgtaatcctatacagcttattttacagatttaaaaacattgccttcaggtggggtaggggtttcaccagatgccacagcacaacaatcatggagaacctgtgcccaggaagccatgaggggcaggaaggagcccagagcaagagtgaggcrgcctcctggagagatgaaaactctccagggctgggatggaatgcagtgcaggcaggtggcagaggactcctgagaagggactcaggatgtaaagcacttcgcctcaacaaaaaagggcagaagcaggaggtggcagctgtgtccaagtcacagcagggttgtaaagagaaggggtggaaacagctgtgggcagtcggagagggggagagaaagtctgtggctggatttaggccaaatggaaataagacattcccctgggcggggggcagagtggagatggggaaggagctggagggctga

SEQ ID NO: 121684 - DNA, 601 bp, Human
cttagagttattgcagaaactttaaaataccttttatatccatcactgcttctaaattttgtagtttagtaaacgcgccaccaagtcctgttatttaatgaactagtaaataagtccaagtattactaaatcgtaactttggatttttaagaaatattttgggccgggtgcagtggctcatgccaggccgaggcgggtggatcacctgaggtcaggagtttgaggccagcctggccaacatggcgaaaccctgtttctactaaaaatacaaaaaattagctgggtgtggtggcacgtgccygtaatcccagttactcgggaggctgaggcaggagaattgcttgaacttgggaagcggaggttgcagtgagccgagatcgcgccattgcactccagcctggatgacaagagcaaaactccatctcaaaaataaaaaagaaatattttgataactgtctataaatataatgtttcctttgtaatcctatacagcttattttacagatttaaaaacattgccttcaggtggggtaggggtttcaccagatgccacagcacaacaatcatggagaacctgtgcccaggaagccatgaggggcag

SEQ ID NO: 121685 - DNA, 601 bp, Human
tatgggcccagacaggcctgagctaggagggtgagaacctgggtgagagtcacaggggagacaacaaagactctcaggaggtgatggattcgcaaggcaggaagggttcctggctcccctcgccccttctcccagcacccccaggctcccacatccaccctgcaggaagaggcctgtaggggcttccctcatccaacaaaagtggaaattacgagaagagaggcagagtcagcaggggacagcagacccaggaactggccccactctcctggtcctcatctgctttgcggcttttctttcttttttttttttttttggtcttttttgagacggagtctggctctatcacccaggctggagtgcagtggcgcaatctcagctccctgcagcctccacctcctgggttcaagtgattcttgtgcctcagactcccgagtagctggaattactagcacccatcaccacacccagctaatttttgtctttttagtagagacagggttttgccatgttggccagactggtctcaaactcctgacctgccttggactcccaaagtgctgggattacaggcatgagtcactgtgctagccccatgtgg

SEQ ID NO: 121686 - DNA, 601 bp, Human
ggtctgtggtgctgaccagacccttgtcccattccccaccagtcatcaccaaagagcaagagggtgaccctcccatggctcccaccctggggctcccatcatccactcacctgtcaccccgacgacagacacagggcccatgcgctggccaccgtggaagccgtacaggttcatcttgtatttatggtctggctccaggcccgagatggtgaccccttcctcgtgccctggcaccctcactgccttgggctgcccatctccattcctgtactggaccaggaagtggtcaaactgtccctcrggaactgtccaggacaggctgagggagtcaggggtggcatctgtcacggtcagctcccccaggcgaggcttgatggggggctcgggggttgcggtgggaggttctgaaggcttctcctcctccgggactggacagagacatggaaagagaggactgaggtgggcagggtatccgcgggactctgctgtcctctggactctcccagccatctgaaaggaggcatagtgggcagagttctcacctgtcagggcctcgacatggacaggacctacatgcttcccatcactgaaaccatacagg

SEQ ID NO: 121687 - DNA, 601 bp, Human
ctggggaaaaggagggagaagccaaggctatgactgggggacccgaggtcagttcagagaggcctactcttggggctgggtggtcctgctcagctgacagctaacacacatgacaagttccagggtcagctgtgggggacctgggacagccaccagcacagcaaaattcccgatggcccctctctgttcaggaggagccagtggtcaacctcacaggaaggcccaaggggagccccagccccagccacaagcaggtctgtggtgctgaccagacccttgtcccattccccaccagtcatcwccaaagagcaagagggtgaccctcccatggctcccaccctggggctcccatcatccactcacctgtcaccccgacgacagacacagggcccatgcgctggccaccgtggaagccgtacaggttcatcttgtatttatggtctggctccaggcccgagatggtgaccccttcctcgtgccctggcaccctcactgccttgggctgcccatctccattcctgtactggaccaggaagtggtcaaactgtccctcgggaactgtccaggacaggctgagggagtcaggggtggcatctgtcac

SEQ ID NO: 121688 - DNA, 601 bp, Human
acctgtcctgagcctttagtgaacagggtgtattacaggtttgaggtcttggggttctgggtccctagtggaggagatgctggaggctgtactttgctaagacccaacccagagggctctgcagtgcacactcacccgtgacgcccacagcagacactgggcccacgcgccgcccctcgtggaggccgtacaggtgcatcttgtacttgcgcccaggctccaggccccccacggtgacttcactctcctcgcccccaacacgcaccacctggggccgcccgtccctgtccttgtactgcayggtgaaggagtcgaagcggccctgggggacggtccaggagaggctcagcgagtcaggggaggatcctgtcactgttagctcccccaggagcggctcctcagcgggctccggggcctccatgctgggttctgtggggctgggggtctcttcctctgcagctgagaaggaggaagagagagtgagggggatgtccttgggtactggggaaaaggagggagaagccaaggctatgactgggggacccgaggtcagttcagagaggcctactcttggggctgggtggtcctgctcagctgacag

SEQ ID NO: 121689 - DNA, 601 bp, Human
atattactttttgaatggataaatgaaatgtaccacaaagttttacccaaaccactgacttcactctcttaatagatccccatgtatgtttttcttccctgccccaatctgaaggaggtgagattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacctgtgccrtgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcaatagtttactgagaatgatgatttccaatttcatccatgtccctacaaaggacatgaactcatcattttttacggctgcatagtattccatggtgtatatgtgccacatt

SEQ ID NO: 121690 - DNA, 601 bp, Human
gagatgcatattactttttgaatggataaatgaaatgtaccacaaagttttacccaaaccactgacttcactctcttaatagatccccatgtatgtttttcttccctgccccaatctgaaggaggtgagattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacmtgtgccgtgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcaatagtttactgagaatgatgatttccaatttcatccatgtccctacaaaggacatgaactcatcattttttacggctgcatagtattccatggtgtatatgtg

SEQ ID NO: 121691 - DNA, 601 bp, Human
atattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccag

SEQ ID NO: 121692 - DNA, 601 bp, Human
gaggaaggtgagaaagagaactggacggatattggataaatgttttggggaggtggagagtcgactgggaaccttttgaaaaagtgatagagggtccctgagtgggcccgccagcaactctgtaacccccttcccagagagaaggtgtctgcaattggaggctttttcggtttcctttcaaatgtaaattctcggtattttagggctggccaggactaatcagggaatccctcaattggtaaatgtagaggtcggcggaaactgacttgtcacggccgcagagtagactctgggacccatrttttccctcggaacccatttttagtcggctttctttctgggaacttctccttgtgccccaccttaattaacccttgacttactcgagccttcgtggatcagctcttaaagtggtcttgcttctttcagaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaagg

SEQ ID NO: 121693 - DNA, 601 bp, Human
aagagcccgccttccaactgtggcctttgatgcagaaacatttcattctctctgtttcatctacaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggtaaacttattcttaccattgtagagtctgttgattatttcttgtcccttatttcactgatacrtgcaagagcattcaaatgaatagtaatattaataccatttattgagtgcttagcatgaggcaagctctgcctaacattttacatgcattaactcacataatctttacacgtactctctgaggtttgtcacctctactatttaaatcatggctttagagaggttatgtcagggtcacacaggtaagtggcccatatgggattcaagctcaggctgtctggcttcagaatctatgcttttaattgtcaactgtcttatattccttcgttaatgatattaagtagtagctgtctgagccaaag

SEQ ID NO: 121694 - DNA, 601 bp, Human
aaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggtaaacttattcttaccattgtagagtctgttgattatttcttgtcccttatttcactgatacatgcaagagcattcaaatgaatagtaatattaataccatttattgagtgcttagcatgaggcaagctctgcctaacattttacatgcattaactcacataatctttacacgtactctctgaggtttgtcacctctactatttaaatcatggctttagagaggttatgtcagggtcacacaggtaagtggcccatatgggattcaagctcaggctgtctggcttcagaatctatgcttttaattgtcaactgtcttatattccttcgttaatgatattaagtagtagctgtctgagccaaaggctttgttgtccaactacaagccatctctgcagaatttattggcgtaaacatagaatgttctcttgaatttttttactgctgcatatggc

SEQ ID NO: 121695 - DNA, 601 bp, Human
cattcaaatgaatagtaatattaataccatttattgagtgcttagcatgaggcaagctctgcctaacattttacatgcattaactcacataatctttacacgtactctctgaggtttgtcacctctactatttaaatcatggctttagagaggttatgtcagggtcacacaggtaagtggcccatatgggattcaagctcaggctgtctggcttcagaatctatgcttttaattgtcaactgtcttatattccttcgttaatgatattaagtagtagctgtctgagccaaaggctttgttrtccaactacaagccatctctgcagaatttattggcgtaaacatagaatgttctcttgaatttttttactgctgcatatggctactaaataataagcctgtaacattggaatatgcaaaggagtaaaacaggaagaaggcaacttttcagggagtggttaagaagatgaattaacacttagcctcaaaaataataactttttattaaatataaggtatgtaaatgtattctatgatagacctacctgtgaaggaaaggtaggtcatgtagaggaggctgctttgatgaaattgcaatgaac

SEQ ID NO: 121696 - DNA, 601 bp, Human
gggattacaggcgttagccacggcgcccagccagttcagcttcttatatctaaggataagagattgaaagctattgctttagtgttgaatttctgggcatagcacatgaaatatgtagccagcacagtctttgggcatatcaaactacgtgaggctttcttggaaggcccatactgattcttacctttgctttcccacttagtaagaatgccttccccaccctgtctttcatttagctaataaccttttcatccttgaaaacagctcaagcatcaactcctgaagctttcccaaacttccsccatctccaccccctgttcctagaatcagtcttttttttccctttgagacagagtctcactctgttgcccagactggagtgcagtggtgccatcttggctcaccacaacctctgcctcccgagttcagtgattctcctgcttcagcctcccaactagctggggctacaggcacatgccaccatgcttggctaatttttgtatttttagtagagacggggtttcactatgttggccaggctggtctcgaactcttgatctcgtgatccacccgcctcagcctcccaaagtgctgggattac

SEQ ID NO: 121697 - DNA, 601 bp, Human
acggcgcccagccagttcagcttcttatatctaaggataagagattgaaagctattgctttagtgttgaatttctgggcatagcacatgaaatatgtagccagcacagtctttgggcatatcaaactacgtgaggctttcttggaaggcccatactgattcttacctttgctttcccacttagtaagaatgccttccccaccctgtctttcatttagctaataaccttttcatccttgaaaacagctcaagcatcaactcctgaagctttcccaaacttcccccatctccaccccctgttyctagaatcagtcttttttttccctttgagacagagtctcactctgttgcccagactggagtgcagtggtgccatcttggctcaccacaacctctgcctcccgagttcagtgattctcctgcttcagcctcccaactagctggggctacaggcacatgccaccatgcttggctaatttttgtatttttagtagagacggggtttcactatgttggccaggctggtctcgaactcttgatctcgtgatccacccgcctcagcctcccaaagtgctgggattacaggtgtgagccaccatgcc

SEQ ID NO: 121698 - DNA, 601 bp, Human
ctttcttggaaggcccatactgattcttacctttgctttcccacttagtaagaatgccttccccaccctgtctttcatttagctaataaccttttcatccttgaaaacagctcaagcatcaactcctgaagctttcccaaacttcccccatctccaccccctgttcctagaatcagtcttttttttccctttgagacagagtctcactctgttgcccagactggagtgcagtggtgccatcttggctcaccacaacctctgcctcccgagttcagtgattctcctgcttcagcctcccaastagctggggctacaggcacatgccaccatgcttggctaatttttgtatttttagtagagacggggtttcactatgttggccaggctggtctcgaactcttgatctcgtgatccacccgcctcagcctcccaaagtgctgggattacaggtgtgagccaccatgcccagccttagtcttatttttgtttattttttttttcccaagacagagtcttgctctgtcacccaggctggagcacaatggcacgatcttggctcactgcaacctctacctcctgggttcaagcaattctcttgcct

SEQ ID NO: 121699 - DNA, 601 bp, Human
acataaattatactgttaccacatttacgtagtttttttgttgttgttgttttgtttttttgagatggagtctcacactgtcgcccaggctagagggcagtggtgcggtctcagctcactgcagtctctgtctcctgggttcaagcaattctcctgcctcggcctcccaagtagttggggttgcaggcacacaccaccatgcctggctaattttttgtatttttatttggttttggtttttttgagacagggtcttgctctgttgcccaggctggagtgcagtggtgcaatctcggctcartccagcctccgcctcgggtcaagtgattctcatgcctcagcatcccgagcagctgggattacaggtgcccaccacaacacccagctaatttttgtacttttagtagagatgaggtatcaccatattggccaggctggtctcgaactcctgaccttagatgatctacccatcccggcctcccaaagtgctgggattacaggcctgagcaaccgcacccagcccccagttgtttctaatgtgttgtcttatgtcatcactgacatgttcatctcttgcctgctcctttttggcctctccttt

SEQ ID NO: 121700 - DNA, 601 bp, Human
aggctggtctcgaactcctgaccttagatgatctacccatcccggcctcccaaagtgctgggattacaggcctgagcaaccgcacccagcccccagttgtttctaatgtgttgtcttatgtcatcactgacatgttcatctcttgcctgctcctttttggcctctcctttttctataggattcttctgcaagacttctttgccaggagcagccttctgcttttagtttcttcttccatctttctagtgctttttaaagttgtgttctaactttggaggattcaatttagtaaatgtgctgkttcttttttttttttttttttttttgggacagagtctcgctgtgtcacctaggctggtgtgcagtggcacaatctcggctcactgcaagctctgtctcccgggttcacgccattctcctgcctcagcctcctgagtagctgggactacaggcatccgccaccacgcctggctaattttttatatttttagtagagacggggtttcaccgtgttagccaggatggtctcaatctcctgacctcatgatccacccgccttggcctcccaaagtgctgggattataggtgtgagccaccgcgc

SEQ ID NO: 121701 - DNA, 601 bp, Human
ttttctataggattcttctgcaagacttctttgccaggagcagccttctgcttttagtttcttcttccatctttctagtgctttttaaagttgtgttctaactttggaggattcaatttagtaaatgtgctgtttcttttttttttttttttttttttgggacagagtctcgctgtgtcacctaggctggtgtgcagtggcacaatctcggctcactgcaagctctgtctcccgggttcacgccattctcctgcctcagcctcctgagtagctgggactacaggcatccgccaccacgccyggctaattttttatatttttagtagagacggggtttcaccgtgttagccaggatggtctcaatctcctgacctcatgatccacccgccttggcctcccaaagtgctgggattataggtgtgagccaccgcgcccagcctgtaaatgtgctgtttcttgatgcttcgttcttgttctgtgcaaggccatttatgcaaagcaacccctcaagtggcagaggagctgagaaaccaaggaattaggcagataaatggagtttgctggtattgggtgactgatgagggggaatttacagacataa

SEQ ID NO: 121702 - DNA, 601 bp, Human
gggttccagctgccctgggagttactgatattttctctacataaagctcaggttctaagtttagaggcttaagtgaaaagatctgagatgataatgtagtatctttatttggaagggagtggaccagcagcagttgtggtgaagaatatcgtaagacctgacaatataaaaaagctgtcatactgtcctatctaatgtttgccttttttttcttttttttttggggtggggagacagtctcactctgtcacccaggctggagtgcagtggtgcaatctcggctccctgcaacctccacctkccaggttcaagcaattctcctgcctcagcctcccaagtagctggaactacaggtgtgcgcaaccatgcccagctaatttttgtatttttagtaaagacaggtttttccatgttggccaggctggtctggaactcctggctgcaagcaatctgccaacttcagcctcccaaagtgctgggattacaggcgtgagccaccacgccagccttcatgtttgctttatttcttggtgatgttgttgtttgtggttgaccatatgaataattgaattaagaactgatatagattataaatgcccca

SEQ ID NO: 121703 - DNA, 601 bp, Human
atttggaagggagtggaccagcagcagttgtggtgaagaatatcgtaagacctgacaatataaaaaagctgtcatactgtcctatctaatgtttgccttttttttcttttttttttggggtggggagacagtctcactctgtcacccaggctggagtgcagtggtgcaatctcggctccctgcaacctccaccttccaggttcaagcaattctcctgcctcagcctcccaagtagctggaactacaggtgtgcgcaaccatgcccagctaatttttgtatttttagtaaagacaggttttkccatgttggccaggctggtctggaactcctggctgcaagcaatctgccaacttcagcctcccaaagtgctgggattacaggcgtgagccaccacgccagccttcatgtttgctttatttcttggtgatgttgttgtttgtggttgaccatatgaataattgaattaagaactgatatagattataaatgccccagtgctactgtaggaactaactgatctttctggacataaatgtgtcacatggagtcatgtttctaagaataatcagcattttcttttgcaggaagagcaagcagtca

SEQ ID NO: 121704 - DNA, 601 bp, Human
agcagttgtggtgaagaatatcgtaagacctgacaatataaaaaagctgtcatactgtcctatctaatgtttgccttttttttcttttttttttggggtggggagacagtctcactctgtcacccaggctggagtgcagtggtgcaatctcggctccctgcaacctccaccttccaggttcaagcaattctcctgcctcagcctcccaagtagctggaactacaggtgtgcgcaaccatgcccagctaatttttgtatttttagtaaagacaggtttttccatgttggccaggctggtctsgaactcctggctgcaagcaatctgccaacttcagcctcccaaagtgctgggattacaggcgtgagccaccacgccagccttcatgtttgctttatttcttggtgatgttgttgtttgtggttgaccatatgaataattgaattaagaactgatatagattataaatgccccagtgctactgtaggaactaactgatctttctggacataaatgtgtcacatggagtcatgtttctaagaataatcagcattttcttttgcaggaagagcaagcagtcagaccaaaatacctactgggtcg

SEQ ID NO: 121705 - DNA, 601 bp, Human
gtctcactctgtcacccaggctggagtgcagtggtgcaatctcggctccctgcaacctccaccttccaggttcaagcaattctcctgcctcagcctcccaagtagctggaactacaggtgtgcgcaaccatgcccagctaatttttgtatttttagtaaagacaggtttttccatgttggccaggctggtctggaactcctggctgcaagcaatctgccaacttcagcctcccaaagtgctgggattacaggcgtgagccaccacgccagccttcatgtttgctttatttcttggtgatgktgttgtttgtggttgaccatatgaataattgaattaagaactgatatagattataaatgccccagtgctactgtaggaactaactgatctttctggacataaatgtgtcacatggagtcatgtttctaagaataatcagcattttcttttgcaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattga

SEQ ID NO: 121706 - DNA, 601 bp, Human
gttcatgcaggtgagcatttcagtaagagttttcccttccaggattctagccgagtcataagaaactgatgttttcaggccagtctgggcgcagtggctcatgcctgtaatcccagcgggcgggtggatcacaaggttaggagatcgagaccatcctggccaacgcagtaaaaccctgtctctactaaaaatacaaaaaattagccgggcatggtggcgggcgcctgtagtcccagctactggaggcggaggttgcagtgagctgagatcacgccattgcactccagcctgggtgacagarcgagactcaaaaaaaaaagaaagaaataaaccgactttttcaactaaaatctttcttgggggatatggtgtcattaattaagattttgctatgggagaatgtctttctacctctccttcatcatagctctgtgtctccttttcaaacattttattcaccctattgaaattcccattgcagaataattgtgtgcccaagaagatgctgcagctggttggtgtcactgccatgtttattgcaagcaaatatgaagaaatgtaccctccagaaattggtgactttgcttttgtgactgacaac

SEQ ID NO: 121707 - DNA, 601 bp, Human
tcccttccaggattctagccgagtcataagaaactgatgttttcaggccagtctgggcgcagtggctcatgcctgtaatcccagcgggcgggtggatcacaaggttaggagatcgagaccatcctggccaacgcagtaaaaccctgtctctactaaaaatacaaaaaattagccgggcatggtggcgggcgcctgtagtcccagctactggaggcggaggttgcagtgagctgagatcacgccattgcactccagcctgggtgacagagcgagactcaaaaaaaaaagaaagaaataaacygactttttcaactaaaatctttcttgggggatatggtgtcattaattaagattttgctatgggagaatgtctttctacctctccttcatcatagctctgtgtctccttttcaaacattttattcaccctattgaaattcccattgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatgga

SEQ ID NO: 121708 - DNA, 601 bp, Human
cacttcaatggagaagtaggcggagtgtggtggctcatgcctgtaatcctagcactttgggaggtcgaggctggtggattacttgaggtcaggagttcaagaccagcctggccaacatggtaaaaccccatctctactaaaaatacaaaaattagctgggcgtggtggtgtgcacctgtaatcccagctacctgggaggttgaggcaggagaatcgcttgaactggggatgtggaagttgcagtgagccgagattgtgccactgcactccagcctgggcaacagagcgagactctgtctcaaaaaaaaaaaaaaaaaaaattgccagaagcagatgaaagacaaccacaggtttaaatgaaaacaagctgaaacaatgcaaactttttatactagatattcgacttaaaaatatctcaatgaagggttagttttctcaaaaaaaaatgaaaaagaaaacaggaaatagccctcaacttatggaaaagaatgaaatctcccattcactgggtagttatgcaaaggctttttcttctaccattttccattaagcagaataaaacttgagaatgagttaggattgtttgttagactataacatg

SEQ ID NO: 121709 - DNA, 601 bp, Human
tccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtcmgtcatctctgaagtccccagaacagtgtttcaaaagggacacatttaccacactgcagcaagttgtaagtacctcagaccacaggccaaacaggcatgttactaagaatggaacaatgtttcccccaagataagtgcacaggactcctagaggaacaaattaaataaggcactaaatcatttgacatacagtagtcacggatattaaatttcctctcttgaacagatagaacctctcaaatgcactacgtggattattcatcttcaaagatataagaatacaataaaatagcacaaaaac

SEQ ID NO: 121710 - DNA, 601 bp, Human
aagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtcagtcatctctgaagtccccagaacagtgtttcaaaagggacacatttaccacactgcagcaagttgtaagtacctcagaccacaggccaaacaggcatgttactaagaatggaacaatgtttcccccaagataagt

SEQ ID NO: 121711 - DNA, 601 bp, Human; identical to SEQ ID NO: 38953

SEQ ID NO: 121712 - DNA, 601 bp, Human; identical to SEQ ID NO: 38954

SEQ ID NO: 121713 - DNA, 601 bp, Human; identical to SEQ ID NO: 38955

SEQ ID NO: 121714 - DNA, 601 bp, Human; identical to SEQ ID NO: 38956

SEQ ID NO: 121715 - DNA, 601 bp, Human
cagattttaaaatttgcattccagataatgcactacaatgtccttgcatgaaatgaaaataatgcatattggccgggcgcggtggctcacgcctgtaatcccagcactttgggaggctgaggtgagtggatcacctgaagtcgggagttccagaccagcctgaccaacatggagaaaccctgtctctactaaaaatacacaattagccaggcgtggtggtgcatgcctgtgatcccagctactagggaggctgaggcagaagaattgcccgaacccaggaggtggaagttgtggtgacccaagatcgtgccactgcactctagcctgggcaacaagagcgagaatctgtctcaaaaaaaaaaaaaaaaaaaaaaaaaaggaaaaagaaaataatgcgtattcacttggcacaactaggaaaaaggcaactttgaccaaaaaaaaatatatatatatataaatatatatatatatacagactctcaaaagccattcagtaatggtggagagttcctctgaattaagcaagtattaatttctctccggagggcatggtgactctctattctgtattacttcatttctccaaaatccattcctc

SEQ ID NO: 121716 - DNA, 601 bp, Human
catgcataccaccatacccagcctcatgctccttttttctttttgagacagagtctcgctctgttgcccaggctggaatgcagtggtgtgatctcatctcactgtaacctccacctcctgcgttcaagcgattctccttgcctcagcctcccaagtagctgggattccaggcgtgtcaccaccacctaatttttgaattttctttttttgtgtgtttgtgtgtgtttttaatgtttgtattttcaaataaagacgaggtttcaccatgttggccaggctggtctccaacctcaagtgatcygcccacctcggcctcccaaagttccagggtgacaggcgtgagctactgtgcctgaccaatacatactcttgaccaagcaattccacttcccagatttatctcactgaaacaatgagacaaaatacaatgtgcaacatacacatatacacccacacccttgatcaatatccatgagcttgtgtatggagtatctacataaataccaggatatatcaatttttttttttttttgagacggagtcttgctctgtcgcccaggctagagtgcagtggtatgatctctgctcaaagcaacctcca

SEQ ID NO: 121717 - DNA, 601 bp, Human
tttgagatggagtctcgctttgtcacccaggctggaatgcagtggcacgatcttggctcaccacaacctctgtctcctggattcaagccattctcctgcctcagcctcccaagtagctgggattacatgcccccaccaccacgactgactaacttttgtatttttagtagaggcagggtttcaccatgttggtcaggctggtcttgaactcctgacctcgtgatccacccgccttggcctcccaaagtgctgggattacaggccgtgagccaccgcgcccgaccaacaattatttatttatttttttgagacagagtctcgctctgtcgcccaggctggtgtagtgacgcaatcttggctcgctgcaagctccgcctcccaggttcatgccattctcctgcctcagcctcccgagtggctgggactataggtgcccaccaccacacccggcttatttttttgtatttttagtagagacatggtttcaccatgttagccaggatggtctcgatctcctgacctcgtgatccgcctgcctcagcctcccaaagtgctgggattacaggcatgagccaccgtgcccggccctgaccgacaattt

SEQ ID NO: 121718 - DNA, 601 bp, Human
cgtctccagccatgaatataggacacaacctagatctgtggataactaaataaaaataaagccccgttctggttagctcggtcactgttttcatacttgctaaacaaaagcagaaaacaacagaactgggacagattatttatagtgacacctttcttggataattacgacccagcagctcatttgaggggcacaagtgattattattcctttgttctaaagttgacaattggggcactaatcaagcatagctgcaaatggaccaagtagtaaagcagtggggaatattaagattagaccragataagtattatcaaaaagaaaataaatcgtctgacaatgagtccttcagtcaaattctgaaagccaaacattctgctgcaggtaactaataaaccaaaccaatgtttattccttcaggccatacctaagatattccatgtggcgctggctgtaacagggaaagtaaagaaagagtcccagcaaatattaaaaaatacagaggttgatctgcgaatatttatacttgtgtatccttaaatgcccttcacttacactctctgtagttactttgatcaaactaatccgtgtacataatttt

SEQ ID NO: 121719 - DNA, 601 bp, Human
agcttcttagagcaagcagagtataaaactgatgcaaactgcattttgcaggtaaaagattctgtgagaaccctgagatactgtatcagacgatgaggaactggcagtagtacaatgaacggtgtagtgaagcgtctccagccatgaatataggacacaacctagatctgtggataactaaataaaaataaagccccgttctggttagctcggtcactgttttcatacttgctaaacaaaagcagaaaacaacagaactgggacagattatttatagtgacacctttcttggataattacracccagcagctcatttgaggggcacaagtgattattattcctttgttctaaagttgacaattggggcactaatcaagcatagctgcaaatggaccaagtagtaaagcagtggggaatattaagattagaccgagataagtattatcaaaaagaaaataaatcgtctgacaatgagtccttcagtcaaattctgaaagccaaacattctgctgcaggtaactaataaaccaaaccaatgtttattccttcaggccatacctaagatattccatgtggcgctggctgtaacagggaaagtaa

SEQ ID NO: 121720 - DNA, 601 bp, Human
taaatgcaatattctggtttagtcaacaagattgataagaattcttaccaaaaggcaaaggctgggtgcaatggctcacacctgtaatcccagcactttgggaggaaaaaataaatggttctacagagtatactgatactaggactttaaaatagtggggggggggaagaaaaacacttttttttttttttaatttggagatggggtctcgctttgttgcccaggttgggctccaactcctgggctcaagcaatcttcctctctcagcttcatgagcaggtggggccttcaggcttgcackagcatgcctggctttttatttagattaggtaatttgaacccctgaaatgggacttgtgcactgaaactcaggacttataacttgtgaaaactctaaccaaccaaactagggattggctctccactgatcttctccattgaggatcataatcaaagggcattcctttcttaggagacttattaaaatgcccctatctgacaggcagaaatcccatgattcttgctttcagtatctttcaaaccactcccctccttcatttctagtatcccaggttgatacagacacttgacacacaacccg

SEQ ID NO: 121721 - DNA, 601 bp, Human
aactaaaaacacacacacacaaaaattagctgggtgtggtggcgggtgcctgtagtcccaactaatcgggaggctgaggtaggagaatggcatgaacccaggaggcggagcttgcagtgagctgagatcccaccactgcactccatccagcctgagggacagagcgagactccatctcaaaaaaaaaaagagtgccaatcttgcccaggacggtggctcaagcctgtaatcctagccaaggtgggtggatattttgaggccaggagttcgagactaacctggccaacatggtgaaactcayctctactaaaagtacaaaaattagcagggtgtggtagcacgtgcctgtagtcccagctataggctgaggtgggaggatcgtttgagcctgggaggcagaggttgcagtgagctatgatggcacctctgcattccagccttggtgacagggggagactctgtcttaaaaaaaaaaaaaaaagtcaatatttcagcattcaagattagaaatgatctataatttagtaggctgggcatggtggctcacacctgtaatcccagcactttgggaggccgaggcaggtggatcatttgaggtcag

SEQ ID NO: 121722 - DNA, 601 bp, Human
tgggaggctgagaggggcagatcacgaggtcagaggatagagaccatcctggctaactaaaaacacacacacacaaaaattagctgggtgtggtggcgggtgcctgtagtcccaactaatcgggaggctgaggtaggagaatggcatgaacccaggaggcggagcttgcagtgagctgagatcccaccactgcactccatccagcctgagggacagagcgagactccatctcaaaaaaaaaaagagtgccaatcttgcccaggacggtggctcaagcctgtaatcctagccaaggtgggtrgatattttgaggccaggagttcgagactaacctggccaacatggtgaaactcatctctactaaaagtacaaaaattagcagggtgtggtagcacgtgcctgtagtcccagctataggctgaggtgggaggatcgtttgagcctgggaggcagaggttgcagtgagctatgatggcacctctgcattccagccttggtgacagggggagactctgtcttaaaaaaaaaaaaaaaagtcaatatttcagcattcaagattagaaatgatctataatttagtaggctgggcatggtggctcac

SEQ ID NO: 121723 - DNA, 601 bp, Human
gcattaataaaactaaaagctagcaattactgtctactttatgctagttactgctttaaaaacaccaacataggctgggcgggtggctcacgcctgtaatcccagcattttgggaggctgaggcaggcggatcacaaggtcaggagttcgagaccagcccggccaatatggtgaaagcccgtctctactaaaaatacaaaaattagctgggtgtggtggcacgctcctgtagtcccagctactcaagaggctgaggcagaagattcgcttgaacccaggaggcagaggttgcagtcagccragacagcaccactacactacactgcactacagcctgggtgacagagcgagactccttcccaaaaagaaaacaacaacaacaaaaaacaccaacatattggctcttttagtcttcactatgaccccaggaaggtaggaaactattgttcccattttacagatgtcagaaccaaaacacaaagccatcccgtaaattgcccaagatcgcaatgcccgatctgtctgtgacagagctaggattccaagcaggcaggtctcgcctagagccagtattctttacaatacttcagatgtctctcat

SEQ ID NO: 121724 - DNA, 601 bp, Human
ggccaacatggtgaaacctcgtctctactaaaaatataaaaattagctgggcgtggaggcacgtgcctgtagtcccagctatttggaaggctgaggcagaaaaatcacttgaactcgggaggcagaggttgtggtgagccgagatcgcgccactgtactccagcctgatgacagagcaagactccgtctccaaaaaaaaaagtcctgggtaatgtatcgagaccttgtctcaaaaaaaaaggaataaaaagtccactattaaactaaagaataaattagttgaaaataaaagccactgttaaaacgaagaaaaaaactttcactattttactgctaataattaatacaggttgtatatcccttaactgaataagcgaccagaggcatttcaaggtttctggattttggaatatttgcatttatataggttcagcatccctaaatctcaaaatccaaaatgctccaacaggcacttcctttgtgtgccatgctggcgctcaaaaaagtttcagatttcagatctttggattagggatactcaatatgtagttcttttgataaaaatgttaggacagaaagtaaaagaactactgctagaaac

SEQ ID NO: 121725 - DNA, 601 bp, Human
gtttattcgtagagaaaacagctgaacatgtcatgtttctagtttatcttattagattctacaaaatttctatgtaatagccttatacaggtggaagatgatgtactgcctacaccaagaagagttttaataggaaacaaatttgctccatgaagctgtgcacagtgattttttctttccttattagacagcaagacggccctaaaatatttgttgacctgcaaactgacatctggaaaactactgtagtgtttttgttttttactgctttttctgattacaaaactaatagcttgtagtaaaaaaaaaaaaaaaactattatagaaatgcaccatatagaaagttaaagttctccataatccctacatccagagaaaaccaactgttacccaacatcacactcttcttttttctttatattgcagtatatgtgagtaaggatgtttcattaagttacaatacttgtttctcaaaagctctcagcagagcctcctggcttaaagctaaacatttgcagcataaactaaacaaagactggtttgtctgtcttcccatcttgttccaagcatgagttaagatggatggtcttcctctagaaaa

SEQ ID NO: 121726 - DNA, 601 bp, Human
cactaacaaactcatagctaaatatgaaaattactactaagaactttaaaggtaacaactgttcaggtgggtgtagttctagtacaagcttaaacatggcagattggacaggcctctgagcagatacagtgtgactttctccaagtttacgaacaactacagtattagttcttctgtactggtaacctaagtatagaaggagacgaaccaattaattaagggaaggcttgtacggtctaccagttctcacttctagcattaaatgaggccattagttacaaattcactgggatatatgacrtggactacttcagcacaatgttttggaaaattcacacaaatttcggttcacaatctattctgattagctttaatatgattttgagaaaagtcttaatcattgtatcttttctaagagcctggcacagaaatcctctgagctactgccactttctaaagaggtacactttaacagaaatgccattcttctctccaaagatgaagtacctgcttactttcattataaaattttgaatatggtttcattgttatgttttatggtacccaggaactgcaataaaagtaactatggctatatgca

SEQ ID NO: 121727 - DNA, 601 bp, Human
cttagagtactatgtaaatatcaggcacatggaagacaaatactttgtggtctaaacttaaaacactatcaatacgcattcgatgagaaataacatcttccacagaaacaccaatttataagcttttagaaaataatttgtcattacaaaggaactatcaaagagctaaaagaacagatatttggctgggcgcagtaactcatgcccgtaatcccagcactttgggaggccgaggtgggcggatcacttgcggtcaggagtttgagaccagcctggccaacatggcgcaaccaaatccccrtctctactaaaagaacaaaaattagccaggcgtggtggtgggcacctgtaatcccagctactcgggaggctgaggaaggagaatcggttgaacccaggaggtggaggctgcagtgaaccaagatcatgccactgcactccagcctgggagacagagagactgtctcaaaaaagaaagaaaatctactttcagagtatttccttaagcaagagtgaggctggaggcatgatgtttggaggtacttatctatagcctttcacagaatgtcaaagaagtgtcataagtattctgaagctcttc

SEQ ID NO: 121728 - DNA, 601 bp, Human
gcagtgttttgaggtccatttaggaaaaaaatctactaactacttatttacttaggtcaattctcacagggaaaaagcatctctcatttttcagaagacagagcagtctgaaaacatcgaaattgtttttatttggtagttttgagcctaacacccaaacttctaatggcagaccatgaagagtaaaatcaaacgaatcttgtactggccacctttatttttaggacattctctggcagttctagtatcaaatgattgctataatgagaatatgtgagctccacaagctggcaggtgtccracaccaaccccactgcagctccatctgctgcccacccagaggcttatgtttacagtgggaaaagtccatcaagggggcagaaacgaatggctcatcttacgctagatctcctacggttaactttctcaaaacaaaacaaacaaaaaacaaaaccccgaaacctctaaattagaaccatttaaatcttcctggacagaactttatatccaagaaattctaaatcctactttaatgaattctactttgctataaataatggtacagaaaagtcagctattcttttactcagaataaatcagt

SEQ ID NO: 121729 - DNA, 601 bp, Human
cagtttgttctggacaccatatttcataatctattcctgtcacaaagtatgtgtatctgtttgatttgggggaaagggaaggctattttccatcccatagatctcctggtttctaattttaagagccaagagtcccattctcaaagatagggtagcacctcacctaaactatcttctttggtcaatgtgtgccctgtacccactcataaataaggaactgccaggtcacaggtcacctctaaaatcagttacagaggataggctacttttacttccacacagtctcatttcattttctgcytctaaactttctccatggagtatcttttctactctggaaagctatgtggattgtggtgaggagagtgatagatacactgtctattatttcaggaaaccaaaagtacaacaaatgcaaggaatgttatactctatttacaaaatgctttactaagtctcacgcttattaaatcacaactctgaatttttgctgagcttaagagcaaactagcgggccgggcatggtggctcacgcctgtaatcccagcactttgggaggccgaggagggtggatcaccaaaagtcaagagatcgagaccat

SEQ ID NO: 121730 - DNA, 601 bp, Human
aaaaaaagacacagttgtaccttgtattcatgggggactggttccaggacccctgcatatacccaaatctgtgcatactcaagtcccacagttggccctctgcgtaagtgggctgtgcatcctgtgaatactgtctttttgacacacatgtagactgaaaaaaatccgtgtataagcggaaccatgcagctcaaacctctgttgctcaagggtcaactgtacctcctttactggttgggcttctgtatttcctcgagtttctatgcccttaaaaaaaaaaaccatttttaccgggcgcggkggctcacacctgtaattccagcactttgggaggccaaggcaggcagatcatgaggtcaggggttcaagaccagcctgacaacacggtgaaaccccgcctctactaaaaacacaaaaattcgccaggtgtggtggcacatgcctgtaatcccagctactcaggaggctgaggcaggagaatcgcttgaacctgggaggcagaggttgcagtgagccgagactgtgccactgcactccagcctgggcaacaacaaaaaaaattctggccaggtacagtggctcatgcctgtaatcccagcac

SEQ ID NO: 121731 - DNA, 601 bp, Human
tgcagctacagcctggtatcactcagcctttatgatcccctctatgcagtaaaagtgttttaatgtcacggatgtctatgtataataaatcaataatgattaaggctatcaactctgaactgactagcaccaaaatttccagttttctctagttgaattttcatcatcaagctcacaagaccgttctctgggagaaaaagttaacttttttttttttttttttaaaaagacatagttggccaggcacagtggctcacgcctgtaatcccagcactttgggaggccgaggtgggtggatcaraaggtcaggagatcgagaccatcctggctaacatagtgaaaccctgtctctgctaaaaatacaaaaaattagctgggcgtgctggcgggcacctgtagtcccagctactcgggaggctgaggcaggagaatggcgtgaacccgggaggcggagcttgcagtgagccgagatcgcgccactgcacttcagcctgggcgacagagcaagactccgtctcaaaaaaaaaaaaaaaaagacacagttgtaccttgtattcatgggggactggttccaggacccctgcatatacccaaatctgtg

SEQ ID NO: 121732 - DNA, 601 bp, Human
gttctatgagtccagagtgctctgtatgaaagcacatcttggggagaccgaatctaatcaatgcaaggaaagctcacttgggcggtaacatttatttatttatttttattttttttgagacggagtctcgctctgttgcacaggctggagtgcagtggcgcgatctcggctcactgcaagctccgcctcctgggttcacaccattctcctgcctcaacctcccaaatagctggaactacaggcacccgtcaccacgcgcagctaatttttttgtattttcagtagagacagggtttcaccrtgttagccaggatggtctcgatctcctgacctcgtgatccgcccaccttggcctcccaaagtgctgggattacaggcgtgaagcaccgtgcctggccacttgggtggtaatatttgaatggaaaccctcagtgtaagtaggctgtagtgaggcttgggggcgggcattgaggacacaaatgagagcaagaaacattccaggcagaggaatgcgcaggtgcaaaagttctcaggcaggaagggatgtggcatagtctaggggagaccagggacagagaactgagcccgactgtgcagggca

SEQ ID NO: 121733 - DNA, 601 bp, Human
aaccatgctggccatgttactaaaactactgcctaacagataagacaagctgtcctccctgttgcctttagcctgctaaggctgtaaaacctgagagcccagaaaccttcgaggacacatgtaggcttgcccagaataactagatcaaggggctggttcgagccttctgttttcataactcagacttttttttttttttttttttttgagacagagtcttactctgttgcccaggctggactgcagtgatgcgatcttggcccactgcaacccccgcaccctctgcctcctgggttcaagygattctcctgcatcagcctcccaagtagctaggattgcaggcgcccaccaccacgcctggctaatttttgtattttaagttgagacgaggtttgaccattttggccaagctggtcttgaactcctgacctcaggtgatccacccgcctcagcctcccaaagtttgtaatcctgggattacaggcgtgagccaccacaccctgctgactcagacatctgatggccacccactgcctcactttggatgatcatattggcaaagatgaaaataagttaatacttagtgatagggatagtatcg

SEQ ID NO: 121734 - DNA, 601 bp, Human
ccataatgcccagccctattctgtttactattaaaagttgagaaagggggtgaaggtataaaaacctcagatttgtaatctgaccattactagactggcataatgacttgcagtagctgcccctttgaattgcactttagatattgttcaagtgtctactacactgaaagcattgtgttaggaagctgaaaagggaataagaataaaaggcatggtccctgccctcagaagtgtttatgagctaagggagctatgtgtgtaaataaagaggaaataagtaaaaaagtgagataagggaaaytgctgattttgagctggacacagaattcaccgctacatgtttctatttacttttcagttttagagacagggtcttactctgttacccaggctagacaatgcagtggcacaatctctgctcactgcagcctctgcctcctaggccaagtgaacttcccacctcagtctcctgagtagctgggactacaggtgcacgccgccacgcctggataatttttgtattttttgtagagatgcggttttcccatgttgtccaggctggtttcgaactcctgagttcaagcaatccgcccacctcagc

SEQ ID NO: 121735 - DNA, 601 bp, Human
attgttttgtatttttagtagagatggagtttcgccatgttggccagggtggtcttgaactactgacctcaggcgatccacccgccttggcctcccaaagtgctgggattacaggcgttagccacggtgcctggcccttgcacttaattttctatacaaattatagaaaaaggtgtcatttagaaaaatggcaagtattttgtttatagattgctgcattttgaaataaggggatattttctggcctgaacatattcagtcatctgtaaatgaataaaaaatagaaatcataatttttttwaaaagaaataggctgtacagttacggtcccatcaagcctttcaacacgcgctccaattccaacagcttgcagaaaagttcaacatttcttcagggaaaaattattcaaagttttatcaatctgtgaagcaatttgtgtgagaacatttgtgcatgaatgataggaagaattacattttaaagctcttaacacgtaaaaaaccaaaaacaccatttatagttggtccctgcagtgcagaaattcaacataagccagtgaggtgtccccggttcttcaaagaacccagataaaactagtcta

SEQ ID NO: 121736 - DNA, 601 bp, Human
cggtctcgatctgacctcgtgatccgcctgcctcggcctccaaaagtgctgggattataggcgtgagccactgcgcccggcctacttttactactactactactactactactactactactactactactattattattattattattattattattattattattatttatggagacagagtctcactctgttgcccaggctggagtgcagtggcacaatctcggctcactgcaacctccgcctcccaggttcaagtgattctctgcctcagcctctggggattacaggcacccgccaycacgcctggctaatttttgtatttttagcagagatggggtttcaccatattggtcaggctggtcttgaacctctgacctcaggtgatttgcctgccttggcctcctgagtagctaggattacaggcgcctgtcaccatgctcagctaatttttgtatttttcatagagacggggtttcaccatgttggccaggctggtctcgaactcctggcctcaggtgatctgcccaccttggcctcccaaagtgctgggattacaggcatgagccaccgtgcccggccacaaataatttttaaaggc

SEQ ID NO: 121737 - DNA, 601 bp, Human
gcctcctaggttcaggccattctcctgcctcagcctcccgagtagctgggactacaggcgtctgcaaccacgcccagctaattttttatatttttagtagagacgggtttcactgtgttagccaggacggtctcgatctgacctcgtgatccgcctgcctcggcctccaaaagtgctgggattataggcgtgagccactgcgcccggcctacttttactactactactactactactactactactactactactactattattattattattattattattattattattattatttatkgagacagagtctcactctgttgcccaggctggagtgcagtggcacaatctcggctcactgcaacctccgcctcccaggttcaagtgattctctgcctcagcctctggggattacaggcacccgccaccacgcctggctaatttttgtatttttagcagagatggggtttcaccatattggtcaggctggtcttgaacctctgacctcaggtgatttgcctgccttggcctcctgagtagctaggattacaggcgcctgtcaccatgctcagctaatttttgtatttttcatagagacggg

SEQ ID NO: 121738 - DNA, 601 bp, Human
gctggagtgcagtggcacaatctcggctcactgcaaggtccgcctcctaggttcaggccattctcctgcctcagcctcccgagtagctgggactacaggcgtctgcaaccacgcccagctaattttttatatttttagtagagacgggtttcactgtgttagccaggacggtctcgatctgacctcgtgatccgcctgcctcggcctccaaaagtgctgggattataggcgtgagccactgcgcccggcctacttttactactactactactactactactactactactactactactaytattattattattattattattattattattattatttatggagacagagtctcactctgttgcccaggctggagtgcagtggcacaatctcggctcactgcaacctccgcctcccaggttcaagtgattctctgcctcagcctctggggattacaggcacccgccaccacgcctggctaatttttgtatttttagcagagatggggtttcaccatattggtcaggctggtcttgaacctctgacctcaggtgatttgcctgccttggcctcctgagtagctaggattacaggcgcctgt

SEQ ID NO: 121739 - DNA, 601 bp, Human
gccggaggcaaaacacaggatgaacaatgcagctgcaaccctgagccagagaccaggcctttcaacccaactgctccacctgcactgggagcttgcacacacaagccctgaaactggagtgatgtaattagatgcttaaaaattaagttttattcaaatgtttaagtatacaaaacagctactgaagtgtcgggttaaaaaaaaaaaagaaagaaaaagaaaacaaaacagcaaagaacacaaatgaatgttgaagagctcgaggtggcagagaccagaagcatctgaggatgaggctgcrcctacaaagattgtttcatttgctgtggctttaggtgaaagctcacatccttcacaaataatttttattttattactgttactatttttttttttttttgagatggagtctcgctctgtcgcccaggctggagtgcagtggcacaatctcggctcactgcaaggtccgcctcctaggttcaggccattctcctgcctcagcctcccgagtagctgggactacaggcgtctgcaaccacgcccagctaattttttatatttttagtagagacgggtttcactgtgttagccaggacggtct

SEQ ID NO: 121740 - DNA, 601 bp, Human
ttcaggctcccaaacatctggaatgaaaccctcagtaaggaaggagaaagaagaatggcaagtattagttgttttttttttttaagacggagtcttgctctgtcgcccaggctgaagtgcagtggcgcgatcttggctcactgcaacctccacctcctgggttcaggcgattctcctgccacagcctcccgagtagctgggattacaggcgcatgccacgttgcccagctaatttttgtatttttagtagagatggggtttcaccatgttggccaggctggtcttgaactcctggcctcakgtgatctgcccaccttggcctctcaaattgctgggattataggtgtgagccactgtgcccggccagtttttttgtttggtttggtttttctaagagagaaacctggagaagaggttctggaaaatggcaaacacataggagaataagggagcctgacgaagacaaagtctactttctgggagagagaggtgtcacagcagaactaagcagcaacagaaccttttattagactcctctagagatcttccaaccgacctccagaatctacagtgatacagtcctggatcccctcatggcttc

SEQ ID NO: 121741 - DNA, 601 bp, Human
tttattttttgagacagagtcttgctttgttgaataggctggagtgcagtggcgtgatcttggcttgctgcaagctctaacaggcaaatgttttgaaagtctttaaaaagatgggctttgggccgggtgtggtggctcacacctgtaatcccagcactttgggaggccgaggcgggcggatcaggaggtcaggagattgagaccatcctgaccaacacagtgaaaccccatctctactaaaaatacaaaaattagccaggcatggtggcacatgcctgtaatcccagctactcaggaggtsgaggcaggagaatcccttgaaccagggagttgggggttgcagtgagccgagatcgcgccacagcactctagcctggcgacagagcgagactccatctcaaacaaacaaacaaacaaacaaacaaaagatgggctttggcagggtgcggtggcttacacctgtaatcccagcactttaggccaagagctcgagatcagcttggccaacacagtgaaaccccatctctactaaaaatacaacaattcgacgggagtggaggcacgcgcctgtagtcccagctactcggcaggctgaggcaca

SEQ ID NO: 121742 - DNA, 601 bp, Human
tggaccaaatagtccattaaagttgtaaatctaacttacatatcttttcttttttttttttttttgaggagtctagctctgtcacccaggctggagtgcagtggcacgatctcgctcactgcaagctctgcctcccgggttcacgccattctcctgcctcagcctcccaagtagctgagcagctgggactatacataggcgcccgccaccatgcccggctaatattttgtatttttagtaaagatggggtttcaccgtgttagccaggatggtctcgatctcctgaccttgttgatccgcstgccttggcctcccaaagtgctgggattacaggcatgagccactacgcccggcccttttttttttagatagagtctcactctgtcatcaaggctggagtgcagtggcacgatctcggctcactgcaaccttcgcctcctgggttcaagcaattctcctgcctcagcttccctagtagctgggattacaggcggccaccaccacgcccagctaatttttgtatttttaatagagacggggtttcaccatattggccaggctggtcttgaactcccgacctcgagatctgcccgcctcagcc

SEQ ID NO: 121743 - DNA, 601 bp, Human
gaagcaactggctgtggcttatcaagaggaagaggagaggaacacttctacaagagcttcaagtcaagctgcctcactatttcaaatgaaaactataattaggaagaagaaactgtgaaaaccatgttctcttctcaaaattgtctttagttatcatttttaaaagcaaaagttatagcaaataaagacctataaacatggaaactggcattcatttaatatgctaattataatatcaaaagtccttttaatggaccaaatagtccattaaagttgtaaatctaacttacatatcttttcttttttttttttttttgaggagtctagctctgtcacccaggctggagtgcagtggcacgatctcgctcactgcaagctctgcctcccgggttcacgccattctcctgcctcagcctcccaagtagctgagcagctgggactatacataggcgcccgccaccatgcccggctaatattttgtatttttagtaaagatggggtttcaccgtgttagccaggatggtctcgatctcctgaccttgttgatccgcctgccttggcctcccaaagtgctgggattacaggcatgagccactacgcc

SEQ ID NO: 121744 - DNA, 601 bp, Human
gattcttgaaccttttttgcagaggtgtgtgtgttgttaaagagagtcatgacacctgctttgcttctaaaacaataaatgcattaaatccttaaaagattctacttgagaaaatggaagtttgagagtttctgctgagcaaacaggcagcgtccagccgagcacgtggctgcccccgtggttttggccaccacccagtgatttactgcttgttcccctcatcttataaggtttcagttacacttgggtcagtataaaactaaagaaagacaggtgtcacacatgtttttcttttcttttytttttttttttaaagatggatggagtcttgctctttcacccaggctggaatgcaatggctcagtctcggctcactgcaacctctgcctcctaggttcaagtgattctcctgcttcagcctccggagtagctgggaatacaggcatgtgccaccacgcctggctaatttttgtatttttttagtagggacagtgtttcaccatattggtcaggctggtctcaaactcctgacctcatgatcggcccgcctcagcctcctaaagggctgggattacaggcatgagccaccatgccgggccac

SEQ ID NO: 121745 - DNA, 601 bp, Human
caacatccagaaaccagagagggacaggccatcagtcattctcattctgaagatgtttgtaagataaagagtccaggccgggtgcggtggctcacacctgtaatcccaacactttggaggccgtggtgggcagatcacctgaggtcgggagttcgagaccagcctggccaacatggagaaatcccatctctactaaaaatacaaaagtagctgggcatgatggtgcatgcctgtaatcccagctactcgggaggctgaggcaggagaatcacttgaacctgggaggccgaggttgtggtgrgctgagatcgcgccattgcactccaacctgggtaacaagagtgaaactctgtctcaaaaaaaaaaaaaaaaagagtccatgtgccctgaaccctaccaaataaaaacagccgtacttaagacaaaggagtgtgacttaacatcctttgaataaaaaaataattaaaatcttatatgcaggaagaaggtgaggagggctggaaatactttcaacaattctctcgtaactgggaatagttcaaagtaatgttttccattcaggaattttagctccactcatggggaaaaggtctctgaacaa

SEQ ID NO: 121746 - DNA, 601 bp, Human
gcttgtgggtttaattcttttgtatgtgttttacatttttcactttctttaaataattgcttcttgactcttagacgttccggttcacgggggtgacataattgcggggaaacatgccggtctgcccgtggcaagctcctttccaccagttggggtctgagttatccatgacatggataaaatctccccggcggaagcccagctctccatcctcctggggatcaaagtcaaagagggcctggacgtatgtcggctgctgcaaaacaggagcaggaaaaacccacattgcattcctggtctstgactggccacctccgaggccagatgggttccagggggaaacgaatgcgtgccaaattctccatgtttcttaaactcacctcccatctcccaaccccccgtttattcttacctattctaagtttacaggccaagcgggtttagtgtgatatttcccagtgctcagaaaatattagagtatgtctcccagaggagggtggccaactgtgccgtattatcaagtagagggcaggcagtgcttggaggagaaagttcttcagaaacagccatctgtgtttaggccgtgggcccagaatcgcaa

SEQ ID NO: 121747 - DNA, 601 bp, Human
gtgggatgtgggagagctgggcggtcaccttccctcttgccccggtggcccatcacactcacactgcaccctgggcaagcagttccctgaacccccaaggggctcacaacccttaaagctggagcttaaagcctcctggcttagtacaagcaggagaacgcctcaccttccactcctgcttgtctcctttgctctaccctggctcccctgcccggagggaaaaatatttacacagagtaggagacaaattggctgaaaagctctggactgtctttaacttattttaaaacaaaacaaattaaaaaaaaaaaaaacaccactcagaagcaacccttgaaataaggaaaaaggcactatgaaaaaacaacatgctcgataatcccactggaagggccaacaaagtggaaagagacaggctttcaggtgggctttttttttttttttttgagacggaatctcgctctgtcacccaggctggagtacaatggcacggtcccggctcactcaacctccacttcccaggttcaagcgattctcctgcctcaggctcccaagtagctgggactacaggtgcgtgccaccacacccggctaatttctta

SEQ ID NO: 121748 - DNA, 601 bp, Human
ggcttccgacccccctgtaagccagatccagtgggatgtgggagagctgggcggtcaccttccctcttgccccggtggcccatcacactcacactgcaccctgggcaagcagttccctgaacccccaaggggctcacaacccttaaagctggagcttaaagcctcctggcttagtacaagcaggagaacgcctcaccttccactcctgcttgtctcctttgctctaccctggctcccctgcccggagggaaaaatatttacacagagtaggagacaaattggctgaaaagctctggactgyctttaacttattttaaaacaaaacaaattaaaaaaaaaaaaaacaccactcagaagcaacccttgaaataaggaaaaaggcactatgaaaaaacaacatgctcgataatcccactggaagggccaacaaagtggaaagagacaggctttcaggtgggctttttttttttttttttgagacggaatctcgctctgtcacccaggctggagtacaatggcacggtcccggctcactcaacctccacttcccaggttcaagcgattctcctgcctcaggctcccaagtagctgggactacagg

SEQ ID NO: 121749 - DNA, 601 bp, Human
atttctgcttatttttcgtgagctattcattgacccacctgagtgtttagagctgacttctataactgtttaaaacttaccaatattttaagtattgtctctgcaccctactgtctaatatacttggggattcacaactggcaatctaaaaataataaaagttttttatttctgataggtttttgagttccagttgactgcagaggacatgaaagccatagatggcctagacagaaatctccactattttaacagtgataggtaagtttcctttgtaaatgggtgatctaatttatttctrgagaaggaatgtaggatgggtgttgagagtgacctccataccagagggacagaggccaatgtgagtcagaggtgagactggaactctcctgctggattcactccagagctctgttctctggcagggtgagtgggcagggatcagcatgggtcaacctgtgcctctgctctcctgactccatggaactttccagagcagccaacatcattgccaagtctgcacgttccatataggcctggtgtttctaccactggacatgctgtggatactgcccatgtgacttcattagatgtttccaaa

SEQ ID NO: 121750 - DNA, 601 bp, Human
aatcccccagccctagccaaccaaactactttccatctccatggatttgcgtattctggacattgcatagaaatggaattatataatatgtggcctttcatgtgtagcttcttccacttagcatgtttttaaagttcatctatagtgtagcatgtatcagtatttcgttccttttgttgttgttgtttagagacagagtctcatgctatgacctgggccagagtgcagcggtgcaatcctagctcactgtagcctcaaagtcctgagctcaaacaagcctcccatctcagcctccagagtrgctgggactaccggggcacaccaccacaccaggctaatttttaaaaattttttgagagaagttggtgggaggtgaaaaaaaaaattttttttttttggtagagccagggtctggctatgttgcccaggctagtctcaaactcctggctttaagcgattctccagcctcgggctcccaaagtgctgggattaccggtgtgagccaccatgccctgcccagtactttattctttttattgccaaataatattccattatatggctataacacattttgtttgctcattcatcagttgatgaa

SEQ ID NO: 121751 - DNA, 601 bp, Human
ctctgcagggagtgtagccctgctggcagcttgattttggtccattcatacttattctagatccagaatggggaaagaataagtttctgttgttttaagccaggaagtgtgtgggtatttgtcactgtagccacaggaaatgaaaacataccctctaaaatttttaaaataacagattcattgagatatagttcacatgccataccatttacctatttaaagcgtgcaattcaatggtgtttcatatattcagagttgtgcaaccatcaccccaatcaattttagaacattttcattatcycaaaaagaaacctgtattctttagctatcttgcctaatcccccagccctagccaaccaaactactttccatctccatggatttgcgtattctggacattgcatagaaatggaattatataatatgtggcctttcatgtgtagcttcttccacttagcatgtttttaaagttcatctatagtgtagcatgtatcagtatttcgttccttttgttgttgttgtttagagacagagtctcatgctatgacctgggccagagtgcagcggtgcaatcctagctcactgtagcctcaaagtcctg

SEQ ID NO: 121752 - DNA, 601 bp, Human
tgccctatatggtgtcttagtttgtttggactgggtgccttagaaacaacaaaaatgggccgggccgcggtggctcacgcctgtaatcccagcactttgggaggctgaggcaggtggatcacctgaggttgggagttcaagatcagcttgaccaacacagagaaaccccatctctactaaaaacacaaaattagccaggcatggtggctcatgcctgtaatcccagttactcagctggctgaggcaggagaatcgcttgaacccgggaggcggaggtttcaatgagctgaaattgtgccaytgcactccagcctgggcaacaagaatgagactccatctcaaaaaaaaaaaaaaaaaagaaacaacaaaaatgtatttctcacagttctggagtttgggaagtccagcatcaaagctccagcagctccagtgtctggtgaggcctacttcctcatttatagatggctgtctctctgctgtgtcctcacatgatggaaaggactagggaattcttttcttgccttttttttttttttttctgttttgagaaggagtcttgccctgtcacccgggctggagtgcagtggcgcggtctcggctg

SEQ ID NO: 121753 - DNA, 601 bp, Human
gttctagaccaaagatttttctattgtggagtatttcaagaagtcctgaaatgtttttctttctgttttgtgtttttttttttttttgagacagagtctcactctgtcacccaggcttgtgtgcgatggcgtgatctcggctcacctctgcctcccgggttcaagcaattctcctgcttcagcctcccgagtagctgggattacaggcgtgcaccactatgctcagctaattttttgtatttttagtagagatggggtttcatcatgttagccaggctagtctcaaactcctgacctcagrcgatccacctgccttggcctctcaaagtgctgggattacaggtgtgagccaccgcaccgggccctgaaatgtttttcttccagaggccctgtgtgaggaattagggctcagggctgaaggcaggcagccagcatcaccacttcagctgtgggatcgtggacaagagtactaacctctctgagagtcttgtttctctcttgtaaaaagagggtaataacagtaactgactcataggattaaaggaaacgtgagaaatatgtaagcactcaataaatattagttattattatttaaataaaa

SEQ ID NO: 121754 - DNA, 601 bp, Human
caagatcttttctaggtgcaaaatgttcctgtttgttttccgtttagaatttccccttattgggagcatattttctccctctcaccctcagagaaaatttccaggttccttccacattctaaagagcaatgtgaaaattcaaggttttctgttttgttttgttttgttttttttgagactaaatctcggtctattgcccaggctggagtgcagtggtgcaatctcagctcactgcgacctccacctcccgggttcaagcgaattctcctgcctcagcctcctgagtagctgggcccacggmacgtgccaccacacctggctaatttttgtgtttttagtagagacagggtttcaccatgttggcaaggctggtctccaactcctgacctcaagtgatcctcctgcctcagcctccaaaagtgctgggattacaggtgtgagccatggcatccagccctattttttaaatagaaatatttttattgagataatagtacatttgcatgcatttgcagtaaataatacagagatatgtgccagtttcccctaatggtaacattttgcaaagctacagtacaccatcacaaccaagttttctggg

SEQ ID NO: 121755 - DNA, 601 bp, Human
tttcatttaggagctgaggcttgtcaatgcatctcacaatgatttgcagaaatcccctttacctccctgaatatacaagatcttttctaggtgcaaaatgttcctgtttgttttccgtttagaatttccccttattgggagcatattttctccctctcaccctcagagaaaatttccaggttccttccacattctaaagagcaatgtgaaaattcaaggttttctgttttgttttgttttgttttttttgagactaaatctcggtctattgcccaggctggagtgcagtggtgcaatctcrgctcactgcgacctccacctcccgggttcaagcgaattctcctgcctcagcctcctgagtagctgggcccacggcacgtgccaccacacctggctaatttttgtgtttttagtagagacagggtttcaccatgttggcaaggctggtctccaactcctgacctcaagtgatcctcctgcctcagcctccaaaagtgctgggattacaggtgtgagccatggcatccagccctattttttaaatagaaatatttttattgagataatagtacatttgcatgcatttgcagtaaataataca

SEQ ID NO: 121756 - DNA, 601 bp, Human
ccatccctgccgggcgcagtgactaattcctgtaatcccagcactttgggaggccaaggcgggtggatcacttgaggtcaggagttcgagaccatcctggccaacatggtaaaaccccatctctactaaaaatacaaaagtaagctgggcatggtggcaggtgcctgtaatcccagctactcagcaggctgaggaagaaaattgcttgaacccaggaggtggaggttgcagtgagctgagatcacaccactgcactccagcctgggtgacagagcaagactctgtctgtctcaaaaaaaaragagagagagagagagaatgcatctccttccttcttgaaatgcccagattgccgtggtcatatcattgatgagctaagtaatgggattcttgggcttataagtttacagtggctgaagcctccactgtatggggcagtttttgtgaaatcctctagtaccggaatggcaccatggaagtggaaggaatagagtggaatgtcattgagtcttcctcattcaaaaaaaagagcccctttgcagatatagctgtccatatccatgggttccagattcatggattcaaccaaccgtggatagaa

SEQ ID NO: 121757 - DNA, 601 bp, Human
tcattatttgtattttataaatctcattattgggaatattttatccaaaatagcattaactaagtagtcaatgatttttctatttgtatttatatgtatatttgattaattaaagtccccagtagataagggacaaccttgctaaattgataaaactccatccctgccgggcgcagtgactaattcctgtaatcccagcactttgggaggccaaggcgggtggatcacttgaggtcaggagttcgagaccatcctggccaacatggtaaaaccccatctctactaaaaatacaaaagtaaactgggcatggtggcaggtgcctgtaatcccagctactcagcaggctgaggaagaaaattgcttgaacccaggaggtggaggttgcagtgagctgagatcacaccactgcactccagcctgggtgacagagcaagactctgtctgtctcaaaaaaaagagagagagagagagagaatgcatctccttccttcttgaaatgcccagattgccgtggtcatatcattgatgagctaagtaatgggattcttgggcttataagtttacagtggctgaagcctccactgtatggggcagtttttg

SEQ ID NO: 121758 - DNA, 601 bp, Human
gttgaagttcccttcagaaataccctcctgcttcaagcctatagagggtaaaccaaatgaggtgctcgttaaaagaatttagtccttacatgaaaaataccatcaaatgtatgtagagtttcttttagtcctgcagaaatgcatacctgataccttgattatcacagagaaaaatgtttttggctactttaaaatgttccataattctgagcaggctggcagtcctaccttttcaccatcaaaaaccccccattatttttattatgtatttatttattttatgttttgaggcagggtctcrctctgttgcccaggctggagtgcagtggcacaaccatggctcactacagccttgaactccagggcctcatcctcccaactcagcctccctaatagctgggactacaggcatgcaccaccaagcccagctaattgttttgttttgttttgttgttgtttgtttgttttagtgatggagtctcactatgctgcccaggccagtctcaaactcctggactcatgtgatcctcctgcctctgcctcccaaagtgttgtgattataggcatgagccaacactcctggccccttcattatttgtat

SEQ ID NO: 121759 - DNA, 601 bp, Human
agagcaagactctgtctcaaacaaacaaacaaacaaaacaaacagacaagaaacaagttgaagttcccttcagaaataccctcctgcttcaagcctatagagggtaaaccaaatgaggtgctcgttaaaagaatttagtccttacatgaaaaataccatcaaatgtatgtagagtttcttttagtcctgcagaaatgcatacctgataccttgattatcacagagaaaaatgtttttggctactttaaaatgttccataattctgagcaggctggcagtcctaccttttcaccatcaaaamccccccattatttttattatgtatttatttattttatgttttgaggcagggtctcgctctgttgcccaggctggagtgcagtggcacaaccatggctcactacagccttgaactccagggcctcatcctcccaactcagcctccctaatagctgggactacaggcatgcaccaccaagcccagctaattgttttgttttgttttgttgttgtttgtttgttttagtgatggagtctcactatgctgcccaggccagtctcaaactcctggactcatgtgatcctcctgcctctgcctccc

SEQ ID NO: 121760 - DNA, 601 bp, Human
tgtaaaagtgaaataagcactgggagcgtccaaagctattttaaaggtgttgggggtggccaggtgcagtggctctcgcctgtaatcccagcaccttgggaagctgaggcgggtggatcgacttgaggccaggagtttgagaccagcttgggcaacatggtaaaaccccgtctctactaaaaatacaaaaagttagctaggcatggtggtgcacccctgtaatcccaggtacttgggaggctgaggcacgagaatcacttgaacccacgaggtggaggttgctctgtctcaaaaaaaaaaraaaaaagcgtttaggagaagctgcggctgataaattacaaatagatgggttttcgtctgacctgctaatcttccactagatggcgtcattgtcaagtgtctgtaatttcaaaagcgctagggaggaaagactgcccattaattgtttatgccttaacactttatttttattttcgcttgtttttcttttgagtcacttgaaattaaagaaaaaaaagctgaggccaggcacagcggctcactcctgtaatcccagcactttgggaggccagtgaggaaggatcgcgtgagcccaggaatt

SEQ ID NO: 121761 - DNA, 601 bp, Human
aaaaaaaagataaggccttagccacttagctagggtgccgggcaatttctagtactcttcccagaaggagcctaaagcagtcaatttcgagcttgcaaaggcttttagctgctcaagttaatttttagagctaaatatgatatgaacctccaaaattcccacccttcagatggcagaagccaagagaaagtaccctgacatggtcacagggttaaaggatcaagctcccgcctcacctccccgagtagctgggattacgggtgcttgccaccatgcccggctgattttttttttttttttwaattttagtagagatgaggtcttgctatatttcccaggctggtcttgaactcctgagctcaagcgatcctcccacatcagcctcccaaaatgctgggattacaggggtacaccaccatgcccagctgaaattacccttttaaaccaaagccaataaggatctgggtaggcccttagctgccagcagaagtgacctatcctaagagatgatttgtcaagattttgttagtggagagaagacgattccagaaaatctgggtgtttaccacaggctgagcacaaggaaggaaggaaggctttg

SEQ ID NO: 121762 - DNA, 601 bp, Human
ctggtgtgtgtggtattttcaaagaggtggtaagcagttgttacaaggatctagaatcgccaaatgtagcccagagaaaggaaaattcaagatgggaagtcagaagttgttcatggtagggaagataattaataactggcaaaagtcacacagacagcaaaccagaaagcacttattccctaagccgggaattgaaccgaggccaccactgtgaaaaaaaagataaggccttagccacttagctagggtgccgggcaatttctagtactcttcccagaaggagcctaaagcagtcaatttygagcttgcaaaggcttttagctgctcaagttaatttttagagctaaatatgatatgaacctccaaaattcccacccttcagatggcagaagccaagagaaagtaccctgacatggtcacagggttaaaggatcaagctcccgcctcacctccccgagtagctgggattacgggtgcttgccaccatgcccggctgatttttttttttttttttaattttagtagagatgaggtcttgctatatttcccaggctggtcttgaactcctgagctcaagcgatcctcccacatcagcctccca

SEQ ID NO: 121763 - DNA, 601 bp, Human
taatgtaatctctcataccctaaatgtaaaaaacatcaggtaacacaatgcaaaacagagcagagcctgacttttaaccaaatctcttattaccactctagccaggacaaatagctgatattcctggcttttggacttgaccaaaggtaaccttccaggtgaaacgaataagacttaactaggattatgacttaaccatggatgtgcatttttttgttttttttttttgtttgtttgttttgtttttttttgagatggagtcttggtctgttgcccaggcgagagtgcagtggcacgcacratctcagctcactgcaacctctgtctcctaggctcaagctatcctcttacgtcagcccccctagtagctgggattacaggcatgcgcaaccacgcccagcgaatttttgtatttttagtagagatggggtttcttcatgttggccaggctggtctcaaacttctgacctcaggggatccacccgcctcggcctctttttaaagtgctgggattacaggtgtgagccactgtgtccggcatgtgtggtattttcaaagagtgcagtggcacgcacgatctcagctcactgcaacctctgtc

SEQ ID NO: 121764 - DNA, 601 bp, Human
agcaggcttggatccccaaataaagggaatcaggctatcccttataggagtcttatctctcagtgggggtgggtgggtatgtttccataccttctaggtggtcaagagcatgcttctctgatccaaacatgcaaagaactgagtactcccctataactgccattagccatcccttgaagtatatttcctacctagttattacacattaaggctaaaagctctctcataatgtaatctctcataccctaaatgtaaaaaacatcaggtaacacaatgcaaaacagagcagagcctgacttttaaccaaatctcttattaccactctagccaggacaaatagctgatattcctggcttttggacttgaccaaaggtaaccttccaggtgaaacgaataagacttaactaggattatgacttaaccatggatgtgcatttttttgttttttttttttgtttgtttgttttgtttttttttgagatggagtcttggtctgttgcccaggcgagagtgcagtggcacgcacaatctcagctcactgcaacctctgtctcctaggctcaagctatcctcttacgtcagcccccctagtagctgggat

SEQ ID NO: 121765 - DNA, 601 bp, Human
ccacaagatcagatgagtcagtttattgacctgggtggtgccagctgatccatcaggagcagggtctgcaaaatacctcaagccctgatcttaggagcagtttagggagggtcagaatcttgcagcctccagctgcatgactcttaaaccataatttctaatcttgtggctaatgttagtcctaaaaaggcaatctagtccccaggcaagaaggaggtctgctttgggaaagggctgttattgtctttgtttgtttgtttgtttgttgtttttgagatggagtcttcgctctgttgcccasgctggagtgcagtggcgggatctcagctcactgcaacctccacctcccaggttcaagcaattgtcctgtgtcagcctcccgagtagctgggactacaggtgcccgccaccacacccagctaatttttgtatttttagtagagacagggtttcaccatattggtcaggctggtctcgaactcctaacctcaggtgatccaccagcctcagcctcccaaagtgctgggattacaggcgtaagctacctcacccagccaccactgcacccgacttatctttgttttaaactataaaccaagtt

SEQ ID NO: 121766 - DNA, 601 bp, Human
cgggcccctgtagtcccaggtactcaggaggctgaggcaggagaatggccggaacccagaaggcggagcttgcagtgagccgagatcccgccactgcactccagcctgggcgacagagccagactccatctcaattaaaaaaaaaaaaaatctggatcaatatctaattctgggacagatggaattggctagcgactccatatcaccttggttccaacagttgtctagttcatggaaagcctccttacttagtttactttagataatttcttaaattgaacacctgttaatcttctaaatmtcaccttttgtcagaactcagagttatgattggccttgaccataccaatgctctctgattaagcttctctctaccctgaatactagagaaactaatagttaggcaggaatgtcatcacccttatttctcctaaagaaattacagatgatggatcctcatcgctctacaacacttaggatgaaaagtctccctgtaaaagggagggggagtgtgtcagaggcactggaacaagaatgactccatcttgagtaggagttgggtaaagtgaggctgagacctgctgggctgcattcctaggag

SEQ ID NO: 121767 - DNA, 601 bp, Human
gaaagaacttccaagactctcttggaaaatgagtctataagcattgagcaaaacaggaactaactgcatagactgaactaataaaaagccaaaaaatctttttagttttttctgcaatttaaactgaccctgcttattcctgggaaccaaccagtgatttctggcagctgctcaggaaaagagaggaatgagtaatataaaaatctggattggctgggcgtggtggctcacacctgtaatcccagcactttgggaggccaaggcgggcagatcacaaggtcaggagatcgagaccatcccrgctaacacagtgaaaccccgtctttactaaaaatagaaaaattagccagggcgtggtggcgggcccctgtagtcccaggtactcaggaggctgaggcaggagaatggccggaacccagaaggcggagcttgcagtgagccgagatcccgccactgcactccagcctgggcgacagagccagactccatctcaattaaaaaaaaaaaaaatctggatcaatatctaattctgggacagatggaattggctagcgactccatatcaccttggttccaacagttgtctagttcatggaaagcc

SEQ ID NO: 121768 - DNA, 601 bp, Human
taaatcgaacattgaaataaaagcacaacagttttccttggaacttctcttctttaaaaaaagaaaaagaaaaagaaaaaatcttgtaaaaggtttatgagaatcttacctcatggtgaaacattaagattgtatagatttgtctataaggttttattaataattgggtttgacgttaatagtacattaatgcaaaagtaaaatttagctttctctcttgaacaacattttcacataatattaaaagacaatgaaagatttttcttcgcttttaaatacgctacaggaaaaagaagggagaaaaaaaagacattgtttggaaagctgtcttcccgctatcaatgagtaaaggtttttgtcttttaaaaatctttgagtcatcgatttgactaaataaatgacttgtggtgtcctgggattttattttataatatcaagtgctttaaatctttgatatttgacaaactttccaaaatcaaattctaaattatgtctttttctgacctgattaatccttttagatgttaagttccataagttcaaaatgaaatatttggcttatttggtatattaaaatcatacagaaagctgtcaaatataa

SEQ ID NO: 121769 - DNA, 601 bp, Human
ttggaaccattagagtctagggaaggcctggggatatatgagggtagccatgccccctggctatgctagaaagagtcacaccttatctgcactactgcctgctgtcctaggtgccacactcggtacttgcgaagtttttcaccaaaaataaaagttgctaagagttaacactgggacatatgcatacaaggtgtgtaaggaaagtacaatgtttttggcaaaagattacaagatggcatgggaatgtgggttttttggcctagtttagagggttaaaggattgttttggccgggcacagcrgctcacacctataaatcccaacactttgagaggctgaggcaggttacttgatcatttgagtccaggagttcgagaccagcctgggcaacatggcaaaaccatatctctactaaaaatacaaaaattagccaagcatggtggcgcaggcctataatcccagctactcaggaggctgaggcacgagaatctcttgaatccaggatacagaatttgcagtgagccgagatcacaccattgtactgcagcctgggcaacgaagcgattctgtctcaaaaagagaaaagaaaaaagaaaaaaaaa

SEQ ID NO: 121770 - DNA, 601 bp, Human
tgggaggctgaggcaggtagatcacttgaggtcaggagttagataccagcctggccaacatcatgaaaccccgtctctactaaaaatacaaaaattagctgggcgtggtggtgtgcacctgtaatcccagctactgggaaagctgaggtaggagaatcacttgaacccaggaggtggaggttgcagtgagccgagatagtgctactgcactccagccttggcgacagagtgagactgtctcaaaaaaaaaaaaaaaaaaatggatttggcactatgggatgctaacagctattctctttgkattaatccaccttgcgttctttgctgatgactgcgggtttttttcctccatcaaaggggaaaattgagagctgacaggactcctggaaaagatcccttcgttactgacaagcagttgcctgaacttttgtttcagtgttgctgtgatggtggatggttctatggcctcctggtgcttctcatctccctttctctgctacaggcaatgcttttctccctccagtttcctctgtctgtcttcctttcctttcccttttctatcttttctgtcactcagggtgactgtccactcttccatctt

SEQ ID NO: 121771 - DNA, 601 bp, Human
aaacagccaacgcagcactctgggctgctatgcctcttgaataaccattcttctgtttctttacttctctaataagcttgccttcactgtactctgtggacacacccagaattctttcttgtgtgagatccaagaaccctctcttggggtctgtattgggacccctttccaggaacatcttcctggcaaaccacgaaaagacattaccagagagacccttggcccaaaggaaaatcatctgtgcagcactaattggccgactttgggtaagtagtgggtagcttttatcccggttaagggrcaaaaatttgggttagaagcccaacttcgaagggttagattcccccctaagacatagggggttagaggtccccctcagtaaggcccctcttagttaaaaatggatctagtggccgggcgcggtggctcacgcctgtaatcccagtactttgggaggctgaggcaggtagatcacttgaggtcaggagttagataccagcctggccaacatcatgaaaccccgtctctactaaaaatacaaaaattagctgggcgtggtggtgtgcacctgtaatcccagctactgggaaagctgaggtag

SEQ ID NO: 121772 - DNA, 601 bp, Human
acgcctgctgagaagtgcagatgaggtctgactcttctcagcatagctagggggcatagctaactccacttcctcagccctttgctccaaagcaggtaagttgaacaattatcacattaaataggcaatttatgacatttaaccatttagcaaatgtgtcagaggtgctggaaccagagcaactattcttttgaataggagctgggtaaaatgaggctgagaccttccggactgcattcccaggttaggcattcttagtcacagaacaggagatccgcacaagatataggtcacaaagacycaagtgataaaataggatgcaataaagaaaccaatcaaaacttgccaaaaccaagatggcaagtaaagtgacctctggaatctcttcattgctcattatatgctaattataatggattagcatgctaaaagacactcccaccactgccgtgacagtttacaataccatggcaacgtctgaaagttatatagactgcctcagtttcaagaatttcttccccttttccagaaaactcatgaataatccacccgttgtttagcatacgatcaagaaataaccataaaaacagccaacgcagca

SEQ ID NO: 121773 - DNA, 601 bp, Human
gaagattattttggtctttttttaatttagtctatgcaattaattcctgttttgcttgatatttatgaacacattagttttccaagagagtcttggaaatttctcccctctactttaatggcacactttcaaaacttagcagagacttggatttaagagtcagagtcctatagctaattataaaacatcttttgaacaggatcaaaacaagacagtaattgtctgtgaatgacaaaaggtcttaagggagccatattcaaagacacaattgacaaggaaatttggtcacttctgtggtatmcaacaattttacctaaaaattattattactgataacttacactaactcatatcagaactataggagtttcccataattttgcactacgtatcaataacatacttatacaaataaatcccaaagaaagccaaacaccatttcatatttgacaatgcttccagtatgattttaatataccacataggtcaaatatgttttgttttgattttttgagacagtctcactctgtcccccaggctggagtgcagtgacgcagtctcactctgtgccccaggctggaatgcagtacataatcccagc

SEQ ID NO: 121774 - DNA, 601 bp, Human
aaggccgtggaagacggatttgtcaaaagtggaataatattaatcagctgggcgtgggggctcatgcctgtaatccaagcactttgggaggctgagtaggaggcaggagtatcgtttgagcctaggagtgtgagatcagcctgggtagtagagtgagaccccatctctacaaaaaaaaaaaaaaaattgaaaaaaattgaaaaaattgaaacaattaactgggcttggtggcacgtgcctgtagtcccagctacttgggagaccatggcaggaggattgcttgagcctgacaaatcagggytgcagtgagctgtgattgtgccactgcactccagcctgggcaacagagcaagacactgtcttaaaaaaccaaaaccaaaacaacaacaactacaaaaaaaaaagtggcataataaaccagaggtgaagtcttaaattgaaaaagaaaacattttccccatagacctgacacatttctcaaaatcatgccaaatccatgttgttgaggtctgcagtaatttaccatattgataagactgacggtaaatatagtaacacacaataaagttgctatattcctttttgctgtgctaagagattc

SEQ ID NO: 121775 - DNA, 601 bp, Human
gcaatgtttttcatcagcatcctgtcactttttggctaccactgctggccagctggaaaagaacagacaaccatagaatcattccccgcacccacattttctttctctctcttttttttttttttttttgagatggagtctcgctctgttgcccaggctggagtgcagtggcgctatctcggctcactgcaacctccacctcctgggttcaagggattctcctgcctcaccctcccaagtaactgggattacaggtacgtgccaccacacctggctaaattgtgtatttttagtagagacrggatttcaccccattggccaggctggtctcgaactcctgacctcaggtgatctgcctgcctcggcctcccgaagttgtgggattacaggcgtgagccactacccccggctccacattttcatatagacccatggaaatggtttctctatcagatccagtacaaattgcagacaagtctggcaatggaaaaaatatatattggcaacttctagtattttcaaactggagtaatagctgcagtggcgccatctcgggccactgcaacctccacagttcccaggttcccaagtagctgggatt

SEQ ID NO: 121776 - DNA, 601 bp, Human
gctggttttgaactcctgggctcaagcgattctcctgcgtgtggcctccaaaagtgctaggattacaagcatgaaccaccatgcccaacccttactacaacaactttacagcactttataaaagtttggatgggtgaactgtcagatacatgtgcaaaattccatcaactttttcttttcttcacgtctgcaatgtttttcatcagcatcctgtcactttttggctaccactgctggccagctggaaaagaacagacaaccatagaatcattccccgcacccacattttctttctctctcttttttttttttttttttgagatggagtctcgctctgttgcccaggctggagtgcagtggcgctatctcggctcactgcaacctccacctcctgggttcaagggattctcctgcctcaccctcccaagtaactgggattacaggtacgtgccaccacacctggctaaattgtgtatttttagtagagacgggatttcaccccattggccaggctggtctcgaactcctgacctcaggtgatctgcctgcctcggcctcccgaagttgtgggattacaggcgtgagccactacccccggctc

SEQ ID NO: 121777 - DNA, 601 bp, Human
gtgattttcccacctcagcctcccaaagtgccgggatttcaggtgtgagccaccatgcccagccccaaaaatatcgttttctccaactgtacttttatttatagaactcagctgcacaattatctttcacttcctccaaagagcaggaagtaaccctgctaactagattcaagagaaattctcaacaggaaatgggtctgctacactctgttagatcatagcctattctatgacctaacagaaaaacccagctatacattttattatatatatatataatgcattaataagacagtattayaggaaaggaagaaaagctgttaagtatctatcatgtgccaggcgtgccagtcacatgatctcatttgaccttcacgacagtcttgtagtgtggatagtatcatgcccattccacagatgaaccaactgtgcttcagagagattgagaaatttgcccaaggtcacacagctagtaaatggccgagttgggactgacttcaagagtccacacttaaaaacaattttttttttatttactttcttttctgttttgagacggagtctcactctgtcacccaacctggagtgcagtgccacgatc

SEQ ID NO: 121778 - DNA, 601 bp, Human
atccaaaaatatcattttcttttcaatgtatttatttattcagagacagggttttgctctttcaaccatgctggagtgaagtggcacaattatagctcactgtaacctcaaactcccaggctcaagtgatcctcctgcctcagcctctgtagctgggactacaggtgcacactgctggctaatttttaaatgttttgtagagacagagtctcactatgttgcccgggctggtctcaaactcttggcttcaagtgattttcccacctcagcctcccaaagtgccgggatttcaggtgtgagycaccatgcccagccccaaaaatatcgttttctccaactgtacttttatttatagaactcagctgcacaattatctttcacttcctccaaagagcaggaagtaaccctgctaactagattcaagagaaattctcaacaggaaatgggtctgctacactctgttagatcatagcctattctatgacctaacagaaaaacccagctatacattttattatatatatatataatgcattaataagacagtattataggaaaggaagaaaagctgttaagtatctatcatgtgccaggcgtgcca

SEQ ID NO: 121779 - DNA, 601 bp, Human
ccctgtcatacttggaaatagctggtgatatggcaacatggttttcaaagaaagtgtaattgatgggcagcgagccattgactgagaggcaatgtaatgttatatgtcggtctgtttctgtttgaatgaccataatgttcagcactggggaagtcaccgggtctggaagaatgaaagtgaacatgaaaaggataaacagactgggtgtgctcactcagaccacaaatatgagtggaacccttactccactccaggctgtggaaccaagatgaacgacccccttcctgagaagtcaagaagytcacggcccactgggaaaggccaatgggcatgtggccaaccccgtgcagtgtgttgttagccgaggttctcagctgagtgctgagaaagccagagagtggagggcatctctctgctttgaggaattggggtgcaagcttgcccttcctagaattcacaatctatttattgttaataatgaatataattttgtcaatgatccagttctaagtatgaagctgagaagtgcttttttatgtttattttttatagacatagggccttaccatgttggccaggttggtcttgaactcctggcctc

SEQ ID NO: 121780 - DNA, 601 bp, Human
ggaggccaaggcaggtagatcacctgaggtcaggagtttgagaccagcctggccaacatggtgaaaccctgtctctacccaaaatataaaaattagctgggcctggtggcgcgtgcctgtatttccagctacttgggaggctgaggcatgagaatcgcttgaacccaggaggcggaggttgcaatgagccgagatcgtgccattgcactccagactgggtgagtgagactccatctcaaataaataaataaataaataaataaataaataaataaataaataaaataaaataaaaaaataataataaagtttaaaaagtcatgaccaagcacatcttccacaggggccacccaaagaagagaaaagcagcacagaatttaacaggacgaataccagcaacatttctggggtcatgagcaccagaaaagcctgggtgtttactgggcaaggccctgagccctggcagcatgtttcgtgtcatccaaacaactgccagttgttgagttttagctgcaggccagacactgtgttaggcacttcacctgtgttgccttatttatcccattggcatcactcccattttatagatgaggtgagtaag

SEQ ID NO: 121781 - DNA, 601 bp, Human
ctgggaggccaaggcaggtagatcacctgaggtcaggagtttgagaccagcctggccaacatggtgaaaccctgtctctacccaaaatataaaaattagctgggcctggtggcgcgtgcctgtatttccagctacttgggaggctgaggcatgagaatcgcttgaacccaggaggcggaggttgcaatgagccgagatcgtgccattgcactccagactgggtgagtgagactccatctcaaataaataaataaataaataaataaataaataaataaataaataaaataaaataaaaaaataataataaagtttaaaaagtcatgaccaagcacatcttccacaggggccacccaaagaagagaaaagcagcacagaatttaacaggacgaataccagcaacatttctggggtcatgagcaccagaaaagcctgggtgtttactgggcaaggccctgagccctggcagcatgtttcgtgtcatccaaacaactgccagttgttgagttttagctgcaggccagacactgtgttaggcacttcacctgtgttgccttatttatcccattggcatcactcccattttatagatgaggtgagt

SEQ ID NO: 121782 - DNA, 601 bp, Human
actctgggaggccaaggcaggtagatcacctgaggtcaggagtttgagaccagcctggccaacatggtgaaaccctgtctctacccaaaatataaaaattagctgggcctggtggcgcgtgcctgtatttccagctacttgggaggctgaggcatgagaatcgcttgaacccaggaggcggaggttgcaatgagccgagatcgtgccattgcactccagactgggtgagtgagactccatctcaaataaataaataaataaataaataaataaataaataaataaataaaataaaataaataaataataataaagtttaaaaagtcatgaccaagcacatcttccacaggggccacccaaagaagagaaaagcagcacagaatttaacaggacgaataccagcaacatttctggggtcatgagcaccagaaaagcctgggtgtttactgggcaaggccctgagccctggcagcatgtttcgtgtcatccaaacaactgccagttgttgagttttagctgcaggccagacactgtgttaggcacttcacctgtgttgccttatttatcccattggcatcactcccattttatagatgaggtg

SEQ ID NO: 121783 - DNA, 601 bp, Human
taatcctagcactctgggaggccaaggcaggtagatcacctgaggtcaggagtttgagaccagcctggccaacatggtgaaaccctgtctctacccaaaatataaaaattagctgggcctggtggcgcgtgcctgtatttccagctacttgggaggctgaggcatgagaatcgcttgaacccaggaggcggaggttgcaatgagccgagatcgtgccattgcactccagactgggtgagtgagactccatctcaaataaataaataaataaataaataaataaataaataaataaataaaataaaataaaaaaataataataaagtttaaaaagtcatgaccaagcacatcttccacaggggccacccaaagaagagaaaagcagcacagaatttaacaggacgaataccagcaacatttctggggtcatgagcaccagaaaagcctgggtgtttactgggcaaggccctgagccctggcagcatgtttcgtgtcatccaaacaactgccagttgttgagttttagctgcaggccagacactgtgttaggcacttcacctgtgttgccttatttatcccattggcatcactcccattttat

SEQ ID NO: 121784 - DNA, 601 bp, Human
aagataaggaataggaattattgggccaattatgtgaatttctaagcgcatgagggcagtggaatagactctgcagaacatgctcaccatcttgggctgtggaaacacacggcctggatcccacttctggcacagattcctcctctgtaaaatgagaatgacataaattgggggttggtggcgtttgtgttagaaaaggtcggtaaattgctcagcaatgcgtctggaatgtggccatgtaggctgggactgttccattgtcagctgatgatagggtttgactgtgtcctcacccaaatcwcatcttgaattgtagtccccataatccccacatctcatgggagggaccaggtggagataattaaatcatgggggtggtttctgtcatactcttctagtgacagtgagttagttctcacaagatctgatggttttataaggggtttcccccttcccttggctctcattcttctctctcctaccgccttgggaagaaggatgtgtttgcttccccttccaccatgattgtaagtctcccgaggcctcccaagccctgcggaactgtgggtcaattaaacctctttcctttataaactacccc

SEQ ID NO: 121785 - DNA, 601 bp, Human
cattgttctagttgctgtgatagaggaaatgttgggaggtggtgtatctgccacctctgtgtcctgtgtcatatccctgggccttccctctgacccagcagcatctgagggtctactcactttgcactgatagtgtcttgcttcaattgcacaatacacatgttcactttctgtcctggggtgtttgcagtgcctggggtgagacactgaggtaagcctgcttggaatacccacatgctagtctagaagtgggggaggtgtcgctttctggggtgatcctcaaccagtgagcgttggacaycagtggataaatgcctctcactatcaatcctcaagtggacaatactgagaagaggctcttgggctcttcagaagattccagtgggctcatgtccagctgcccaccacagtgctcaactcagcaaaacaccctggtactggtttttcccatggcgcattgggcctgcttcctagggccacctcctacataaatgatgtgcatagaaggccttatttcaggctctgctttcaggtctggtccaggataaaacaagcgaccagaagtccctagaaagcagcctcagggaacaaaattaccccc

SEQ ID NO: 121786 - DNA, 601 bp, Human
ctgcagccttgacctcccgggtcaagcattcttcccacctcagccgcctgagtagctgggactacaggtatgcgccatacctagctaatttttttgtatttttttggtagagagaagttttcaccgtgttgcccaggctggtctcaaactcctgagctcaaggaatccacctgcctcagcctcccaaagtgctggaattataggcatgtaccaccatgcctggccaaattaatttctttctgccaaacatctaagtggagaaatctggggggcagctgaatatgttactacatggtgtttktatgacctcagctaacttctgttttcacacagaaaattataactgttaagaaactgtttgttaatacttgtgttatatttaaacttgtgttatatttaaacaaactatgctttttcccctttcctgtcttctccctcccccatttaattgccttaggtacttaaacttcacccttgtttagcccctattaaggttgctttggatgtaggaagaggccccacattggaactaagacaggtgagttaaatgagtttaaatgtcattttaattacagattgagtattatccaaaaacgctttg

SEQ ID NO: 121787 - DNA, 601 bp, Human
atgaataacccaatctatataaaagtaaggaatggtatagcaacaaagaaggatttccacaaacaagaaaattcacccttggccaggtgcggtggctcacgcctgtaatcacagcactttgggaggctgagacaggcggatcactttaggtcaggagtttgagaccagcctggccaatatggtgaaactccattactactaaaaatacaaaaattagccatgcgtgatggcacacgcctgtagtcccagctactcaggaggctgatgcaagagaatcgcttgaacctgggaggaggaggtygcagtgtgccaagatcgcaccactgcactccagactggacaacagagctagactgtctcaaaagaaaaaaaaaaagaaagaaaaagaaaaaagagaattgaccctcatgacctttgatctagagtaaatcatcatacatgagacgaagaaattggataccatgttctaaaagtaagccgacttgtttttctttgattacctttcctggctcatgtatcttagagctgtcttttatgaccccaattttaaaatgctattgttatcttcgtttaggtaagggtttcaaaccaatgatcaaat

SEQ ID NO: 121788 - DNA, 601 bp, Human
aagaaggatttccacaaacaagaaaattcacccttggccaggtgcggtggctcacgcctgtaatcacagcactttgggaggctgagacaggcggatcactttaggtcaggagtttgagaccagcctggccaatatggtgaaactccattactactaaaaatacaaaaattagccatgcgtgatggcacacgcctgtagtcccagctactcaggaggctgatgcaagagaatcgcttgaacctgggaggaggaggtcgcagtgtgccaagatcgcaccactgcactccagactggacaacaragctagactgtctcaaaagaaaaaaaaaaagaaagaaaaagaaaaaagagaattgaccctcatgacctttgatctagagtaaatcatcatacatgagacgaagaaattggataccatgttctaaaagtaagccgacttgtttttctttgattacctttcctggctcatgtatcttagagctgtcttttatgaccccaattttaaaatgctattgttatcttcgtttaggtaagggtttcaaaccaatgatcaaataaaaggtctcaaccaagaaatatagcacattactgttaaacatta

SEQ ID NO: 121789 - DNA, 601 bp, Human
ttttttttttttttttttgagacggagcctcgctctgtcccccaggctggagtgtaatggcgcgattgcggctccttgcaacctccctggttcaagcgattctcctgcctcagcctcccgagtaggtgggattacaggcgtacatcaccacgcccggctaatttttgtatttttagtagagaccagggtttcaccatgttgcccaggctggtctcgaactcctgacttcaggtgatccacccacttcggccttccaaattgctgggattacagacgtgagccgccgcgcccgactctttttaattcttgccctcagctcacgccaggccctgggtggaaagctttctttgcccggaaactggctttctgaaaccaagggcttttgtgtcacgttcatggagagatggcagtgcgggttgaggcagaagtgctcagtcagaactgatgagtccagatgagaagcttgacttttaaccccggccctcggggctgcaccctaccctctgggaaacaattccagccagaagagtttacactcagcagaaggtgcctctgtcaccacaatgggtgtggagccactggaaagaggttgggtgatagt

SEQ ID NO: 121790 - DNA, 601 bp, Human
ctaccctctgggaaacaattccagccagaagagtttacactcagcagaaggtgcctctgtcaccacaatgggtgtggagccactggaaagaggttgggtgatagtgaggaaggacagcaggttttggcatcaaaggcactaccttggcctcaatcccagttcagccagctgcttcctagctctgtggccttggtcaagacacttaccttctctaaagcatggtttatttgcagtctcaggggctcatgcctgtgatcccagcactttgggaggctgaggcgggaggatcacttgagctcakgagttcaagaccagactggataatatggtgaaaccccgtctctataaaaaaatgcaaaaattagccgggcatgctggcatgggcctgtagtcctagctacttgggaggctgaggtgggaggatcgctttagtccaggaggtcgaggctgcagtgagccaagatcgcaccactgcactccagcatgggcgacagaccaagaccctgtctcaaaaagtaaaataaaataaaccatggtttattcatctgtacaaagaaattaaagaatcagtgctgagtagcacaggtgagcagcttcctag

SEQ ID NO: 121791 - DNA, 601 bp, Human
tgggagcttgcagacaatgtaacttataaacccaaagctgcaacttttccaagaaagggaaattgattatcttccagaaaagtacattacttttgcaggtagctctgatggtttaaaagttcttcctgtattgagtcgaagtataacacctgtgctttgtgtccaccgggtactagtttggccttatgcagaataccgggcatgtttatgagcagttttatccttcctgatgggaatgggaatgatggtcccatttactacttggagctgaaatcttactaagttatattatcagagtagkgcagtctagcccattctccaccatagagattgaggagagggaaacaaaagcagtaaattatagacagtatctacacgaataggggaggaaggggtaggaggtaccatttatacactatggttgcttaagtgttcttcatagaacttagcatctaatactataacatataatattctatctatatgttatctggctctaattgaatacaaaaatatatatttctggccgggggcggtgcctcacacctgtaatcccagcactttgggaagctgaggtgggtggatcatgaggtcaggagtt

SEQ ID NO: 121792 - DNA, 601 bp, Human
tgccaaactagttggcaacaggaaatcggctataattttaatgaagtcttaaaggccaagtgtaggttggcatgtgagtttggactagctgggggcctcagatacaaagggagttcacattcattcataagccctttttaataaacctccatcagaaaccgtacttcacaaggaagatggggactggcaaagagcccggagagagacctctctgtggggtgggcatccagctgctcaggaacaggcacagaccccacctgcttcctctggactcttctcttctaaaaaagcaggctgggcrcagtggctcatggctgtaatcccagcactttgggaggccaaggcgggcagatcatctgaggtcaggaatttgagaccagcctggccaacatggtgaaactctgtctctactaaaaatacaaaattagctcggcgtggtggcgcacacccgtagtcccagctacttggggactgaggcacgagaattgcttgaacctgggaggggaaggctgcagtgagccaggatcaagccagtgcactccagcctgagcgacagagggagactcgtcacaaaaaaaaaaaaaaaaaaaagaaagaaaag

SEQ ID NO: 121793 - DNA, 601 bp, Human
ataaaacccagtaatccaaattcaaatgcaaaaaaggaggggaaagagaagcagaatccctctacaatccaggggtttgccatgaggatggtgggaatgttgagaaggccccaccctttgagcatcctgggctacacattttttttttttctcgaggcggagtctggctctgtcacccagtgcagtggtatgatcttgactcactgcaacctctgcttcccaggttcaagcaatgctcctgcctcagcctcccaagtagctgggattaacaggcacccgccaccacacccagctgattttyctatttttagtagagatggggtttcaccatgttgcccaggctggtctcgaactcctgacctcaagtgatccgcctgcctcggcctcccactgtgctgggattacaggggtgagccaccacccagcccagtattgtccgtcttgtagagtatttgcattctaattctctttgctgttcgtctttcatgaagagatcctggcatagctatggccaaatgaagcagcattgtgtttatttagttcatttactgtttaataggagcttgctgaaagccaaatcccaccctaaagagaaaccaga

SEQ ID NO: 121794 - DNA, 601 bp, Human
tctgaccaacatggtgaaacccccctctactaaaaatacaaaaattagctgggcatggtggtgggtgcctgtagtcccagctactcaagaggctgaggcaggagaatcgcttgaacccaggaggcagaggttgcagtgagccaagatggcatcactgtactccagcctgggcaacagagggagactccatctcaacaacaacaaaaaaagtatatacataaattataccttaagaactgagaaaaatgggaaacaaagcaaatgctcagcaacatgggacttacagcatgagtatcattcrgccactaaacagtacacttcacgcatgaacaacttgagcttgaactacatgggtccacttacatgtggatttttttcttttttttttctgagatggagtcttgctctgtcacccaggctggagtgtggtagcacgatctcagctcactgcaacctctacctcccaggttcaagcaattctcctgcctcagcctcccaagtagctgggattacaggtgtgtgccaccatgcctggctaatttttgtatttttagtagagacggggtttcaccatgttggctaggctggtctccaactcctg

SEQ ID NO: 121795 - DNA, 601 bp, Human
attacaggtatgacccaccatgcccagccagatttttttcaataaaagttacacttgagtgtgccagcctttcctgttgctccttccacctcctctacttctttcacttctttttttgagacagggtcttgctctgtttcccaggcgggagtgcagtggtgcaatcatggctcacggcagccttgacctctcaggctatagtgatcctcccacctcagcctcctgagtagctggaactacaggtgtgtgctaccatgcctggctaattttttttttatttttggtagagacagggtgtccstgtgttacccaagctggattagaactcctgggctcaagtgatcctcccacctcggcctcccaaagtgctggcattacacgtatgagccactatgtctggtgtttatttttaattgaagtatatttagggacatgagaaaatgctcatgatcaaatggcaggagaacgaaactatatttacagtacgatcccaattttgtaagacacatacacacattgatgatgatgatgacgacaagaaaacagcacatgtggctgggcgtggtggctcacacctgtaatcccagctactcgggaggct

SEQ ID NO: 121796 - DNA, 601 bp, Human
gtgcaatcatggctcacggcagccttgacctctcaggctatagtgatcctcccacctcagcctcctgagtagctggaactacaggtgtgtgctaccatgcctggctaattttttttttatttttggtagagacagggtgtccctgtgttacccaagctggattagaactcctgggctcaagtgatcctcccacctcggcctcccaaagtgctggcattacacgtatgagccactatgtctggtgtttatttttaattgaagtatatttagggacatgagaaaatgctcatgatcaaatggyaggagaacgaaactatatttacagtacgatcccaattttgtaagacacatacacacattgatgatgatgatgacgacaagaaaacagcacatgtggctgggcgtggtggctcacacctgtaatcccagctactcgggaggctgaggcaggagaattgttgaacctgagaggtggggggcacagggagccgagattgtgccattgcactccagccttgggcaacgagagtgaaattccacctcaagaaaagaaaagaaaaaaagaaaatggcacatgtgcatatatgttaggaaaaatacc

SEQ ID NO: 121797 - DNA, 601 bp, Human
gtggggggcacagggagccgagattgtgccattgcactccagccttgggcaacgagagtgaaattccacctcaagaaaagaaaagaaaaaaagaaaatggcacatgtgcatatatgttaggaaaaataccagaaaaaaatacaccccaatgttagcaatgtaacctctggaagtcaggatcacagataactaatgtttttctgaatacctttactaaatttccaaattttcatctgagcctttgttccttttacaatcaggaaaaaataattaagattcctattggaaaataccataaagkggcagggccacctggctgtctttgcccagaagcggccagtgactgtatgtagttcacatgccctgaggcggctgccttggtgatccgaatgctgttgagctcagggtcttttaggtcctcgtaccctaaccctaaccctaaccctaaccctaaggcgctctgggtttctgcaaccttcgggaggtctagcacctagtattcctctggcgtctgagttttggtccactggccgttggtgctggtatcctttcccctaagagtgacatcacttatttagttcatttctttcttccttccttc

SEQ ID NO: 121798 - DNA, 601 bp, Human
aataccataaagtggcagggccacctggctgtctttgcccagaagcggccagtgactgtatgtagttcacatgccctgaggcggctgccttggtgatccgaatgctgttgagctcagggtcttttaggtcctcgtaccctaaccctaaccctaaccctaaccctaaggcgctctgggtttctgcaaccttcgggaggtctagcacctagtattcctctggcgtctgagttttggtccactggccgttggtgctggtatcctttcccctaagagtgacatcacttatttagttcatttcttycttccttccttcctttcctagccctttccacaaaggatttgtagatgcctagaacaatataatctgggtttcataggatagtcccagatttgttgcgttttcttttttctttttggtttagtgccacatacccaggctagagggaggatgagcactgtggttcctccgaccctgtgcctggtggtggtcatgcctggccagaaatgagcctcgtacctcaactgcaggcgaggccagatttagctcagtttgggcacatcctcccaggtgtggtggagccacctccatcctgaccctggt

SEQ ID NO: 121799 - DNA, 601 bp, Human
aggccagatttagctcagtttgggcacatcctcccaggtgtggtggagccacctccatcctgaccctggttcttttcactggctggcacctggagctgactccgtcctggcctgagggcccctctgcttgctgccaccacaggggccacagagatgcagcccatttattcggaaaaccgaggcccagagagtggcctttgtcttccacaggtgtctgtggaagggctggggaggggcgcagaccttccctgcctcagaggaggcttcaggaagggtggacaagggaggggagcagagcggrcagccaccactctggggagaccttggactgtgaaaaggggtgggggaaggaaagcttacagggcacccacaggctggggtgcccacctggcagggtctttggcttctgagcaccccttaagttatcctcacttcatcacccctgtttttttgttgtcattgttttgagacagagttttgctcttatttcccagactggagtgcagtggtgcaatcttgacttactgtaacccccgcctcccgggttcacacgattctcctgcctcagcctcccaagtagctgtgattacaggtgcccacc

SEQ ID NO: 121800 - DNA, 601 bp, Human
gcagcactgatccagggtggtggctgtgggaggagcgaagggcagccatggacagcagagaaccctgggcccctgcctatggtgtcactcataatcgtgacaatgaccagctcctgagtgcctgtggcgtttttctttttttttttttttttgagatggagtcttgctctgtcacccaggctggagtgcagtggcgcgatctcggctcactgcaagctccacctcccgggttcatgccattctcctgcctcagcctcctgagtagctgggactacaggtgccaggcaccacgcccagctarttttttgtatttttagtagagacggggtttcatcgtgttagccaggattgtctcgatctcctgacctcgtgatccacccgcctcggcctcccaaagtgctgggattacaggtgtgagcgaccgtgcccggcctttttctttttttgagactgtctcgagagctctgtcgtccaggctggagtgcagtggtgcaatcatggctcactgcagcctcaaattcctgggctcaagcaatcctcctgcctcagtctcccaagtagttgggactagatgcatgcaccaccacactcgaccaatttt

SEQ ID NO: 121801 - DNA, 601 bp, Human
aatcgtgacaatgaccagctcctgagtgcctgtggcgtttttctttttttttttttttttgagatggagtcttgctctgtcacccaggctggagtgcagtggcgcgatctcggctcactgcaagctccacctcccgggttcatgccattctcctgcctcagcctcctgagtagctgggactacaggtgccaggcaccacgcccagctaattttttgtatttttagtagagacggggtttcatcgtgttagccaggattgtctcgatctcctgacctcgtgatccacccgcctcggcctccsaaagtgctgggattacaggtgtgagcgaccgtgcccggcctttttctttttttgagactgtctcgagagctctgtcgtccaggctggagtgcagtggtgcaatcatggctcactgcagcctcaaattcctgggctcaagcaatcctcctgcctcagtctcccaagtagttgggactagatgcatgcaccaccacactcgaccaatttttaaactttttgtagagacaaggtctcactatgttgcccaggccaccttttcttcttgctctaactctccaactggaaaagtatcacttctac

SEQ ID NO: 121802 - DNA, 601 bp, Human
ttcctgggctcaagcaatcctcctgcctcagtctcccaagtagttgggactagatgcatgcaccaccacactcgaccaatttttaaactttttgtagagacaaggtctcactatgttgcccaggccaccttttcttcttgctctaactctccaactggaaaagtatcacttctacttggggaaactgaggcctagagacaagctgaagtttccaagctggcccctgagggcagggcaggagagggaagatgggcagttagaggccctgccagatctctcacggggggggccgtgtgatccrgcctcagagtggaggttgcttcatccagctcagcggggaccgtggtcttgccatggtgtttgggcagtgactgaggccactggcaccaggagcctgcttctgaccccccaccttccctcccaaccccgttctgcctgtttctctgcagcctggggctgtgggccgagccgggtgtccgccctgcgctgtagggctccaactcctcagaagctgggagcaggggacccgccacccctcagacaaggaggctgcgtgacaaggatctgtcccatacccttgctgagctgggacaaagccaca

SEQ ID NO: 121803 - DNA, 601 bp, Human
tttaaactttttgtagagacaaggtctcactatgttgcccaggccaccttttcttcttgctctaactctccaactggaaaagtatcacttctacttggggaaactgaggcctagagacaagctgaagtttccaagctggcccctgagggcagggcaggagagggaagatgggcagttagaggccctgccagatctctcacggggggggccgtgtgatccagcctcagagtggaggttgcttcatccagctcagcggggaccgtggtcttgccatggtgtttgggcagtgactgaggccacyggcaccaggagcctgcttctgaccccccaccttccctcccaaccccgttctgcctgtttctctgcagcctggggctgtgggccgagccgggtgtccgccctgcgctgtagggctccaactcctcagaagctgggagcaggggacccgccacccctcagacaaggaggctgcgtgacaaggatctgtcccatacccttgctgagctgggacaaagccacactgcaggggcagctgcctgccttgctcctcccaggtgctctgtgaggccccatgcccagctggcgtgcttttctgggcagc

SEQ ID NO: 121804 - DNA, 601 bp, Human; identical to SEQ ID NO: 35675

SEQ ID NO: 121805 - DNA, 601 bp, Human; identical to SEQ ID NO: 35674

SEQ ID NO: 121806 - DNA, 601 bp, Human
ctgagcctcgggtcacgcctgggatagagcagagttagcagccatatgttttcacttcaacagtaaatctaacttggaattttaagaacctatttttcccctctaggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggkctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctat

SEQ ID NO: 121807 - DNA, 601 bp, Human
cacgagattctgatttactccttggctctttgtgctctctgtggagcaccattcacatagttaccctgcagtcctgcaacctcacccattctgtagcactttgaaaggagagagttgtaaccttcatagtcattgacctttcagtacccacttttattacattttaaatacacccttgaagccctcccatcttcaaggaaagatccagcctgttagctctgggtgtgtaacgtaagaccttagctgatgtcttccttgcaggcataccaagaatgccagtcacctctccaaaccctccccsaaactaacatggtctcctgagcctcgggtcacgcctgggatagagcagagttagcagccatatgttttcacttcaacagtaaatctaacttggaattttaagaacctatttttcccctctaggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactgga

SEQ ID NO: 121808 - DNA, 601 bp, Human
tcaaatgaatgaatagcaactctatctacaaggcatgccaaacaagctaccacgagattctgatttactccttggctctttgtgctctctgtggagcaccattcacatagttaccctgcagtcctgcaacctcacccattctgtagcactttgaaaggagagagttgtaaccttcatagtcattgacctttcagtacccacttttattacattttaaatacacccttgaagccctcccatcttcaaggaaagatccagcctgttagctctgggtgtgtaacgtaagaccttagctgatgtyttccttgcaggcataccaagaatgccagtcacctctccaaaccctcccccaaactaacatggtctcctgagcctcgggtcacgcctgggatagagcagagttagcagccatatgttttcacttcaacagtaaatctaacttggaattttaagaacctatttttcccctctaggaaaaaatacttgggatatcacatgaagaagtagactgaaatatcagatttgtcatcaggaatactctttgtctactgtggtcctgtgcacgttggcctcagatggactacaggagattacaacgtac

SEQ ID NO: 121809 - DNA, 601 bp, Human
tacataacaccatagatgttcagccagtacttgtagaacggtgaatgaatcgatcaaatgaatgaatagcaactctatctacaaggcatgccaaacaagctaccacgagattctgatttactccttggctctttgtgctctctgtggagcaccattcacatagttaccctgcagtcctgcaacctcacccattctgtagcactttgaaaggagagagttgtaaccttcatagtcattgacctttcagtacccacttttattacattttaaatacacccttgaagccctcccatcttcaagraaagatccagcctgttagctctgggtgtgtaacgtaagaccttagctgatgtcttccttgcaggcataccaagaatgccagtcacctctccaaaccctcccccaaactaacatggtctcctgagcctcgggtcacgcctgggatagagcagagttagcagccatatgttttcacttcaacagtaaatctaacttggaattttaagaacctatttttcccctctaggaaaaaatacttgggatatcacatgaagaagtagactgaaatatcagatttgtcatcaggaatactctttgtcta

SEQ ID NO: 121810 - DNA, 601 bp, Human
atttcttatccaagttatcataaaccttaatcttaactcttggccacagttaagtttaatttggagcatgtcagtggaaattaggagaggggagacaaagaatgtgagagggatgactaatttttccaaagggtagaaaaaaaataaaggaggatgataaagaatatttatgagctgatatgagctatggaagtgtgaaggacatgtggattggggcgtgtgctcagagtcccttaacgggaaaaaaagaagacaatgggaagtaagcctcctgggacttccattggcaccaagtgtctcratggctctctctgctgtccttgtagtagtgtgggaggagagaaatctagtcccatgcacaagctttccagaagctcagggttcctatctcagtattccacatttcatatgagtacatctcatcttcccaactaaactgcaaatctgtaagggtgagatcatgtttttatgatggctcctttaatctcccatagctcccattcctctacataacaccatagatgttcagccagtacttgtagaacggtgaatgaatcgatcaaatgaatgaatagcaactctatctacaaggcatgccaaa

SEQ ID NO: 121811 - DNA, 601 bp, Human
caattatttttttaatttggctgctggtactggagaaaaaaaacagttccaattagaaaaaaaaaaagatgaattattcagtaggaatactaaagtggatttccaaaggctttagaaattgatggcactagttctttaacatctgtagtttcaattcaaagtgtatttcttatccaagttatcataaaccttaatcttaactcttggccacagttaagtttaatttggagcatgtcagtggaaattaggagaggggagacaaagaatgtgagagggatgactaatttttccaaagggtagaaaaaaaataaaggaggatgataaagaatatttatgagctgatatgagctatggaagtgtgaaggacatgtggattggggcgtgtgctcagagtcccttaacgggaaaaaaagaagacaatgggaagtaagcctcctgggacttccattggcaccaagtgtctcgatggctctctctgctgtccttgtagtagtgtgggaggagagaaatctagtcccatgcacaagctttccagaagctcagggttcctatctcagtattccacatttcatatgagtacatctcatcttcccaactaaac

SEQ ID NO: 121812 - DNA, 601 bp, Human
ataactctgtgaatatactaaaagtgaatatacgaattcactgaattagtgaattttatagcataattatatttcaatcaatcttcataaaactagcagttctaattctagtaatcaaaaagaggaaagagaaatgaatgcaattatttttttaatttggctgctggtactggagaaaaaaaacagttccaattagaaaaaaaaaaagatgaattattcagtaggaatactaaagtggatttccaaaggctttagaaattgatggcactagttctttaacatctgtagtttcaattcaaartgtatttcttatccaagttatcataaaccttaatcttaactcttggccacagttaagtttaatttggagcatgtcagtggaaattaggagaggggagacaaagaatgtgagagggatgactaatttttccaaagggtagaaaaaaaataaaggaggatgataaagaatatttatgagctgatatgagctatggaagtgtgaaggacatgtggattggggcgtgtgctcagagtcccttaacgggaaaaaaagaagacaatgggaagtaagcctcctgggacttccattggcaccaagtgt

SEQ ID NO: 121813 - DNA, 601 bp, Human
taaaaacattatgctaagtgagagaaagtcaggcaacaaggccatatactgtatgattccgtgtatatgaagtgtccagaataggcaaatgtatagatacagaaagtagactcgttgctaggagctgagggtgagagaatgggaataattgctaagggatgtgaagtttatttttggagtgatgataatgtcctaaaatcagaggcgatgtttgcataactctgtgaatatactaaaagtgaatatacgaattcactgaattagtgaattttatagcataattatatttcaatcaatcttyataaaactagcagttctaattctagtaatcaaaaagaggaaagagaaatgaatgcaattatttttttaatttggctgctggtactggagaaaaaaaacagttccaattagaaaaaaaaaaagatgaattattcagtaggaatactaaagtggatttccaaaggctttagaaattgatggcactagttctttaacatctgtagtttcaattcaaagtgtatttcttatccaagttatcataaaccttaatcttaactcttggccacagttaagtttaatttggagcatgtcagtggaaatt

SEQ ID NO: 121814 - DNA, 601 bp, Human
cccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcaggggggctgaggtaggagaatggtgtaaacctgggaggcggagcttgcagtgagccaagatcgcgccactgcactccagcctgggagasagagcgagactctgtctcaaaaaataaaaaaaattaaaaaaaataaagttaccagttccactcctggatatatacccaagaaagctgaagacatattttcatacaaaaatttgtacatgaatgttcatagcttccattagccaaaaagtggaagcaacccaaatgtccatcaactgatgaatgatgaatggataaggaaaatgtagtatagccacacaatggaatattattccactataaaaataaagcaagtattgatacatggatgaaccttaaaaacattatgctaagtgagagaaa

SEQ ID NO: 121815 - DNA, 601 bp, Human
gaggatgtggagaaattggaaccttttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcaggggsgctgaggtaggagaatggtgtaaacctgggaggcggagcttgcagtgagccaagatcgcgccactgcactccagcctgggagagagagcgagactctgtctcaaaaaataaaaaaaattaaaaaaaataaagttaccagttccactcctggatatatacccaagaaagctgaagacatattttcatacaaaaatttgtacatgaatgttcatagcttccattagccaaaaagtggaagcaacccaaatgtccatcaactgatgaatgatgaatggataaggaaaatgtagtatagccaca

SEQ ID NO: 121816 - DNA, 601 bp, Human
gtggctaaaatgaaaaagaaaagcattgacgtcggtgaggatgtggagaaattggaaccttttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcayggtggcaggtgcctgtagtcccagctactcaggggggctgaggtaggagaatggtgtaaacctgggaggcggagcttgcagtgagccaagatcgcgccactgcactccagcctgggagagagagcgagactctgtctcaaaaaataaaaaaaattaaaaaaaataaagttaccagttccactcctggatatatacccaagaaagctgaagacatattttcatacaaaaatttgtacatgaatgttcatagcttccattagccaaaaagtggaagcaacccaaatgtccatcaactgatga

SEQ ID NO: 121817 - DNA, 601 bp, Human
atggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgacgtcggtgaggatgtggagaaattggaaccttttatgttgctggttggattgtaaaatggtgcagtccctttggaaaaccacttgggagttcccaaaaatgttaactatgaagttaccaattccaggggccgggcgcrgtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcaggggggctgaggtaggagaatggtgtaaacctgggaggcggagcttgcagtgagccaagatcgcgccactgcactccagcctgggagagagagcgagactctgtctcaaaaaataaaaaaaattaaaaaaaataa

SEQ ID NO: 121818 - DNA, 601 bp, Human
gaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgacgtcggtgaggatgtggagaaattggaaccktttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcaggggggctgaggtaggagaatggtgtaa

SEQ ID NO: 121819 - DNA, 601 bp, Human
aaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgacgtyggtgaggatgtggagaaattggaaccttttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcag

SEQ ID NO: 121820 - DNA, 601 bp, Human
ttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacartggctaaaatgaaaaagaaaagcattgacgtcggtgaggatgtggagaaattggaaccttttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcat

SEQ ID NO: 121821 - DNA, 601 bp, Human
ataatatacaaaagatgatcaaattcccaattgactatgtttcaagcattcattttaaaaatcattgttagtcctcttaatatattttctcagagaaattataattatcaattgggttcacaggctagctctcaaaaatctatttaacccactaatgtagctaaaataccataaatatgctattaaaaagcagtggttctacaccaaaagcacaagcaacaaaagaaagaatagatacattggattttgttttgtgcttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgacgtcggtgaggatgt

SEQ ID NO: 121822 - DNA, 601 bp, Human
atgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctatttaacccactaatgtagctaaaataccataaatatgctattaaaaagcagtggttctacaccaaaagcacaagcaacaaaagaaagaatagatacattggattttgttttgtgcttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgac

SEQ ID NO: 121823 - DNA, 601 bp, Human
catgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctatttaacccactaatgtagctaaaataccataaatatgctattaaaaagcagtggttctacaccaaaagcacaagcaacaaaagaaagaatagatacattggattttgttttgtgcttccaagaacaccaccaccaagaatgtgraaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattga

SEQ ID NO: 121824 - DNA, 601 bp, Human
ctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctatttaacccactaatgtagctaaaataccataaatrtgctattaaaaagcagtggttctacaccaaaagcacaagcaacaaaagaaagaatagatacattggattttgttttgtgcttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcaca

SEQ ID NO: 121825 - DNA, 601 bp, Human
ggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctrtttaacccactaatgtagctaaaataccataaatatgctattaaaaagcagtggttctacaccaaaagcacaagcaacaaaagaaagaatagatacattggattttgttttgtgcttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatt

SEQ ID NO: 121826 - DNA, 601 bp, Human
gccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctratctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctatttaacccactaatgtagctaaaataccataaatatgctattaaaaagcagtggttctacaccaaaagcacaagcaacaaaagaaagaatagatacattggattttgttttgtgcttccaagaacaccac

SEQ ID NO: 121827 - DNA, 601 bp, Human
acctgcccattataagtgctcaggaaatatttgttaaatgtcaagtgaactgactgttccattttatacatgtatttgtgctgatgaaatgaattcaccgagcagtacatgcccattctggttctgcaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctytgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttaaaaacaaattttctcagaactcagaagagatggg

SEQ ID NO: 121828 - DNA, 601 bp, Human
ccgcatctcagtcatccatactacctgcccattataagtgctcaggaaatatttgttaaatgtcaagtgaactgactgttccattttatacatgtatttgtgctgatgaaatgaattcaccgagcagtacatgcccattctggttctgcaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacrcagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttaaaaacaaatttt

SEQ ID NO: 121829 - DNA, 601 bp, Human
gaaaacaattaccctatagtatcaatactatcaccatcctagtttagagatgacaaactgaatctgagaggttaatttccccaagattgcatagctaagtaagaggtggacccaggggtttgagccaagacagtgattcctaagcttcagatcctgtcccttacactacttctagcaaaggacatcacatttttctgcaattcccactagactgtgagccctttgagtgaggacccgcatctcagtcatccatactacctgcccattataagtgctcaggaaatatttgttaaatgtcaartgaactgactgttccattttatacatgtatttgtgctgatgaaatgaattcaccgagcagtacatgcccattctggttctgcaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctttgatgggccacttccaggatgggctgtcctactctgttttcaag

SEQ ID NO: 121830 - DNA, 601 bp, Human
gcccaggagtgggcaacatggcgaaactctatctctacaaaaaaatagaaaaaaattagccaggtgtggtggcatgcacctgtagtcccatctacttgggaggctgaggcaagagaatcacttgagcccaggaggcagaggttgcagtgagctgagaccacaccactgcactccagcctgggcaatgggagtgaaaccctgtcttaaaaaaaaaaaaaaagaaagaaaacaattaccctatagtatcaatactatcaccatcctagtttagagatgacaaactgaatctgagaggttaatytccccaagattgcatagctaagtaagaggtggacccaggggtttgagccaagacagtgattcctaagcttcagatcctgtcccttacactacttctagcaaaggacatcacatttttctgcaattcccactagactgtgagccctttgagtgaggacccgcatctcagtcatccatactacctgcccattataagtgctcaggaaatatttgttaaatgtcaagtgaactgactgttccattttatacatgtatttgtgctgatgaaatgaattcaccgagcagtacatgcccattctgg

SEQ ID NO: 121831 - DNA, 601 bp, Human
ttttaagtgaacattgcatgcaagggagtcttccctgacctccatgctcccgtagcatcctgaaaaatgactcgcatttccaaagcacctcttctatgtccagcactataaagtgttcaactaccctatagtatagggccaagcacagtggctcacacttgtaatcccagctcctggggaggccgaggtgggaggatcgcttgaggccaggagtttgagaccagcctgggcaatatagtaagccttgtccctaaaaaacaataataataaaagtttcttaagaaaatgaaggctgggtacrggcacagtggcccacacctgtaatcccagcactttgggaggccgaggcaggtggatcacctaaggttaggagttcaagaccagccttaccaacatgatgaaaccctgtctctactaaaaatacaaaaattagccgggtgtggtggtgtgtgccagtaatcccagctacttgggaggctgagacaggagagttgcttgaacctgggaggcggaggttgcagtgagctgagatcgcgcctctgcactccagtctgggcaagagagtgagactccatctcagaaaaaaaaaaaaaaagaaaga

SEQ ID NO: 121832 - DNA, 601 bp, Human
tcctccattgggaaactgatgaagaggagtctgttccctgttatggaggaggctggccatgcctcctgcagagtcacaacccagacggggcctggacggtgggggtgggcgtggttcagggaaaagacaggtctgccaaaatctcccaatcgcatctgactcatcccccagatatcccttttagaaacaatatttgttgaaaacccgcttggcttatcattcctctaggacagaactagaggattttcaaataaatattttgtccctgctcactcagaaatttccgttttcacatgacaascagcatattaacagacattgcaagaatgctttaaatgaagatgatatatagctttttgatatgagccctgatttttcaaaagcagaagaggcagcattgattttgttttaaaggcgtggtagttcaaaggaggtaaagcagagagataccaggttcaagggaaggccgggaggtaaaatcaatagggtagaataatgggaaagaaatcaatgaattggagtttttttaagtgaacattgcatgcaagggagtcttccctgacctccatgctcccgtagcatcctgaaaaatgactcgcat

SEQ ID NO: 121833 - DNA, 601 bp, Human
ttgttatttcctttacatgcttccccagtagggagctctgctagagacacatggtaggtgtgaccttgtgctgggcgggtgccaagctcccactgcagagtgccgtgtgtgtggctgcaggggatctgcagagccgctggtcccaagagcacacacagcccgaaggcccatcctacacctccaggagaggccaaagagccaggtgcacccgagagggacaggcaggggaggggtgaggaggtgccagtggaagccctgtctttgtggcgtttgattcttttactgttctggcacagtcccsacttggctgcctgctagggttttgagcctggcctcctccattgggaaactgatgaagaggagtctgttccctgttatggaggaggctggccatgcctcctgcagagtcacaacccagacggggcctggacggtgggggtgggcgtggttcagggaaaagacaggtctgccaaaatctcccaatcgcatctgactcatcccccagatatcccttttagaaacaatatttgttgaaaacccgcttggcttatcattcctctaggacagaactagaggattttcaaataaatattttgtccct

SEQ ID NO: 121834 - DNA, 601 bp, Human
ttgcaagtaggtgccaataccagttagcatttcagcacagaactccgaggggtcctttagacaacctcaagggctctttacaactcagagtttctgtggctctcacggcaacctccttcccagcttccctaagcagggacttgtggtcattggtcagggaggtgggaaaggcggagtgggggtgctggaggtgggacgaaggccaccgatctcaggttatgaagagcgatggtttcattttcacccccacaaattaccactttcaaaaacctcactttgcctggtgctctctcttaaggaktttggacattttacattgcttatggcaaagccttggttgttatttcctttacatgcttccccagtagggagctctgctagagacacatggtaggtgtgaccttgtgctgggcgggtgccaagctcccactgcagagtgccgtgtgtgtggctgcaggggatctgcagagccgctggtcccaagagcacacacagcccgaaggcccatcctacacctccaggagaggccaaagagccaggtgcacccgagagggacaggcaggggaggggtgaggaggtgccagtggaagccctgtctttg

SEQ ID NO: 121835 - DNA, 601 bp, Human
tgtgcccagaggctggtgacccagagggcgaagcacctgggagatgggacagaatgagaaacagcgagaaaaccagggatattaggttaaagaaaagagaacggggtgtgtgagctttgggaccacaagtagagggtggagaggggtgcagaggaagcaagagatggaacaggatcatgatttaagggcacccctgcatttctccagagctagtgtcatggatacacaaattatgcctagtatggggtgattgatttctccttatggtaagaatgaacctccattcctggagaataggcaytccaggctgcccatgagagtcaacgggtgccttgtgagagaatgatcttcctgtcacgggaagaattgcaagtaggtgccaataccagttagcatttcagcacagaactccgaggggtcctttagacaacctcaagggctctttacaactcagagtttctgtggctctcacggcaacctccttcccagcttccctaagcagggacttgtggtcattggtcagggaggtgggaaaggcggagtgggggtgctggaggtgggacgaaggccaccgatctcaggttatgaagagcgatggttt

SEQ ID NO: 121836 - DNA, 601 bp, Human
tctttttcccctgtagttgctggactgtggcctgtttaagggctctcttagcagttcagccagggaggtgcgctagtgttactgggagaatgtatggatttcctgccatttggaagttgagacccatctttccaatcaggaacgggtgagagttgccttcaggtaaagagttggtgagcaaaccttcaacagagtcaaaagggcttctctatgcctcctgggtccataacccacagacgactgagtagtctctagaatctgtcaatcaggggctggcttgcagacatagacccttgttttkccagaatctgtggggagggagtcagaccctgggggtggggatgggaggttctgcaggaagacaaacagctcctgtctatagctttgtcaaaagtgtgcccagaggctggtgacccagagggcgaagcacctgggagatgggacagaatgagaaacagcgagaaaaccagggatattaggttaaagaaaagagaacggggtgtgtgagctttgggaccacaagtagagggtggagaggggtgcagaggaagcaagagatggaacaggatcatgatttaagggcacccctgcatttctccag

SEQ ID NO: 121837 - DNA, 601 bp, Human
ttggaatttttggaaactaaaaaagaaacttgttattgcaagaaaagacaccagtaaattaaaatttgctggatggaattattaatctcattccccatgtaactgatcctcattgaagtttagactcgcatttgctttgcagcctggatatctgtgtcccacagttgctccaaagctggaatactttctggaatctttttcccctgtagttgctggactgtggcctgtttaagggctctcttagcagttcagccagggaggtgcgctagtgttactgggagaatgtatggatttcctgccrtttggaagttgagacccatctttccaatcaggaacgggtgagagttgccttcaggtaaagagttggtgagcaaaccttcaacagagtcaaaagggcttctctatgcctcctgggtccataacccacagacgactgagtagtctctagaatctgtcaatcaggggctggcttgcagacatagacccttgttttgccagaatctgtggggagggagtcagaccctgggggtggggatgggaggttctgcaggaagacaaacagctcctgtctatagctttgtcaaaagtgtgcccagaggct

SEQ ID NO: 121838 - DNA, 601 bp, Human
tccgtctcaaaaaaaaaaaggtcaggcgcggtggctcacgcctgtaatcccagcactttgggaggccgaggggggcagatcatgaggtcaggaggtagagaccatcgtcgctaacacggtgaaaccccatctctactaaaaatacaaaaaaaaaattagccgggcgtggtggcgggcgcctgtagtcccagctactcgggaggctgagggaggagaatggcgtgaacccgggagccggagcttgcagtgagctgagatcaggctactgcactcctgggtgagagagtgagactccctgtcaaaaaaaaaaaaaagaaaaccaacctggccctcagcgtgactttctgtaacatactttacttagcacaaacgggattcctcaaagtaaatcgggtctgcggcctcaccacactggcataaacaggactgggactacaggtggctaacctcaccttcctggaaacagacagcagccaggtgaggcaggtgagcagctgagactgggatgggcagacgacaagcccagggccaagggcgcaaagctcttccaaggacctggtgcttagggaggaggagtgggggtgaggtggggtgtccaggt

SEQ ID NO: 121839 - DNA, 601 bp, Human
actgcactcctaggtgagagagtgagactccgtctcaaaaaaaaaaaggtcaggcgcggtggctcacgcctgtaatcccagcactttgggaggccgaggggggcagatcatgaggtcaggaggtagagaccatcgtcgctaacacggtgaaaccccatctctactaaaaatacaaaaaaaaaattagccgggcgtggtggcgggcgcctgtagtcccagctactcgggaggctgagggaggagaatggcgtgaacccgggagccggagcttgcagtgagctgagatcaggctactgcactmctgggtgagagagtgagactccctgtcaaaaaaaaaaaaaagaaaaccaacctggccctcagcgtgactttctgtaacatactttacttagcacaaacgggattcctcaaagtaaatcgggtctgcggcctcaccacactggcataaacaggactgggactacaggtggctaacctcaccttcctggaaacagacagcagccaggtgaggcaggtgagcagctgagactgggatgggcagacgacaagcccagggccaagggcgcaaagctcttccaaggacctggtgcttagggaggag

SEQ ID NO: 121840 - DNA, 601 bp, Human
gaccaggccactgcactcctaggtgagagagtgagactccgtctcaaaaaaaaaaaggtcaggcgcggtggctcacgcctgtaatcccagcactttgggaggccgaggggggcagatcatgaggtcaggaggtagagaccatcgtcgctaacacggtgaaaccccatctctactaaaaatacaaaaaaaaaattagccgggcgtggtggcgggcgcctgtagtcccagctactcgggaggctgagggaggagaatggcgtgaacccgggagccggagcttgcagtgagctgagatcaggcyactgcactcctgggtgagagagtgagactccctgtcaaaaaaaaaaaaaagaaaaccaacctggccctcagcgtgactttctgtaacatactttacttagcacaaacgggattcctcaaagtaaatcgggtctgcggcctcaccacactggcataaacaggactgggactacaggtggctaacctcaccttcctggaaacagacagcagccaggtgaggcaggtgagcagctgagactgggatgggcagacgacaagcccagggccaagggcgcaaagctcttccaaggacctggtgctt

SEQ ID NO: 121841 - DNA, 601 bp, Human
cccgggaggcagaggttgcagtgagccgagaccaggccactgcactcctaggtgagagagtgagactccgtctcaaaaaaaaaaaggtcaggcgcggtggctcacgcctgtaatcccagcactttgggaggccgaggggggcagatcatgaggtcaggaggtagagaccatcgtcgctaacacggtgaaaccccatctctactaaaaatacaaaaaaaaaattagccgggcgtggtggcgggcgcctgtagtcccagctactcgggaggctgagggaggagaatggcgtgaacccgggagscggagcttgcagtgagctgagatcaggctactgcactcctgggtgagagagtgagactccctgtcaaaaaaaaaaaaaagaaaaccaacctggccctcagcgtgactttctgtaacatactttacttagcacaaacgggattcctcaaagtaaatcgggtctgcggcctcaccacactggcataaacaggactgggactacaggtggctaacctcaccttcctggaaacagacagcagccaggtgaggcaggtgagcagctgagactgggatgggcagacgacaagcccagggccaaggg

SEQ ID NO: 121842 - DNA, 601 bp, Human
tgaggccgggcactgtggctcaggcctgtaatcccagcactttgggaggccaaggtgggaggatcactgtaggtcaggagttcgagaccagcctggccaacatggtgaaaccctgtcactactaaaaatacaaaaattagccggatctggtggtgcacgcctgtattcccagctaactgggaggctgaggcaggagaattgcttgaacccgggaggcagaggttgcagtgagccgagaccaggccactgcactcctaggtgagagagtgagactccgtctcaaaaaaaaaaaggtcaggcrcggtggctcacgcctgtaatcccagcactttgggaggccgaggggggcagatcatgaggtcaggaggtagagaccatcgtcgctaacacggtgaaaccccatctctactaaaaatacaaaaaaaaaattagccgggcgtggtggcgggcgcctgtagtcccagctactcgggaggctgagggaggagaatggcgtgaacccgggagccggagcttgcagtgagctgagatcaggctactgcactcctgggtgagagagtgagactccctgtcaaaaaaaaaaaaaagaaaaccaacctgg

SEQ ID NO: 121843 - DNA, 601 bp, Human
cagagcatgtggaaagttggccatgcccaagcccccttaccccgtccccactacccacaatctggaaatacctgaacagtcaccacctgcttgcccaacccaacaggatttttatgaccctggtgtaaaaaggatgagaaaggaaaagcagggcctccccccagtgcccgcctccccgagtgcccgcctccctccagtgcctgccccccacctcacccagccagcctcttccaggtgcttcctcttcaggcaggaggccacactcctggcccacgcagggacttcacctctccccagaagrgggcacacctgctccctgcctttcacccagctgggagtggatgcagagtggcagcttctcccacctctgagtcaccggaaacaaagccgggggactgcagaagacacgggcaccatggcttcacagaggccaacccaccccagtgagtgccacccagctcctgggccagcctcactcactccagacacagggcagagggttcctaatgtctctaaaaccgaggaactcataagaatggtaaccagataaagccattcgcaccacacccgccttccctccctggccctggagagtagaggg

SEQ ID NO: 121844 - DNA, 601 bp, Human
gaagggaagcacacacttctcaccccatagcccacccaatacaacagggctggcagcagagaaacggcgtaacccatccggagccagggaagataaaaccaggaggagcaaaggtttccggggccagagcatgtggaaagttggccatgcccaagcccccttaccccgtccccactacccacaatctggaaatacctgaacagtcaccacctgcttgcccaacccaacaggatttttatgaccctggtgtaaaaaggatgagaaaggaaaagcagggcctccccccagtgcccgcctcccygagtgcccgcctccctccagtgcctgccccccacctcacccagccagcctcttccaggtgcttcctcttcaggcaggaggccacactcctggcccacgcagggacttcacctctccccagaagagggcacacctgctccctgcctttcacccagctgggagtggatgcagagtggcagcttctcccacctctgagtcaccggaaacaaagccgggggactgcagaagacacgggcaccatggcttcacagaggccaacccaccccagtgagtgccacccagctcctgggccagcctcact

SEQ ID NO: 121845 - DNA, 601 bp, Human
ggtatatgaatctctcaataaagctgttaccaaaaaatactgtctgaagaagtgttatctatttaatgtctatgcacctaaccattctctcctcaaatatatgatggtgggggtggatatgttattattttcttccatatcctgtccaccataatgctctggtcacattaaggactcattcagcagccataaaaaagaatgaaattggccgggcacggtggttcacgcctgtaatcccagcactttgggaggccgaggcgggaggatcaactgaggtcaggagttcgagaacagcctgacygacatggagaaaccccatctctcctaaaaaatacaaaattagccgggcatggtggtgcatgcctgtaatcccagctactcgggaggccaaggcaggagaatcacttgaacccaggaggcagaggttgcagtgagctgagatcatgccattgcactccagcctgggcaacaagaacaaaactctgtctcaaaagaaagaaagaaagaaagaaagaaatcatgtcccttgcagtaatatggatgcaactggaggcctttatcctaagtgaactcactcagaaacagaaaaccaaataccgca

SEQ ID NO: 121846 - DNA, 601 bp, Human
gggtgatgaaaacattccaaaattgattgtggtgatagttgcacaactctgtgaatatactaaaaaccactgaaagcctgggcaacatggcgaaaccctgtctctgcaaaaactacaaaaattagatgggtgcggtgatgtgtgcctgtagtcccagctactaaggaggctgaggtgggaggatcacttgagcctggaagttcgaagctgcagtgagccgtgactgcaccactgcattccagcctgggcaacagagcaagaccctgtctcaaaaaaaacccaaactcaccgaagtgtacaytttagatgggtgaattttatggtatatgaatctctcaataaagctgttaccaaaaaatactgtctgaagaagtgttatctatttaatgtctatgcacctaaccattctctcctcaaatatatgatggtgggggtggatatgttattattttcttccatatcctgtccaccataatgctctggtcacattaaggactcattcagcagccataaaaaagaatgaaattggccgggcacggtggttcacgcctgtaatcccagcactttgggaggccgaggcgggaggatcaactgaggtcag

SEQ ID NO: 121847 - DNA, 601 bp, Human
aatgaaggacttgtttatttggactggttcagggtaaccctaagagttctaaatgcccctaaggtgcacaatttgtttttctacttctgcaggagctgagatgggctgtcctgacctagcctctccctctttgagccatgagcagaaatgagtgaatccaacaagggccagaggagctccctgtgcaaatgtaatgagcgcaaatcccaccctgggttctggcctggatcagtggccttatgcttaaaaacactgatatagccgcacctacagcagtcccctctcagctacagtttgcacttttgtttgtttgtttgtttgtttgtttgagacagggtctcgctgtattgcccaggctggagtgcagtggcacgatcatggctcactgcagcctctactccccaagctcaggtgatcctcccacctcagcctcctgagtagctgggactataggcatgcaccaccatgctcagctaatttatgtatttttttgtagagacagcgtttcaccaccttgcccagactggtctcgaactcctggactcaagcgatccacccatctcagcctcccaaagtaccgggattacaggtgtgagccacc

SEQ ID NO: 121848 - DNA, 601 bp, Human
aggtactgacaagggacagtctcagggagggaaggaggcaggctggggcagaagctgagaattcatgcctggacctgccacatgtgaaatgtcaccaggacatccgggtggagatgccccacatcgccagagcaagggaggagctgggcaagacgacacacccgggaggtatcagcacagaacctgccagctctgcctcaatgactcggaaagagtaatttggcaaaactacattccaccagctataacttcagcttagagcaatttgcaaagcaatcgacaatatgtatgggccaggcaygatggctcatacctgtaatcccagcactttgggaggctgacgtgggaggatcgcttgagtccaggaactcaagaccagcctgggcaacatggcgaaaccccgtctctgaaaaaaataaaaaattagccaggtgtggtggcatgggcctgtagtcccagctacttgggaagctgaggcaggaggatcccttgagctcaggaggtagaggctacagtgagccatgatcacgccattatactccagccagggcgacagagtgagaccctatctaaacaacaacaacaacaacaaaacaacagt

SEQ ID NO: 121849 - DNA, 601 bp, Human
tgggcctggcccactctgtcagtgacagggacagtgacagtgtggacaatgacccacacaagacagtctgcagaggcaccttgagctgcacttgctggtgaaatgggccctcgggctcctgtcttgagccacccactcagtgaagccaggtactgacaagggacagtctcagggagggaaggaggcaggctggggcagaagctgagaattcatgcctggacctgccacatgtgaaatgtcaccaggacatccgggtggagatgccccacatcgccagagcaagggaggagctgggcaagaygacacacccgggaggtatcagcacagaacctgccagctctgcctcaatgactcggaaagagtaatttggcaaaactacattccaccagctataacttcagcttagagcaatttgcaaagcaatcgacaatatgtatgggccaggcatgatggctcatacctgtaatcccagcactttgggaggctgacgtgggaggatcgcttgagtccaggaactcaagaccagcctgggcaacatggcgaaaccccgtctctgaaaaaaataaaaaattagccaggtgtggtggcatgggcctgtagt

SEQ ID NO: 121850 - DNA, 601 bp, Human
caaagtgcagggattataggtgtgagccactgcacctggcctggaaaaatcctatttgaacaaggtgtaaaggattctgactcagagcagaagatgtgaattctagtctttactctgcctcctattaagtaggtcgctggccctttaagcctcgatttcccagcctgctttaacgcatgccaagtccctccacctgcctaatggaactgctccaagcatccagtgagctaaagtctatgtgacggtgtccccaagccttaagtaccatggaaacaggtaagtgatatgcagtcgccagtcygaaacacgtagacctcaatagcagccagagccccgttcttagatattaaaaggcatactgtgtagatttcaacaaatctcagaaaaccttgaatctgatgaacttctttttccaggaatgaagtccagagagatagatttgtctaagagcttcatggctcagccgcaggtcaatcccgtccggagtgaccgtgaactgaaaggccacagcttggtgagcttctgccatcttcagagagtacctggaaggagaaggagaaaatgtaacacagtggaacgtgtgaccagacactaaaaaacc

SEQ ID NO: 121851 - DNA, 601 bp, Human
aaacagaattgagaacatgtggactcaactgtatttgaacttgtggagagtttctttttttttgtttgtttgttttgagacagagtctcgctctctcacccaggctggagtgcagtggcgcgatctcggctcactgcaagctccgcctcccgggttcgtgccattctcctgcctcagcctcccgagtagctgggactacaggcgcccgccaccacgcccggctaattttttgtattttttagtagagacgggggtttcaccatgttagccaggatggtctcgatctcctgacctcgtgatycacccgcctcggcctcccaaagtgctgggattacaggtgtgagccactgcacccggaccttatgcagagagtttctaatgtgtgaatgttttataaacaaagtagttattacatccacttgctgaagtttggaaaaaatatttttttgtttttttgagacaaagtctcgctctgttgcccaggctggagtgtggtggctcaatcatggctcactgcagtctctgcctcccaggttcaagtgatcctcccacctcagcctcctgagtagctgggactacaggtgcatgccaacatacctgc

SEQ ID NO: 121852 - DNA, 601 bp, Human
attgtgccttccacctgcaattcctggccccaaaacaaagcccaattatgaggagttggtggctattattgacctcaggtgatcgacccacctcggtctcccaaagtcctgggattacaggtgtgaaccaccgtgtccaaatggcaaaaatgccattggtgtaaacaagcagcacagaaatcgaatcaaacgtctggcacggggcagcagggacacttccgagacactgtggagctttcagacccgaaagtaaaatgtgtgtccaagcccaagggtcacggctgcacgaggaagctgagtygccctgcgttccactgtctggacgttcaaatggtggtaaagcagcggtgttcactcgcatttgtctcacagaagcttctggggcagggggtggggggacctcagtgctacactgaagaaagcacagatttcagagctgcgcagagctgggtttgaactctagcttccccgctccctcttcctgtgacttgggcagacacctgcacctgtctgaatgctttctcactggtaaaagggaccctaatgagaggtcactgcagtgcaggctctgaccttcctagatgggagtctgggccatctc

SEQ ID NO: 121853 - DNA, 601 bp, Human
tggaggggtcctctgcagacccttcgcaaaaagaggttcaggaatcagggcacttgctcaagctgtcatcaggagactcagaccattaatctgcttaatcttttatttctagtcatcagaatcaaggctgggcatggtggctcacacctgtaatcccaggactttgggaggccgaggcgagtggaccacctgaggtcaatagttcgagatcagcctggccaacatggtgaaacctcatctctacaaaacatacaaaaattagccaggcatggtggcggacacctgtaatcccagctactcrggaggctgaggcaggagaattgcttgaacccgggaggcggaggttgcagtgagccgagatcgcaccatcgcactccagcctgggcaacggagcaaaaactccatttccaaaaaaaaatcaaattcagccgttaactgtgagtgagttttcgtttacgtctctttttctgccggtttattttcttatttctttctgattaaacaatatttatatgcaaacaacctggaaggcgtgactataaagatccagagcttcgttttttagcttagcccagacccggcattgtgccttccacctgca

SEQ ID NO: 121854 - DNA, 601 bp, Human
atggcaaaaccccatcaatacaaaaataaaatttaaaaaagaaaataaaataagaaataaaaaataataaaaataaaaaataataaatatttcttcaaaataagaaataaaaaaagaaaaccactaatttaacactgcataatatttaagtggacaaaaacaaattatcttcaaggttatatactctttgctccaaaatgtatatctttctataacccgtgaaatctagcactggagtttcactgtagtctcttctttaaacctatacactcttttctggtcatctaacctataaacaaayttgggtttagggatttaagaagctatcttttagataatctacattttagattactgaaagaaaaagacctatatacttacttgatttgcaaaaataaaaatattttagcataaacaaataaatgacacattcaagatttttaaaagtatagacatagaggcactcagataaaaaacgttagcaaaaagctttctttgaaaggacatgctccttacaaggctgtcggggacaaactcagagacaaacctcacatgacacggatgactccacttttttattctttcttttttttaagagata

SEQ ID NO: 121855 - DNA, 601 bp, Human
ttttaaatgaaaactatttaagcatgcttcaaatgattaaaacaccaatatatataacctaaaggtgtccctaatatttgaaaagcactaatttggccaggtgcagtggctcaagtctataatcccagcactttgggaggctgagatgggtggatcacttgggtccaggagttcgagaccagcctggacaacatggcaaaaccccatcaatacaaaaataaaatttaaaaaagaaaataaaataagaaataaaaaataataaaaataaaaaataataaatatttcttcaaaataagaaataaaaaaagaaaaccactaatttaacactgcataatatttaagtggacaaaaacaaattatcttcaaggttatatactctttgctccaaaatgtatatctttctataacccgtgaaatctagcactggagtttcactgtagtctcttctttaaacctatacactcttttctggtcatctaacctataaacaaacttgggtttagggatttaagaagctatcttttagataatctacattttagattactgaaagaaaaagacctatatacttacttgatttgcaaaaataaaaatattttag

SEQ ID NO: 121856 - DNA, 601 bp, Human
ttggttcactgcaacctccgcctcccaggtttaaatgattctcccatctcagcctcctgagtagctgggattacaggtgcgcaccaccacatccaactaatttttgtattttttgtagagatggggtcttgccatgttgcccaggctggtttcaaactcctgtcaggtgatccacccgcctcggcctcccaaagtgctgggattataggtgtgtgccactgtgcctggccagaaatgcagctattttgtggtttgttttagttttggttgttttgggaactgcaaaatattttttaaatgaaaactatttaagcatgcttcaaatgattaaaacaccaatatatataacctaaaggtgtccctaatatttgaaaagcactaatttggccaggtgcagtggctcaagtctataatcccagcactttgggaggctgagatgggtggatcacttgggtccaggagttcgagaccagcctggacaacatggcaaaaccccatcaatacaaaaataaaatttaaaaaagaaaataaaataagaaataaaaaataataaaaataaaaaataataaatatttcttcaaaataagaaataaaaaaagaa

SEQ ID NO: 121857 - DNA, 601 bp, Human
ccacaggccggtgccaaacagcacgccgctgaccacgttcttcgtctggctggacatgcagttgctgtggagacagacccagacaagggaggctgtgcgtgaggccacacggtgccaccaacaccaccggtgacgccacagacaccacgtgctgcagggtccagcagcctgccccaggtacagccgggaaagtcagagggagagcacttgcaggaactgagctcttaaaacactcacgggcactctcctcctcaccccaaaaccaatcacgccgaaagtagctggcagacccaggcgcccrgggcgggcctgtttgctctcttcccagaggtcccttcagcccgatctgctcgggtggcctcgaaaccaaccagggctaatttgtgtcttctggaaaaagatacagcttcctccaggacctcaggaccaacggcagaggggatgctgtgaggccaggacctggccaccgtgagagccatgccctgccgacctgtgcgtccccggcaggtgcgcaggagattctgggccactttcttcagctcttgatgaatttttttctctcaaacttacttttagatgtaatcgtaatctcaaattattt

SEQ ID NO: 121858 - DNA, 601 bp, Human
accccctccacagccagagggacacgcaattaccatccagatcttggtggcacgactcatcttgccgtgctcagtgaacatccacccgtggtaggagagcagcactttcagggagtagcgcatggtgacgatgagggccacccacaggccggtgccaaacagcacgccgctgaccacgttcttcgtctggctggacatgcagttgctgtggagacagacccagacaagggaggctgtgcgtgaggccacacggtgccaccaacaccaccggtgacgccacagacaccacgtgctgcagggyccagcagcctgccccaggtacagccgggaaagtcagagggagagcacttgcaggaactgagctcttaaaacactcacgggcactctcctcctcaccccaaaaccaatcacgccgaaagtagctggcagacccaggcgcccggggcgggcctgtttgctctcttcccagaggtcccttcagcccgatctgctcgggtggcctcgaaaccaaccagggctaatttgtgtcttctggaaaaagatacagcttcctccaggacctcaggaccaacggcagaggggatgctgtgaggccaggacc

SEQ ID NO: 121859 - DNA, 601 bp, Human
gggcttggcctcccaaagtgctgggattacagccatgagtagccatgcccagcccccataaaaacatttaaattgagaccgggtgtgatggctcatgcctgtaatcccaacactttgggaggtcaaggtgggccgatcacttgagctcaaaagtttgagaccagcctggccaacaaaaccccgtctctattaaaaatataaaaattagtcagccatggtggtgtacacctatagttccagctactcaggatgctcaggtgggaaaatcacttgagcctaggaagtcgaggctgcagtgagmcgtgatggtgccactatactccagcctgggcaatggaacaagaccctgtctcaaaaagaaaaaaaaaaaaaaaaaagctgggtacagtggttcacacctgtaatcccagcactttgagaggccaaggcaggatcacctgatgtcaggagttcaagaccagcctgaccaacatggtaaaaccccgtctctactaaaaatacaaaactagccaggcatggtggtgcatgcctgtaatcccagaaacttgggaggctgaggcaaaagaattgcttgaacctggaagggcagagtttgcagtga

SEQ ID NO: 121860 - DNA, 601 bp, Human
agtgtctttgacagccgggaccggcaggcgaggcagcgatgtctggaagctgtacaacatgggttttcggcctgaaaagatcttgaccataccctgaagagagagaattatattttcagactactgccatactactctgaaggcacctgttctcgtctgatctcgtgaagctaagcagggtcagtcctggttagtacttggatgggagaatgaccatttcaaagacaaggctatgttaaagatccgaagccacttttcccgtgcgcacaatgtgccaaccacttactgattttctgtgtcratttatttttcatctggtccatcttttacccgccccatacttacaggttctagcaaataagcatataaccctgccctccatgccaataaaagcctgggcaacatggcaaaaccccacctctacaaaaaattagccaggcatggtggcatgtgcctgttgtctcagctacttgggaggctgaggtgaaaggattgattgagcctgggagggtgatgctgcagtgagccatgatcataccactgcactccagcctgggcaacatagtgagaccctatgtcaaaaagcaaaacaaaaacaaac

SEQ ID NO: 121861 - DNA, 601 bp, Human
cctcagctggtgaccctcaccaatcagatcaaaaacattcgccacccagcaacagatgaacggataaataaaatatggtctagccatgcaatggaatactattcagccataagaaggagggaaattctgacacaggctgctatgtgtatgaactttgaagacattttgctgagtgaaagaagccagtcacaaaaggacaaatatgatatgatgccacttatatgaggtccctcagattggcaaatccagaggcagaaagtagaagagaagttactaggtggggggagggaagaatggggartgactgcaatcatttaatacaatgttgtatttagtaattatgtaaagtagcaaaaactggcctggtgcagtggctcatgcctgtaatcccagaactttgggaggctgaggcgggtggatcacttgaggtcaggagttcgagaccagcctggccaacatggtgaaaccctgtctctactaaaaatacaaaaattagccgggcgtggtggcaggtgcctgtaatcccagctactcgggaggctggggcaggagaatcacttgaacctgggaggcggaggttgcagtgagctgagattgcacc

SEQ ID NO: 121862 - DNA, 601 bp, Human
aaaataaaagaaaacaaagaaaaaaccaatgttatgcaaaattgctccacagactgcttcccaggtctgcctgaagaagccaccgtcccagtccgtggcactaacctggtgttccgcaggtgttgtctctattccctggcacatgtgtcctgaggccacccagaggcagtgccccccaaccacctcacagctgctgtcccttcacagcctgctggacccagggatcgcttcctttcagctttgtgctgaaacacacgtacctacagaacagtgcccatgcaagggcctcgtgtgcggagasctgtgcagagagctgacgtttaccagtccagcacaccggtgcagccagcgaatatgcccggccccctgaggctagagagacccctccaggcactgcccatccacccaccatgccacgtctagcgccacctgctggttctgtcagggtcgctttggacaccttctcttccgtgttagttgttcctcaaagctagactccctcccttgctttgtctgccggaggcctgctcttgccctcccagtacgtggaagcccagccagctccccgcacacagggtgccagctaagacgcttcgttgga

SEQ ID NO: 121863 - DNA, 601 bp, Human
caacagtgagctatgatcgtgccactgcattcccacctgggcaacagagcaagaccctttctcaaataaaagaaaacagaaacaaaggccaggagcggtggctcacgcctgtcatcccagcactttgggagactgaggcgggctgatcacttgaggttaggagttccggacctgcctggccaacatgatgaaaccccgtctgtactaaaaatgcaaaaattagccgggtgtggtggcgggcgcctgtaatcccagctactcaggaggctgaggcaggagaattgcttgaacctgggaggcrgagcttgcagtgagccgagatcgctccactgcactccagcctgggtgacgagcgagactttgtctcagaaactaaagaaaataaaagaaaacaaagaaaaaaccaatgttatgcaaaattgctccacagactgcttcccaggtctgcctgaagaagccaccgtcccagtccgtggcactaacctggtgttccgcaggtgttgtctctattccctggcacatgtgtcctgaggccacccagaggcagtgccccccaaccacctcacagctgctgtcccttcacagcctgctggacccaggg

SEQ ID NO: 121864 - DNA, 601 bp, Human
ttccaggaagaaaagtcttgtttcttatgagcaactaagcagctagtattagttcaaaaacatcaagggcttctccaaagggcagattacagaattaaagtacaacagatgtatattcatttaggagacacaaggagaattacatctcagaataattaggctgggtgaaagaaactagaattccgaaaaaaagagtgcatactgttatgattccacttacacaaagctttaaaaattgcaaactaatctagagtgacagatagtagaccagggggtccaggaccaggtgggagggagagaygacaaagggcagaggggttttcgggttgactgatgtattcaccatcctgactgcagtgatgatggtttctcagatgcatcaatatatacacatcagaagttagcaaactctacactttattttttaatttttttttttgagatggagttttgctcttataacccaggctagagtgcaatggtgttatcttggctcgctgcaacctccacctcctgggttcaagtgattctcctgcatcggcctcccgagtagctgggattacaggcgcgtgccagcacgcccagctaatttttctatttt

SEQ ID NO: 121865 - DNA, 601 bp, Human
aagtgatcctccctcctcagcctcctgagtagctgggaccacaggtacacaccactatgtccgactaatttttgtattttttgtagagatggggttttgccatgttgcccaggctgctctcaaactcctgggctcaggtgatccacccacctcagcctcccaatgtgctgggattacaggcatgagccaccacatctggcctggaaatagggtctttgctgatataattcaatattaagatgaggtcatactggactagggtggaccccaaatccaatgactgttgtccttgtaagagagccacacacacacagaggtgagagccaaggtgacatggaggcagagatcagagtgatatgcctacaagccaaggagcacctggacccccccagaagctggaagaggcataaaggcctcccccagagcctttgaaaagagcacggccctgctgacaccttgatctcggactctggcctccagagctgtggcagaagaaacttcttttgtcttaagacatccagtttgtggtcatttattccagcagccccaagaaactgactcaggtatcatgctcagaatggctgtccaggtacactaagta

SEQ ID NO: 121866 - DNA, 601 bp, Human
aaaagattttctaaattttggtagtaattccattttatagcaatatatattattaaatagaaaaatgccagaacttaagacccttaagataagtctatacctctttccctttttttattttggggaatttgaatggtctaattagtgaggattgtgactgatgggatcctccggtggggatgtctgagaaagtgggtggggctttgcccgatgatcaccaacgaatggcattgcacgtgctcatatacatttacctttctttattttttttttttgacagggtcttgctctgtcacccagkctggagtgcagtggtgcgatctcagcttactgcaagctcctcctcccaggttcaagtgattctcctgcctcagcctcctgagtagcagggattacagacatctgctatcacgcctggttaatttttgtgggtttcttttagtagaggtggggtttcaccatgttggccaggatggtctcgaactcctgacctcaagtgatccacccgcctcggcctcccaaagtgctgggattacaggcgtgagccaccactcccaggctttgtatttacatttctttcattcccagtgatgttgaatgc

SEQ ID NO: 121867 - DNA, 601 bp, Human
ccaccagctgggcttcctcgagtgctcccgggtccctctcactccagctcctccagggccctctgccactgcccacccttccagatcggggccatctggctctctccccaccttcttctctctaggagtgcttggctatggcggcccgcagggcgaataagcctagaaacacgctaggcctcagtgcaccccgctcggggaacaaaggtgacggtgacggtggccggcacgtacggagcccttcctgtgaatgactcccatgggtaagatgctgatctggccctatccagagggggcatcrggaccgaggcgcctacagacccacagggagcccaggccccgcggcgccggctcaggctccccatgtctcctccactggggattccaggctctgagaggagggcatcggatgagcgcatcttcacccgagatgcatctcctgccgccgctctttccagccttgtcaacaccacagcagataccgaacaacgccggcttgcccgcacacatcctcctccatcctgctcctgctcccaggcctggccctctttcaggccctcactacttgggccaccgaaaagcatccctgtgtccagggccc

SEQ ID NO: 121868 - DNA, 601 bp, Human
catcggccgtgtagtagagatttggcgtagctgtccattgacgtatccgggtcttcacttctgtatccttcttcagtttcatctaacgtcacgaagaacgctgctttctccacagcatcaagagactgcttatttttcccacgtccaaaataggcctgacgacacctggcccagggaactctgcagtgaagatgaaatacgattaaaggcagcccgacctgcagcgatggagcgtgatgtttgaaatgacacaatcaaacctttgcagtttttcagaatttctcgaaggaaaactccatgwtgatgatgttccccatctgagactgtttgctggaaggactctcacctgctcctggtctccagaccacagcatggggagcggtgggtattttttgttcaataaatgctgactaaatgaacggccagattgcaggctggccccgtgggcaaagccgccaggaagcagcagacccagatcaccctgttccacgctccctgacacaccctccctcccctctacaggaaccaccctaggtaagttccggcagcccaggtcacagtaagtgcgtaagagtgcgtccctcatgccaggctctgctcc

SEQ ID NO: 121869 - DNA, 601 bp, Human
aacatcggccgtgtagtagagatttggcgtagctgtccattgacgtatccgggtcttcacttctgtatccttcttcagtttcatctaacgtcacgaagaacgctgctttctccacagcatcaagagactgcttatttttcccacgtccaaaataggcctgacgacacctggcccagggaactctgcagtgaagatgaaatacgattaaaggcagcccgacctgcagcgatggagcgtgatgtttgaaatgacacaatcaaacctttgcagtttttcagaatttctcgaaggaaaactccaygttgatgatgttccccatctgagactgtttgctggaaggactctcacctgctcctggtctccagaccacagcatggggagcggtgggtattttttgttcaataaatgctgactaaatgaacggccagattgcaggctggccccgtgggcaaagccgccaggaagcagcagacccagatcaccctgttccacgctccctgacacaccctccctcccctctacaggaaccaccctaggtaagttccggcagcccaggtcacagtaagtgcgtaagagtgcgtccctcatgccaggctctgct

SEQ ID NO: 121870 - DNA, 601 bp, Human
ttcatttattaggccagcaggaaaatttaaaacactgcaaaaagatggtctttatagtcaatgtgaatctcaaaggggcttgttgctttaaaagaaaaagatctcaagtctcatcacaacaagtgaccacagtattttctgtgtcaagtctacggatgatgatcctagaatttagcaactttaaacaagaacctgaccggtgagttaaggaaacaaaactttcatttaatttctcatgccaaacacggaacaggtcaaacagttcagagtaacgaattattaaaaaaaaaaaaaaaaaaamaaaggctgagtgtggtggctcccatctgtaatcccagcactttgggaggcccaggcaggcagatcccctgtgcccaggagttcaagaccagcctgggcaacatggggaaaccttgtttctacaaaaaatacaaaaattagctgggcatggtggcacacacctgtagtcccagctacttgggaggctggggtgggagaatgtcttgagcctgggcggtcaaggctacagtgagctatgattgtgccactgcactccagtctgggtgacagagtaagaccctgtctcaaaaaaaaaaaaaaa

SEQ ID NO: 121871 - DNA, 601 bp, Human
cttccgatctcagtcctgctgcgtacgagctggagccctcaggcaagatgcttcacctccgagtgtggagggcagagatgaagagatgccttcctcggggccgtcctgaagtttcgctcgctcctgccaagtacatggcacagtggctggtgccccttgcagctcattcccacacctgggccacgtgggttctggggagcagatggggtggcttcctttgtggagtctctgagctgcaagctctttggagtcacaagggtggctccctgacaacctctcactttggtccctggaccagagrccttttcaggttttctaccttgagtcaacgtcaccaatttgtactgcttgcagaatagtcatttcagcatgtttcaaaatgtactaaactggagcgtggcatttccttactaaactcctaagtcctgcgcttacttgcagggaattcttttaaaaaagaaaaaaatttaaaaagataaaataacatcctttctgtaggtaaggtatcaactgcttgcatgccctcatactgcacgtttacgggcaaaatctgctcatcaattctcaaaatccagctcattgattctgagatgcgatgcct

SEQ ID NO: 121872 - DNA, 601 bp, Human
actgacacaaaaccagcctctcaccgctggtgtacgccactgtgggtgactattcttttcctacagtgctggattctagttgctaagattttatggagggtctctgcacttccattcatgcgggaagctggtctgtgcttcctttttctgcgtttagctgcagcacagtgatgagagccacaggttctcgaacaagcctgcctgcttccgatctcagtcctgctgcgtacgagctggagccctcaggcaagatgcttcacctccgagtgtggagggcagagatgaagagatgccttcctcrgggccgtcctgaagtttcgctcgctcctgccaagtacatggcacagtggctggtgccccttgcagctcattcccacacctgggccacgtgggttctggggagcagatggggtggcttcctttgtggagtctctgagctgcaagctctttggagtcacaagggtggctccctgacaacctctcactttggtccctggaccagagaccttttcaggttttctaccttgagtcaacgtcaccaatttgtactgcttgcagaatagtcatttcagcatgtttcaaaatgtactaaactggagcg

SEQ ID NO: 121873 - DNA, 601 bp, Human
gcacagagtgacggataaaaggcgaaatgtctccactctgggttcaccgggttttgtgtaacaaatatgtaactgacgattcccctaccgccccttttctcttgcatcatgggaattccgtaacgtggccacgccctcccttccttcccctcctgcctgcttttccttttaaatactgaagccctcaaaaccacctttggaggaaggcacaggcctgtctcccaggcacgcatctttaaccttggcaaaatcaacttctaaataaattgagacctgtctcagacactttctagtttccagwctttttttttttttttttttttttttttttgagagggagtctcgctctgtcacccaggctggagtgcagtggtgcgatctcggctcactggaagctccgcctcccgggttcacgccattctcctgcctcagcctcccgagtagctgggagtacaggcgccccccaccgcgcccggctaattttttgtatttttagtagagacggggtttcatcgtgttagccaggatggtctcgatcttctgacctcatgatccgcccacctcagcctcccaaagtgctgggattacaggcatgacccac

SEQ ID NO: 121874 - DNA, 601 bp, Human
atatggcatcacacactagcactgttactatggggctaatgattcaggttggtagggcttccaaagcaggaggcaaataactgctgcagactagaattaataccactgtctagtgtcagcattcaatccatattcaatattcaatactgatttactgatgctcccggcacaggcaatactgttgtaagacagatcatgcctttgccctcaatgagcaaacattctagcaggagacagggatgaacaaaaaaattctatcacatcaagtcaggccactgaatagaaataacacaggaacagrgaactagggaacagaacaatgcgggaggggctacctttttttttttttggagacagtctcactctgtcgcccaggctggagtgcagtggtgtgatcttggcttactgcaacctctgcctaccgggttcaagcaattctcatgcctcagcctcctgagtagctgggattagagatgcgtgctgccatacctggataatttttgtatttttagtagagacgcgtttccccatgttggccaggctggtcacaaactcctgacctcaagtgatccacctgtctcagcctcccaaagtgctgggg

SEQ ID NO: 121875 - DNA, 601 bp, Human
ggatagtgcagcaagggcccctgctgggaatagcagatggtggataaggacagagactgagtccaaggcagcacgcggctgtgggaggaacagcatctgcgtgctgccccaagaaggggcccggggccaccaggccagctcaaagaggaccaggttccaagtggggacgagaaggtgataagcagcagtttatggacccaaatgattcctgaccagacacatccctgcacattagtgtgcaccctggcacaggccctggtggccccagggtggcagacccacccatctgcaaaggacaccmtgtggcaggctgatactgtcaaatgaacccagaagagggtgccagaggcaaggctgggctgagcacagggcctgctcagcctggggaaggggaagccggacagagcacaggacccactcagctggggaacggggagccggacagagcacaggacccactcagctggggaacggagagtcagacagagcacaggacccgctcagccggggaaggcctggcacctgcacacaggcccagctgaagtcaggctcctcacagtgcagccaagatctctggaggagaggaggcccctgaaaggca

SEQ ID NO: 121876 - DNA, 601 bp, Human
tctactaaaatacaacaacaaaaaaaattagccaggcatggcagcgtgtgcctgtaatcccagctacttgggaggctgaggcaggagaatagcttgaacccgggaggcggaggtttcagtgagccaagatggcgccactgcactccagcctgggtgacagagcgagactccatctccaaaaaataaaaaataaataaataaataaataaaacttaaattaaatttgagctgggcacagtggtgcacatcagctactcagcaggctaaggacgaagaattgcttgtgtctaggagtttgagmccagcctgggcaacactgtaagaccctgtctcaaaaaacaataataatatatttcataaacttacaataaaataaaggatttttaaaacaaaggtggtacgcgctcacagctcatcactccctagttacttccgtgcgtcttactgtgacgtaagctctcgaggtcttcgggtctattaagtcaggggctacatgtgacagcgaagtttttgaagaaatgcagtactaaacgcgctgctcacattttccattttatgacagctacacccacagacccgtttttttcaaatgcccattctg

SEQ ID NO: 121877 - DNA, 601 bp, Human
tcagggcaagagaacttggaagaaatgtggaaattgatgaggttctctcccacaaggatgtacgacacaccatagccgtcatcagcaacctggaggacaagggaatttgaatttgttgctgggaaatgagacaacgtgaaaaagggactttctaatgttctaaatgcaacactggcggggctcggtggcttctccttgtaatcccagcattttgggaggctgaggcaggcgggtcacttgagcccaggggttcgagaccagcccggacaacatggtgaaaccctgtctctacaaaaaaatacacacacacacacaaattagctgggcatggtggcatgcatctgtagtcccagctactcaggaggtggaggtgggaggatcacctgagatgggggagattcaggctgccatgagccatgatcatgcttactgcactccagcctgggtgacagagcgagaccttgtctcaaaaaaataaaaaataagtgcaagactgccaaggacatccatagcaatgatcagcagtaattcctttacggcggtagaaccgcaaggtaacaggggcacccagcacggagatgggcccatcacaccccattac

SEQ ID NO: 121878 - DNA, 601 bp, Human
tcctacctcagcctcctgagtagctgggattacaggcgtgtgccaccacaccagctaagttttgtatttttagtagaggcggggtttcaccatgttggccaggatggtttcaaactcctcacctcaagtgattggccagcctcagcctcccaaagtgctgagattataggtgtgagccaccgtgcctggctgagatacatttgtttaaaactaggtaaagagaattttgaaattcacttatggctgggcacagtggctgaagcctgtaatcccaacactgggaggctgaggtaagaggatygcgtgagcccaggagttcaagacttgcctgggaaatgtggggagaccctgtctgtacaaacaattttttaattaaaaaaatttaggccaggcgcggtggctcatgcctgtaatctcagcactttgggaggtcgaggcaggtggatcatctgaggtcaggagtttgagaccagcctgcccaacatggtgaaaccctgtctctactaaaaatacaaaaaaattagccggggtagtggcgggtgcctgtagtcccagctacttgggaggctgaggcaggagaatcacttgagcccgggaggca

SEQ ID NO: 121879 - DNA, 601 bp, Human
tcctgagcatggtggctcatgcctgtaatcccagcactttggaatcgcttgagcccaggagttcaagaccagcctgggaaacatggtgaaaccacatttctacaaaaaatacaaaaatcagccaggtgtggtggcactcccctatagtcccagctactcaggaggctgaagtaggaggatcccctgagcccaggaggctgaagctgcagtgagccgagatcacaccactgcactctagcctgggtggcagagtgagaccctgtctaaaacaaacaaacaaacaaacaacaaaagaaaaccrcagtgaacaaataaaccccaacttcctctgttaacagcgacagtggcatgggttgccaggctatgtacgacaaggaaagcagaatataaataagggcaatgtgccatgctagggaggaggtcccttgttccatccacagaggaagccgggggtcccctgctctgtatgcagatttcttagtgtgtacccattatttttagttcatcttccaagtgctaaagagtctgaaagttacagcagcactccaacgttaagcttcaaaaccattgctgccaacagaggtaaacatgttaaaccaaa

SEQ ID NO: 121880 - DNA, 601 bp, Human; identical to SEQ ID NO: 24926

SEQ ID NO: 121881 - DNA, 601 bp, Human; identical to SEQ ID NO: 24927

SEQ ID NO: 121882 - DNA, 601 bp, Human; identical to SEQ ID NO: 24928

SEQ ID NO: 121883 - DNA, 601 bp, Human; identical to SEQ ID NO: 24929

SEQ ID NO: 121884 - DNA, 601 bp, Human; identical to SEQ ID NO: 24930

SEQ ID NO: 121885 - DNA, 601 bp, Human; identical to SEQ ID NO: 24931

SEQ ID NO: 121886 - DNA, 601 bp, Human; identical to SEQ ID NO: 24932

SEQ ID NO: 121887 - DNA, 601 bp, Human
aacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgtygttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctattt

SEQ ID NO: 121888 - DNA, 601 bp, Human
taaatatatctttgtaaaaagcacttgaaaaatccagaccaacacagtacctataaacctcacattttataaagtgatttttttctgtatatttcagtgcccattttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccrtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggatac

SEQ ID NO: 121889 - DNA, 601 bp, Human
taagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataycaggtgtgagaaacagaaggatgaacaggcagagagacattttcaatatctgatattccatcaaagcctagaaacaaacagatacacccttcttttaatatgcaaatacagtttaggcatctgcatgggtcagttagcattaggcaaaattttcaataaacctcgttgttgtcgagtccttttataattgttccagtgattaaactaacaaagctccccttcatttatagtccaaatgcttaatccttcaattgggctatgtggtagagagagactctctccctactctctcctgcattt

SEQ ID NO: 121890 - DNA, 601 bp, Human
agcggcatctgttacacttgggaagttaaactgacaggagagggcgaaggaaacctctccagcagattagttagaacagcaagaagatttgactatatgcagatattttattcaaaaaacaaaacaccttacatgcaagagaagattctatcacagttactagaggatgtgattggacctgaattcaataggcagtatctatattcatggaaacattttttttaaataaaagaaagaaggaaagagaaagaaagaaaggaagaaagaaagatggaaagaaagaaaaaaagaaagaaagaagaagaggagagagaaaagaaaaataaaggcgataacgacagtttgtgctcctgacgaaagctattatttccattaaaaagagagtttttacattaaaaaactgcaaagtaagggtgtaaaaaacctgtccctgggatcagatctccctccttacctctccccctccaagcctctggcaaatggtctgaaccacttgatgcggctggcaaaatagggtaccaggagcagaggccatgggcaagaggaaggttgattgtaagaactcaggcaagtcaagattgaaaaaagatccccttcttga

SEQ ID NO: 121891 - DNA, 601 bp, Human
ggaagaaaatccactgcaaactctgaagttacaaataaatgaacatatataaataaagccaatctgactttcttttaaaaatgatctgaattgccctcttagaaacaaagcaaggggaaagggtaaggtggggtgtgtaattggagtgtgagggcaacttaacaaggaataaaaattgtgccaggttcttgcctggcacaggaattgaaacctgtgctgctttgctgaagataggtggggattcgctacaattacagtttgtctacttcaaagctgggctcctctctagggcgacttttarctgcccctacccggtaggttccacagctattgttatattattcaaaccaaagctctagagggggtggggagaagcagatctgaggaccgggtttgggcttcaagatcaggatgtggagcacatcaagtgtgtatgtagcccagctgcatgagagagcaagcttgccagtggtaacttcgagtttaaggcaaaatgcagtctatgaaaaattagttaccagctctttgcaacagtagcttcgtatcaacttatttttctcccatgtccagacgggtcgtctattgaatgtggctcttttat

SEQ ID NO: 121892 - DNA, 601 bp, Human
tactttccaaaggagccaggacgcaggctacccagctgcggccgtgctcagatgtttccacaggaacacaacctgaaccacattaatctgcttaatttcttttgtgaatctttccttgcttagaaagaaaggggagtgggtatctgtgaagacgttcaggagctggtatccctaaatcttgtgaggaagaaaatccactgcaaactctgaagttacaaataaatgaacatatataaataaagccaatctgactttcttttaaaaatgatctgaattgccctcttagaaacaaagcaagggkaaagggtaaggtggggtgtgtaattggagtgtgagggcaacttaacaaggaataaaaattgtgccaggttcttgcctggcacaggaattgaaacctgtgctgctttgctgaagataggtggggattcgctacaattacagtttgtctacttcaaagctgggctcctctctagggcgacttttaactgcccctacccggtaggttccacagctattgttatattattcaaaccaaagctctagagggggtggggagaagcagatctgaggaccgggtttgggcttcaagatcaggatgtgg

SEQ ID NO: 121893 - DNA, 601 bp, Human
tcctgaccccctgccagcttcagccccaaaccaccttcctctccccaccctcaatttgtacacataatgagaatgcttcataatctacactcacatatgaaatctgcaagagacacaatccccatggctggggtactttccaaaggagccaggacgcaggctacccagctgcggccgtgctcagatgtttccacaggaacacaacctgaaccacattaatctgcttaatttcttttgtgaatctttccttgcttagaaagaaaggggagtgggtatctgtgaagacgttcaggagctggtrtccctaaatcttgtgaggaagaaaatccactgcaaactctgaagttacaaataaatgaacatatataaataaagccaatctgactttcttttaaaaatgatctgaattgccctcttagaaacaaagcaaggggaaagggtaaggtggggtgtgtaattggagtgtgagggcaacttaacaaggaataaaaattgtgccaggttcttgcctggcacaggaattgaaacctgtgctgctttgctgaagataggtggggattcgctacaattacagtttgtctacttcaaagctgggctcctc

SEQ ID NO: 121894 - DNA, 601 bp, Human; identical to SEQ ID NO: 112286

SEQ ID NO: 121895 - DNA, 601 bp, Human; identical to SEQ ID NO: 29875

SEQ ID NO: 121896 - DNA, 601 bp, Human
actcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacmtgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaatttgttgtaattctgtctcttgatgtgggttcacagccagccacggccagtggagtctctcaggcggcgtcattctcactccgaccctcctgccttcctctttcacttacaagggcccttc

SEQ ID NO: 121897 - DNA, 601 bp, Human
tatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtrtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtag

SEQ ID NO: 121898 - DNA, 601 bp, Human; identical to SEQ ID NO: 59238

SEQ ID NO: 121899 - DNA, 601 bp, Human; identical to SEQ ID NO: 59237

SEQ ID NO: 121900 - DNA, 601 bp, Human; identical to SEQ ID NO: 59236

SEQ ID NO: 121901 - DNA, 601 bp, Human; identical to SEQ ID NO: 59235

SEQ ID NO: 121902 - DNA, 601 bp, Human; identical to SEQ ID NO: 59234

SEQ ID NO: 121903 - DNA, 601 bp, Human; identical to SEQ ID NO: 59233

SEQ ID NO: 121904 - DNA, 601 bp, Human; identical to SEQ ID NO: 59232

SEQ ID NO: 121905 - DNA, 601 bp, Human; identical to SEQ ID NO: 59231

SEQ ID NO: 121906 - DNA, 601 bp, Human; identical to SEQ ID NO: 59230

SEQ ID NO: 121907 - DNA, 601 bp, Human; identical to SEQ ID NO: 59229

SEQ ID NO: 121908 - DNA, 601 bp, Human; identical to SEQ ID NO: 59228

SEQ ID NO: 121909 - DNA, 601 bp, Human; identical to SEQ ID NO: 59227

SEQ ID NO: 121910 - DNA, 601 bp, Human
tcaactaaataaatatctagataaacagatgtaaataaataatatgactagaaagaagtgttagaagtattaatacgttttacatggtggatgacaggttattttaaaaaattttttctggccgggcgcagtggctcacgcctgtaatcccagcactttgggaggccaaagcaggcagatcatttgaggttgctagttcgagaatagcttggccaatatggtgaaaccctgtctctactaaaaatacaaaaattagccgggtgtggtagtgcgcacctgtaatcccagctactcgggtggytgaggcaggagaatcacgtgaacccagaaggatcacgtgaacccaggaggtggatggaggttgcagtgagctgagatggtgccactgcattccagcctgagggacagagcaagactctgtctcaaaaaaataaaattttttattttctacgctttctaaaacttggcatgtgtaccatgttttacttttcttcaataaaaacagtgaaaatgttattcaaaagaaaagtcgatagggagttggggagcttaccttaaaagaagtagaaaatgtgtgggagattgttaagtgtgataagta

SEQ ID NO: 121911 - DNA, 601 bp, Human
ctttagtttttacaattcagtcaaatagttttaagtatttacaatataatcaaatatatattgtgaaatatatatagtaaaaactattataaaaactaaaagtctcaaggcaactaaatacactgagtcattcaactaaataaatatctagataaacagatgtaaataaataatatgactagaaagaagtgttagaagtattaatacgttttacatggtggatgacaggttattttaaaaaattttttctggccgggcgcagtggctcacgcctgtaatcccagcactttgggaggccaargcaggcagatcatttgaggttgctagttcgagaatagcttggccaatatggtgaaaccctgtctctactaaaaatacaaaaattagccgggtgtggtagtgcgcacctgtaatcccagctactcgggtggttgaggcaggagaatcacgtgaacccagaaggatcacgtgaacccaggaggtggatggaggttgcagtgagctgagatggtgccactgcattccagcctgagggacagagcaagactctgtctcaaaaaaataaaattttttattttctacgctttctaaaacttggcat

SEQ ID NO: 121912 - DNA, 601 bp, Human
aaaaattatagtatctgaagcttaattgactttaacctgaatcaaatcttaactaatttgttagctttggtaagctgataccaagtcttaaaccatgtttatgataagtgcccaactaactcttatagagcacttacttaatgctctataaatattttatcacaaagatggtaatgatttttttttctctttgtagacagggagatttgaaaaagaagaaaaagaaaaagaagggtaaggcattaaaaaagtctttataaattttctccaaaataaatgtttgattttagccctatatagmaatatttggacataaatatactgccctcccttgtatctttgaaaactttttatcttgactatagctaacatttaattttattctattactttaaagatcgcaattcactagtttgcctaaattcaaatcgttgctccctcttttactctgtgactgtggacaggctatttaatatacctgccagagtttttcatatgtaaaatggaatatgatagtatatatccttgtagtattagatactacatgtaaagttcttagagtggtgcctggcacaaaagtaagcacttacacattttgatg

SEQ ID NO: 121913 - DNA, 601 bp, Human; identical to SEQ ID NO: 52220

SEQ ID NO: 121914 - DNA, 601 bp, Human; identical to SEQ ID NO: 52219

SEQ ID NO: 121915 - DNA, 601 bp, Human
gaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatmcagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacctttctactccccatcttttggggatcttgtaactctatgacttacttacgttattctccagtatttcttgaaaatgagcattg

SEQ ID NO: 121916 - DNA, 601 bp, Human
gaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacrggagtcttatagatggtagttaaagccataggcatgaatgagatagcttagaaaaagagaagagaaactagtatacagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacctttctact

SEQ ID NO: 121917 - DNA, 601 bp, Human
aatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttrtagatacaggagtcttatagatggtagttaaagccataggcatgaatgagatagcttagaaaaagagaagagaaactagtatacagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacc

SEQ ID NO: 121918 - DNA, 601 bp, Human
attgtggggaggggaggcacaattcaaaatgaggaaaatagtgtccgtctcattaagggaattaagtttggtgggggatatgattagccaaatagtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggkgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggggaggaagcagatcttaaggtgacagatcactggt

SEQ ID NO: 121919 - DNA, 601 bp, Human; identical to SEQ ID NO: 24926

SEQ ID NO: 121920 - DNA, 601 bp, Human; identical to SEQ ID NO: 24927

SEQ ID NO: 121921 - DNA, 601 bp, Human; identical to SEQ ID NO: 24928

SEQ ID NO: 121922 - DNA, 601 bp, Human; identical to SEQ ID NO: 24929

SEQ ID NO: 121923 - DNA, 601 bp, Human; identical to SEQ ID NO: 24930

SEQ ID NO: 121924 - DNA, 601 bp, Human; identical to SEQ ID NO: 24931

SEQ ID NO: 121925 - DNA, 601 bp, Human; identical to SEQ ID NO: 24932

SEQ ID NO: 121926 - DNA, 601 bp, Human; identical to SEQ ID NO: 121887

SEQ ID NO: 121927 - DNA, 601 bp, Human
tacacaacgaacaaaacaatgctgcaatgaataacagcacagttaattctaatagaaggctttataggcatattttcgtttcttttggtaaatatttaatacttaggagtggaactgctgagtaatagaagagttacacatttaacgttaaaaagttccagttttccaaagtagtggtactattttacatgactagcaagtttatgaatctagctgcttcacatccttgctaacatttcatgctgtcaggcttttaaattgtgcagttctggaagaactagtgtttcatatggatttaatytgcattcctctgatcataaatgaggccattcacataactccttttgtaaagtgtttattcacatcttttgctcctcctgccctttttttgagattacagcaggatatgcccattatttttcattgaatcatttaccttttactagtgatttgtgagcgattttaaaaaaagtatattctggaaataagtcctttacagatatatgtaatgagaatattttgtcctagtctatggtttgcccattttcttaatggtttctttgatgaacaaaaagatgattaattttgatgaagtccagtt

SEQ ID NO: 121928 - DNA, 601 bp, Human
gtaactttcctggagatctcatccttgttctcatctttattttcaaagctggcaacaatgaatgcattgtttttctctccatacctaagaataaaattaaaaacttacaaatcttgaagtcacatcagcaaagcaaaaaatgtccataaaaacaaagagatctggacatgccatcaatacaaggcaaagattgaatcatcacagaacttgaccctacacatttaatatcctaatacagctcaatgccagcaagcaaaccacagttttctacttctggtctatttaagtattcataaacatmaccccattttctttcccttattttctttctactaattcctaaaaaaaaaattgtttaaaacatcaaaaaaagtccattgttttgattacatttttgtatgtaccaatgaaattggttgtacaataaaacattctgatgtatttttatttttttgagatgggtttcactctgttgcccaggctggagtgcagtggcacaatcacaactcactgcagactctacctcctgggctcaggtgatcgatcctccaacttcaaacctcccaagaggctgggactacaggagtgtaccaccatgctc

SEQ ID NO: 121929 - DNA, 601 bp, Human
aaatacaaaaaattagccgggcatggtggtgtgcgcctgtaatcccagctactcgggaggctgaggcaggagaattgcttgaacctgggaggcagaggttgcagtgagctgagatcgcaccactgcactccagcctgggcgacagagtgagactccgtctcaaaaaaaaaaaaaaagttgctacgggatggtagaaagggcattagactagtttctcattctggctctgccactgactagcttggtcaccagaggcaagtcacttaatttccctaggccttagtttcctatatgctggacraggaagctggagctggctagatagtggttgatctacggctggtgactcttcgtagtataaaatacctaaacagaagctggacatggtagcttacatctataattctagtactttggaaggtcaaggcaggaagattgcttgagcccaggagttcacaattatagtgagctatgatcatgccaccgcattccagcctggacaacacagcaagaccctctctctaaaacaaaacaaaacaaacaaaaaataaattcctaaacaattgagttcctcacaacataaaatttgtgttctctaatt

SEQ ID NO: 121930 - DNA, 601 bp, Human
tacctaactaacatgttattggcttatttcatttaacttctatttacccaagcacttttatttaaatagttgtcaaaattaagtgaggaaaatttctaaaccaataaagcctctgtcccatctttttttaacctattatacgacatctacctaatggaatgtttaataaataaaaaatatgcattctgttaaatgataagcattctgattaagtagggaaatagggcctatgaaggaaaagtatttactgcctacaatcaagaatcaatcaagagaacttggatttcagcactaatcctastatttatcaggtaagcctagttaagtcactgtacctcttcctcagacctgtaactataaaacatggaaatacaagttaattgatgaatagtaattacgctgtaaaatacaatgatataaagactaatgtgctatttaaagtttttgtaaaagttaaattattagttggttttaatttctatttaaaaaatgaaaaagttctcaacaggtaataggaataagtgtttctacataataatattaacaataataagcattttaaaaaatttattatgcaatggacaatttcctaaatgctttg

SEQ ID NO: 121931 - DNA, 601 bp, Human
acaatcaagaatcaatcaagagaacttggatttcagcactaatcctagtatttatcaggtaagcctagttaagtcactgtacctcttcctcagacctgtaactataaaacatggaaatacaagttaattgatgaatagtaattacgctgtaaaatacaatgatataaagactaatgtgctatttaaagtttttgtaaaagttaaattattagttggttttaatttctatttaaaaaatgaaaaagttctcaacaggtaataggaataagtgtttctacataataatattaacaataataascattttaaaaaatttattatgcaatggacaatttcctaaatgctttgcatgtattaactcttaattctcatgatcatcctgtgagttagatacttttttcctcagcataaagaaaaaaggaggcagagagagtttgagtaacttcccaacattacacagctactaagtgatggatctagggttcaaatccaggccactagactccaaagagcaagttatttccttaatactcaaccctgtatatacgtacctatcttagcgtcaccattaacaatataacaaaggcaaagtgagaaaaat

SEQ ID NO: 121932 - DNA, 601 bp, Human
taatataagctacaacatgggtgaaccttgaatacatcacactaagggaaagaagccagtcacaaatgaccacatattgtacgattccattgatatgaaatatccagaataagcaaatctatatagacagaagacagattagtggcctacggggaagtgggaaaccaagaaaaggagcattgctaataagtacagggttactttttgaggtgataaaaatatttactaaatttcactatagtaatggttgtacaactttgtgaatatactaaaaccattgaactgtacattttaaatgggygaattgcatggtatataaattaaatcccaaaactgttctacataaaaaatttcagcattgactttccgaaagtactctttcaggaagagagatacatttatccacaagttaagagacacaaaaactagtggatctatcaggacatatttaagaaatggaaattcaggtcacccgcagaaaaacaaactaaaagaaataatcagagatttagctacattttggattgcctcaaaggactttaaaaatggtatatctgatttatcattgattaatccttaagggcaaacccttgtcctaaga

SEQ ID NO: 121933 - DNA, 601 bp, Human; identical to SEQ ID NO: 39044

SEQ ID NO: 121934 - DNA, 601 bp, Human; identical to SEQ ID NO: 39043

SEQ ID NO: 121935 - DNA, 601 bp, Human; identical to SEQ ID NO: 39042

SEQ ID NO: 121936 - DNA, 601 bp, Human; identical to SEQ ID NO: 39041

SEQ ID NO: 121937 - DNA, 601 bp, Human; identical to SEQ ID NO: 39040

SEQ ID NO: 121938 - DNA, 601 bp, Human; identical to SEQ ID NO: 39039

SEQ ID NO: 121939 - DNA, 601 bp, Human; identical to SEQ ID NO: 39038

SEQ ID NO: 121940 - DNA, 601 bp, Human; identical to SEQ ID NO: 39037

SEQ ID NO: 121941 - DNA, 601 bp, Human; identical to SEQ ID NO: 39036

SEQ ID NO: 121942 - DNA, 601 bp, Human
tgcatctttctgttggagaatctcggcccccaggcatgaggcctagtgcgccattgtcctagcctgcaggaggagctgaggtcggccgggtcctctggggaagaaggctgtgttcatgacctggggctgtacggcaaaaattgtgttgagtgtcctcggccttgccagctccggccctcagccgccagtcacccggggggcctgcccatcagagggctggttgactgactggaaaaacatgggctgggcaggtcctggcccgcaggtatggatacttgctggatctggtagagctgctgtscatctgtgaactggctgaactactgctgtctttgctggacctctgtctgtgtaatcggttgagcgctggtggcaagtgtctggatctgtccctgcagaacgtgggtgcctgatacagactgggctaagcggatacactgcagctggccagccttcagctgcaccgggatctgctggatctctcctgtgttagtgaggatctgctacatcacctgcacggtccatccagtaccactctgggcctactgggcttgaccctgtggctgggcctggacaatctgcacctgctgaccttctccaa

SEQ ID NO: 121943 - DNA, 601 bp, Human
ccaacctgcgtcgtcacgggcgtggtctggccctgctgaagctgtgcgatgatgatctgcccaggctgcatggtggtcatggagctggcggtggtctggccttgctgctgtccctggacttggacgggcggtgggctgctgagccagcgtgaaatagtattggactggctcagcaggagttacagactgcagcacctcctcctgacactttggaggtttcagttcatctcttagaacaatatcgatgagaaaatccaattgatcaaatttcgtaattgccatggcgacataagtccggcasttgttatcctctgtgtgaatccaggctcgaagagtcaactctgtgataaaaaatctgggctgccctggcaaagagcacaggggcctctgcactgatcatcttcacatcttcatccagtttcataatcttcttaatacgagccagtgggagttcctgcattcagaaatctttcactgctaaattccagatttcttccatgacccgaagccagaaggactttaggctttgctgggcatcactgcggctagtaccaccaaatcctccttctgtggacatttcgacaaacgcctcttcagggag

SEQ ID NO: 121944 - DNA, 601 bp, Human
gaatttacttttcacttttatttttccttcccttttccaatgtttgggatccgcagaggatgagtgctcaacgtacagcagagaggaggataaagctgtaagcagtgtctcagatttgattgtgatctctctcttaaataatgtcctcattgtctgattgagacagaaactccccacctccctattaaaaattttttttataaaccctgacccagaggtttctgaagcctccattgataacacacaatggcctgttcttctaggatgtttcatggcctttaaggaaggctctgttcgcccrcatgatgaaagggtgagagatgagcaaggagaagccgaggttcacccgcctcgccctggctaggcagaggactgtgggcaagtgcaggaatccataaaggacgagctgggccgagggaagccacgtttgtatctcaaggacaagaaataggcaaaccttcacaggaaatatttcccggcacctttcagcttagaggacagaggaaagaggaggcaagaaggaaaagggaaataaagtcacagaagggggaggaaagggagggaacctaagcaagcaccaccatgagccagagccagtgtt

SEQ ID NO: 121945 - DNA, 601 bp, Human
tttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataatatgttttaatgtaaattctttctggtccacgtaa

SEQ ID NO: 121946 - DNA, 601 bp, Human
aaaatttaagttctgtatgtggctcacattatatttctattggattacactgctgtgtacagtatgtttaaagagaatggtgacatgaattgtgttatgagtaatgagaaaaaatcattttaaactcaccattatctggccaggtaatactaactttttatttaaagaatttacagtgttgccattcattgaagatacaggttatatgatttttactatagattttatatatgttttggaggatctgtgaagtaattaacattttgattactgaagccagttatgtaggctttacaaaggyagattttatttgaagcaattaaggatatgattttaatctgttttaaagtttccagaacgtccactaactaaaatataaaggctctgtaatctataaaactctacagagctatacatcttcatgtccttcctttttatttttcttttttctactagcagttatagaaaccagattcattgcagtgtaagaaaacaagacagagcattttcttttggtaacttgattctgtaattagaactatgctttcagtagtattcattaattaaaagtatattatgaataagaaatcggttaagaaaa

SEQ ID NO: 121947 - DNA, 601 bp, Human
ggtaggcactcctaccccatgccagataaagaatcaccagcgaatattagagaaaacaatccccagcactcacgcacggcccagaggaactccgaattccgccaatcatggtgaaaaccttcacaactcaaggatttgttgagtagaatgctgctcagggcccaccccctaaaaaaagtgtaaaaacatgacctgaagcatcaagctctttccaaggaacttacctgcaccccagaacaaagctcaaaaatattcataaaaataaacattatatgtatctcaaagtaaacttctcaatgtgtggcattcaataaaaaattatctggcttgtaaagtaggaaaatattacctacaatgaagagaaaagccaatcaatataaacaatctcagaaattacttaggtgataaagttagtagaaatgacacatgttccatatgcttgagcactaaacacggaaaccagaggacccagatgcaggtccagacaccgagtgaaacttctgcaggtgaaatggcaatgcctgagacgaaaaatacgctggatggaattgacagcagattagatactataggaaagatgagtgaatttaaagacacagca

SEQ ID NO: 121948 - DNA, 601 bp, Human
gtccctctagagaaccccgaccctgactaatacacctggcaaactgccatttactgagatacaaaagattgcagaaggcactggtttggtcaagaaatctggatgtttggtttgtttgtttgtttgtttattttgagacggaatctgctctgtcgcccgggctggagtgcagtggcatgatctcggctcactgcaacctctgcctcccaggttccagcgattctcctgcctcggcctcctgagtagatgagactacatgtgcgcgccaccatgcctggctaattttttgtattttttagtrgagacagggtttcaccatattgtccagcctggtcttgaactcctgatcttgtgattcacccgccttggcctcccaaagtgctgggattacagccgtgagccaccgtgcccggccttggtttttatttcgttagtattaagaaacctaataggcattcattcaagtggacgtatcaagtaagcaattgtacatagaagcctaggcaagctagaaattaaggaatcatcagctttagatcatattgaaagccttaagaccagatgaaatgaatgagcaagtaagtgactgcagagaaagact

SEQ ID NO: 121949 - DNA, 601 bp, Human
ttttgggacttggactgatccaccactggcttccttgcacctcagcttgcagacagccaatcatgggactttagcttgtgatcgtgtgagtcaattctcctcaataaactccctttcatatatacatgtatcctattagttctgtccctctagagaaccccgaccctgactaatacacctggcaaactgccatttactgagatacaaaagattgcagaaggcactggtttggtcaagaaatctggatgtttggtttgtttgtttgtttgtttattttgagacggaatctgctctgtcgccygggctggagtgcagtggcatgatctcggctcactgcaacctctgcctcccaggttccagcgattctcctgcctcggcctcctgagtagatgagactacatgtgcgcgccaccatgcctggctaattttttgtattttttagtagagacagggtttcaccatattgtccagcctggtcttgaactcctgatcttgtgattcacccgccttggcctcccaaagtgctgggattacagccgtgagccaccgtgcccggccttggtttttatttcgttagtattaagaaacctaataggcattc

SEQ ID NO: 121950 - DNA, 601 bp, Human
ctgttttgttttgttttgtttgagatagagtctcgctctgtcgcacaggctggagtgcagtgacatgatctcgggtccctgcaaactctgtctcccgggttcaagcgattctcctgccttagcctcccaggtagctggaactacaggcgcccccaccacgcccggctaatttttgtatttttagtagaggttggggggttacaccatgttggccaggctggtctcgaactcctgacctcaaatgatccacccaccttggcctcccaaagtcctaggattacaggcaacactggctgttttaaaggagaattgtcatttatttttggttttgtttgtttacattttaataggattgctctagcagctgtgttgagaaaagacaacacagggagacaagcatagaagcaggaaggggaggtagctgcaaaaggcaggagagaggtgaggcgggctggtccaggaggtggccaggattcgggggtgaggcagtgggagtagcaaaagcagattctggatgctcttgacagtagagcctgtaggacttgctgatggatcaaatgtgggtgtgagaagtcaggcaggactcccaaggtttggccct

SEQ ID NO: 121951 - DNA, 601 bp, Human
gggggtgacagaaaagttccatactgggacgaggttgaagttgtcgcatgaccgtgtacatttgtcaaaactcattgtacacttaaaattggtgaattttgttgtatgtaaaattataccccagtaaagctgattaaaatgttaaaattaaccataaaagaaaatttcagttggtggtgttcagggattattttattttattttattttatttttgagacggtgtctcactctgttcctcaggctggagtgcagtggcgcaatcttggctcatcgcaacctctgcctcctgggttcaagcrattcccctgcctcagcctcccaagtagctgggatcataggcatctgccaccatgcccagctaatttttgtagttttagtagagacggggtttcactatgttagccaggctggtctcgaactcctgacctcgtgatctgcctgcctcggcctctcaaagtgctgggattacaggcgtgagccacggagaatttttttttaagcagttcttgtgaaaactatcttttaaataagaaaccaggctgaaaacaggccatttaatttgaaacacagtatcgaaaataaataagtaaataaaagat

SEQ ID NO: 121952 - DNA, 601 bp, Human
aaatggtattggctactgtctggtggaacacaaatgaagatgtttgaaagggcaagaaagacaggctgctgagaggtctagaggtggagcgtatggtgggtggtctgtgcagtggggaaacccccaccttagtttcctggagtaggttacatcttcccatgtgaaagccaataatccgttaccaaaacgtctcaaaatgagtccacaaagggctggaaaaaggcataaaggaactcttgggggtgacagaaaagttccatactgggacgaggttgaagttgtcgcatgaccgtgtacattygtcaaaactcattgtacacttaaaattggtgaattttgttgtatgtaaaattataccccagtaaagctgattaaaatgttaaaattaaccataaaagaaaatttcagttggtggtgttcagggattattttattttattttattttatttttgagacggtgtctcactctgttcctcaggctggagtgcagtggcgcaatcttggctcatcgcaacctctgcctcctgggttcaagcaattcccctgcctcagcctcccaagtagctgggatcataggcatctgccaccatgcccagcta

SEQ ID NO: 121953 - DNA, 601 bp, Human
taaagggcacatttcaccaagctgatagatggaaatggtattggctactgtctggtggaacacaaatgaagatgtttgaaagggcaagaaagacaggctgctgagaggtctagaggtggagcgtatggtgggtggtctgtgcagtggggaaacccccaccttagtttcctggagtaggttacatcttcccatgtgaaagccaataatccgttaccaaaacgtctcaaaatgagtccacaaagggctggaaaaaggcataaaggaactcttgggggtgacagaaaagttccatactgggacraggttgaagttgtcgcatgaccgtgtacatttgtcaaaactcattgtacacttaaaattggtgaattttgttgtatgtaaaattataccccagtaaagctgattaaaatgttaaaattaaccataaaagaaaatttcagttggtggtgttcagggattattttattttattttattttatttttgagacggtgtctcactctgttcctcaggctggagtgcagtggcgcaatcttggctcatcgcaacctctgcctcctgggttcaagcaattcccctgcctcagcctcccaagtagctg

SEQ ID NO: 121954 - DNA, 601 bp, Human
tgcctgtaatcccagcactttgggaggccgagttgggtggggagggggggtggtggatcacctgagatcaggagttcgagaccagcctggccaacatggtgaaaccccacatctactaaaaatacaaaaattagcctggcatggtggtacgctcctgtaatcccagctactcaggaggctgaggcgggagaatcacttaaacccgggagacggagatcacagtgagctgagatcgtgccactgcactccagcttgggtaacagagcaagactccatttcaaaaaagagaaataattaaaamaaaaaatgaaagcagagataggagcaacacttgctgggaacaccaaaaatggccagtaaggcaccagaagccaggagacaggcctggaacagaatttccctcagcattcagagggtagcaaccctgctgacaccttgaccttggacttccggcctccagaactgtgagacaataaatttctgttgtccaagccacttggtctgtggtactttgttacagcggccccagtcatctaatccaggaaggtgacatggtgcgacaccagagtttgattgcatgcctgctgacctggctgctagt

SEQ ID NO: 121955 - DNA, 601 bp, Human
agattttacattatcagctcagagagctccaaactccttgcccagccaatacccaacaattcctacagaatgggggcagggggagtaaatttttaaaagaaactgaacagataatgttttaaggaggaaatcaaccatctcaacagagaggatcgaggaaaagttctgagtcgagctcctccctaagaaaggagggagagggccgggtgcagtggctcacgcctgtaatcccagcactttgggaggctgagatgggaggatcgcctgaggtcaggagttcgagaccagcctggccaacgtrgtgaaaccctgtctctactaaaaatgcaaaaattagctgggcgtggtggtgggtgcctgtaatcccagctactcgggaggctgaggtaggagaattgcttgaagccaggagacagaggttgcagtgagccgagatcgcaccactgcactccagcctgggcaacagagcaagactccatcgcaaaaaaaaaaaaaaaagaaaagaaagaaagaaaggagagagaatgcaggagggagagtgagactcgggaaagaacaggggaagttgacaaccaccctttttctaccagctctcatttag

SEQ ID NO: 121956 - DNA, 601 bp, Human
tcaaggcatcagcaggattagaactttctgaggggttgagagagactctattccatgtcccgctcctggcttctgggggctgctggcaatccttgcgcattcctcggtctgcaggtgcatcagtccagtgtctgtctccattgtcacatggcattctctccttgtgtgtctctctcctcctctttttttgttttgttttgttttgtttttgttttgtttttttgagtcagggtctcccttgttgcccagactggagtgcattgatatgatcatagctcactgcagcctcggactcctgggytcaagccatcctcccactagccttccaagtaggtgagactacagctgcgtgccaccatgtctggctaatttttaaatttttagtagagatggggtctcgatatgttgcccagcaaatcctgggctcaagcgatcctcccgcctcagcctcccaaatcgctgggattacaggtgtgagccactgcacccagcctctcctcctcttataagaacacagtcatactggattaagggcttgccctaatgacctcaccttagtttcatagttacatctgcaaagaccctttttccaaataagtct

SEQ ID NO: 121957 - DNA, 601 bp, Human
tcctttaagtgttaccacaactccatttctgggcatcactgcctttggctcatttgagagtcaagttttcatgagaagcttctttgtaacatttccactcacagaccctggcaaactgacttcagagtctagcttttttttttttttttttgagatggagtctcgctctgttgcccaggctggagtgcaatggcgcgatcttggctcactgcaatctctgcctcccaggttcaagtgattcttctgcttcagccacccaagaagctaggattacaggcacccaccaccacacctggctaatttttttttttttttttgtatttctagtagagatgggatttcaccatgttggccaggtcaaactcctgacctcaggtgatccacccacctcagcctcccaaagtgctgagattacaggcatgagccactgtgcccagccagagcctagcttgtaatcactccgctctactacctcccaccttcctttctttgtgtaataagattgcagtacacagtgctgtacaataaacaaaatatttttatacacatagtcacacttcatcctcacagggatcctgaggcaggagaacagttacttttg

SEQ ID NO: 121958 - DNA, 601 bp, Human
tgccgtggaatatgtgaaggagcactggaaagtcatagttcaggaaaagatcatggaagaaatgacaccctgagtcttgaagaaggaataggatatcagagcacaatgattagagaaggttggaggaggaggacaagatgggaagaaaggacctttaaggtagaaaaagcttcctacacaaaacccacagcatgtctggaaatgatgagtggttctgaagcaacagaaaggagcgtgcctggcagtagacaagaaggggcagaaagcggggtggccaggcctggagggatgccagcttcakagtcagaagaatccgggctcccctaaactcaaccattcacttgggggtgtgggggagatgaggcaggtgctgaatcggccagatttcagctctgagcttctccttatctctaaaatggaatcataaaatccactccttgcagagttcttctaagaattaggaagaaagtgtgaaaagtgtctgccatgtagaagacattccatgtgatgataaggttattgttattaaaagtaagttggagtcagatcatggtgtgctaaagaagttttttatcctatggacagtgggggtcacagaagg

SEQ ID NO: 121959 - DNA, 601 bp, Human
cctattcagcacaacattaaatgacaagaccttgggtagaaatactttcattctcagagtgtcaatttccctgcctgttcaaatgagacaggttaactacaaaagctaggcacagatcaactctgtggcttctccccttgggtgccaaaatgttaaagctttgaaaatggcagagtattttcaggtgtggcatcacactgccacccctaggctcatgagagatatcctaaaaagactgaagcctcaagaagccctagatcctagctacatttattcaaaagctggataatttacatgctagggggaattcttacagaaaatgccattcattcattcattcactcactcaacaaatatacagtgaacacctatcctatgaaaagctagatttataaaaaggttagaaaggcatgactgatatttgccttcaagaaacagtctaggggtagtaagtatataggtgagtacatgagaaattatgacacagcctggtggttgccgtggaatatgtgaaggagcactggaaagtcatagttcaggaaaagatcatggaagaaatgacaccctgagtcttgaagaaggaataggatatcagagcaca

SEQ ID NO: 121960 - DNA, 601 bp, Human
cctgtcacctccctccccatcccccgcaagcctctatcatctttcaggatgggcaacagcccctaatggctccccacgtctggactttgtcccttacagcctagtctccatgagtctttagcatcctagtgcctcttgttagtaactgtcttgtgccctatcccttaatcgcatcaggtctcactcagaatttaaaaatagaaaaatgctttcagtggcctacaagaccccatattctgccctacacagcctggttcactccccattccattgatctccctgccccggctgctgtccctgsaggccccatcagtatgctcccatctcagggtctttgtcttctggagggctcttcccccagataccacaacctttgctccctcccttccccttcggtctgggtacaaatgtctccttatggaagaatcctgcaggcaccctactgaaagcagaactatggcttcccccgccctctcgccctccaggcaggcccaacccccctcaccattcgtttttttcacttacttatcaccgctgatgtgctatatatttacttatttgccacatctgtctcctcccacatgcaagtattgctccatga

SEQ ID NO: 121961 - DNA, 601 bp, Human
aaaaaccccactcttcatctcccagcaaatccagtggattctgccttcaattatatccagaatccagccatttcctgtcacctccctccccatcccccgcaagcctctatcatctttcaggatgggcaacagcccctaatggctccccacgtctggactttgtcccttacagcctagtctccatgagtctttagcatcctagtgcctcttgttagtaactgtcttgtgccctatcccttaatcgcatcaggtctcactcagaatttaaaaatagaaaaatgctttcagtggcctacaagaycccatattctgccctacacagcctggttcactccccattccattgatctccctgccccggctgctgtccctgcaggccccatcagtatgctcccatctcagggtctttgtcttctggagggctcttcccccagataccacaacctttgctccctcccttccccttcggtctgggtacaaatgtctccttatggaagaatcctgcaggcaccctactgaaagcagaactatggcttcccccgccctctcgccctccaggcaggcccaacccccctcaccattcgtttttttcacttactta

SEQ ID NO: 121962 - DNA, 601 bp, Human
cttctctgattatagagccattatctactccactgctcaggaaaaaccccactcttcatctcccagcaaatccagtggattctgccttcaattatatccagaatccagccatttcctgtcacctccctccccatcccccgcaagcctctatcatctttcaggatgggcaacagcccctaatggctccccacgtctggactttgtcccttacagcctagtctccatgagtctttagcatcctagtgcctcttgttagtaactgtcttgtgccctatcccttaatcgcatcaggtctcactcmgaatttaaaaatagaaaaatgctttcagtggcctacaagaccccatattctgccctacacagcctggttcactccccattccattgatctccctgccccggctgctgtccctgcaggccccatcagtatgctcccatctcagggtctttgtcttctggagggctcttcccccagataccacaacctttgctccctcccttccccttcggtctgggtacaaatgtctccttatggaagaatcctgcaggcaccctactgaaagcagaactatggcttcccccgccctctcgccctccaggc

SEQ ID NO: 121963 - DNA, 601 bp, Human
gaaatgagactatgggagttctgaggcaaaggcatgaaaatgtcacctgcttcatatcttgttttcttgggaggccacttttggagcccagccgccatgccatgagggagtgaaccccaacacgaggaggtgcaggagttctggctgacatcgcagctgacggcccagctgacagccagcatccacagccagacgtgtgagtaacaagcctcagatggctccagccaacctttgagctgccctaactaatctcacctgcagccgtccccatcgaaccctgcccaggctgcaactggtgagmaaatcaaatgattgctgatgtttcatgccactaagtgcaggatggttggtttgtttgtcactcagcagtagataactgaaacgcatctgccgaaaaccttctctgattatagagccattatctactccactgctcaggaaaaaccccactcttcatctcccagcaaatccagtggattctgccttcaattatatccagaatccagccatttcctgtcacctccctccccatcccccgcaagcctctatcatctttcaggatgggcaacagcccctaatggctccccacgtctggactttg

SEQ ID NO: 121964 - DNA, 601 bp, Human
ataaaaattatgcaatgtggctgggcacggtggctcacatctgtagtcctagcactttgggaggctgaggcaggtggattgcctgagctcaggagttcgagaccagcttgggcaacacggtgaaacctcgtctctactaaaatacaaaaaattagctgtgcatggcagcatgtgcttataatcccagctactggggaggctgaggcaggagaatcgcttgaacctgggaggcggacgttgcagtggggcaagatggcgccattgcactccagcctgggtgacaacgcgagactccatctcaaaaaaaaaaaatgcaatgcttaataaactctctcttatcctgatcctccttcctctcctcctcctcctcccaccaccacgtctctcctcattccaggtggctttaaatatcaactgtataataaagcctccaacgtgtatttccccaaccttgacctctcttgactcatacatccatctgccaactcaacatccctctgtgatagttaacaagcagcttatgctctacaaatcttgatttctgcatccttcacgtggcagacgacattgaccaaagatgggcacaatacctcctatccca

SEQ ID NO: 121965 - DNA, 601 bp, Human
aggctggaatggaaggtagagacaaccatgaaagttgaacacgtcatctgtgcaggaccgttcatactgacatgtggcttgacaccagaaatctgggtattgtaatatcatgttggaaaggagtttgtgtgcctcaaacaactactctagagatgttttacaatgacaatgatagagtagaggaatcttctaattcctaccaaatcagaagggaattcctccttcctgcctgcctgcctgccttcctttctttctctacttccttttctttctttctttccttccttcctctctctctttctctctttcttcctttctttccttctttctttctttctctctctctctccccttccttccttccttccttcctgagacaaggtcttgctctgtctcccaggctagaatgcgatggtgcaatcatgattcactgcagcctcaacatcccaggctcaagtgatcctcccacctcagcctcctgagtagctgggactacaggggcttgccaccacgcccagctaatttgcgtgtgtgtgtgtgtgtgtgtgtgtgtatgtggtagagatggggtctcactatgttgcccagctggtctcaaact

SEQ ID NO: 121966 - DNA, 601 bp, Human
agcaggctggaatggaaggtagagacaaccatgaaagttgaacacgtcatctgtgcaggaccgttcatactgacatgtggcttgacaccagaaatctgggtattgtaatatcatgttggaaaggagtttgtgtgcctcaaacaactactctagagatgttttacaatgacaatgatagagtagaggaatcttctaattcctaccaaatcagaagggaattcctccttcctgcctgcctgcctgccttcctttctttctctacttccttttctttctttctttccttccttcctctctctctttctctctttcttcctttctttccttctttctttctttctctctctctctccccttccttccttccttccttcctgagacaaggtcttgctctgtctcccaggctagaatgcgatggtgcaatcatgattcactgcagcctcaacatcccaggctcaagtgatcctcccacctcagcctcctgagtagctgggactacaggggcttgccaccacgcccagctaatttgcgtgtgtgtgtgtgtgtgtgtgtgtgtatgtggtagagatggggtctcactatgttgcccagctggtctcaa

SEQ ID NO: 121967 - DNA, 601 bp, Human
taatactgttacattggggattatctttcaactcgaattttggttttgtttgtttgtttgtgacagagtctcgttctgtcacccaggctggagtgcagtggtgcaatctcagctcactgcaacctccgcctcccaggttcaaacgattcttgtgcctcagcctcctgagtagctgggattacaggcatgcaccgccacgcctggctaattttttgtatttttagtagagttggggtttcaccatgttggccaggctggtctagaactcctgagctcaggcaatccacctgcctcagcctcmcaaagtgctgggattacaggggtgagccaccgcgcccggcctcagcatgaattttggaaaagacacaaacattcaagccaaagcaatatccttatgttaattccagttatctctgaccatggaataatggataactataattttattctttgtgcttctctgtacaatccaatttctctctacaataaatatgtattgctttcagaatcaatgaaaataagttgcatttaagaaaaaatttttctcttcttcccagtttgaaatacattttctttaaattcaagtctactgccacattag

SEQ ID NO: 121968 - DNA, 601 bp, Human
taaagatgaacatcctattatgacgagcaggtcaattcttcaagaagacatagcaagattaaatgtgtgtgccccttataacagagcattaaaacacaggaaggaaaaactagtagaaagagaaaatagacaaattcaaaattataatgggagattccaacatctctctcttattaattgatggaataagtacacagaaaatcagaaaggatatagaagatttcaataacattagcaaccaacttaacctaattgacatatatagaacacttcatccaacaatggcaaaatgcaaattctyttcaggtgctcatgggacattcaccaaaacagactacattctggcctgtaaactagatctcaataaatttaaaatgattaaattcatacaaagtatattttctgatctcaatagaattacattaaaaattaataggccagacgtggtggttcactcctgtaatctcagcgctttgggaggctgaggcgggtggattgcatgaggccaagagtttgacatggcaaaaccctgcctctcctaaaaaaatagagaaattagccagccatgatggtacatgcctggctaatttttgtatttttt

SEQ ID NO: 121969 - DNA, 601 bp, Human
tgagcccaggagtttgaggctgcagtgagctattaccacaccactgcacttcagcctgtgtgacagagtgagactctgtcaaaaaaaaaaaattaaaaattaaagtaaaaagcagaattgtcaggttagcgtcaaaaaacaaaaaagcaagactcagtctatgctgtctataagaaacccactttaaatataaagacataaatagtttaaaagtgaaaggctgggaaaagatatgccatacacacactaattgaaaaaagctaaagaggctgtatttatagcagacagagtagtattcagkacagagaatattaccagggataaagatgaacatcctattatgacgagcaggtcaattcttcaagaagacatagcaagattaaatgtgtgtgccccttataacagagcattaaaacacaggaaggaaaaactagtagaaagagaaaatagacaaattcaaaattataatgggagattccaacatctctctcttattaattgatggaataagtacacagaaaatcagaaaggatatagaagatttcaataacattagcaaccaacttaacctaattgacatatatagaacacttcatccaac

SEQ ID NO: 121970 - DNA, 601 bp, Human
tacaggaagaaagactggggtaagttaaagatgtatatgtagaccctagagtaaccagtaaaaaatagaaatagaacaaagaggcatagctaataagctaagagctgagataaagtataattagaaaaaatactcaattattccaaaagaaggcacgagaaaagaaagaagatgggacaaacatggggttggggtacaaatgcaggatagtagatggaacccagttgtatcaagaattacatcaaataaatggtctaaacattccaattaaaaagcaacaattaggttggcacagaggcaygtacctgtagtcccaaatactcaggaggctaaggcaggaggagccactgagcccaggagtttgaggctgcagtgagctattaccacaccactgcacttcagcctgtgtgacagagtgagactctgtcaaaaaaaaaaaattaaaaattaaagtaaaaagcagaattgtcaggttagcgtcaaaaaacaaaaaagcaagactcagtctatgctgtctataagaaacccactttaaatataaagacataaatagtttaaaagtgaaaggctgggaaaagatatgccatacacacactaattg

SEQ ID NO: 121971 - DNA, 601 bp, Human
cttatctatggctgcttttgtgctataagagtaaggttaagtagttgcaatagagactgtatagagtgaaaaatatttactatctagctcagaaagtttgccaacctctggtctaaatgtattgtgggggctgagtgcggtggctcatgcctgtaatgccaacactttgggaggccaaggcgggtggatcacctgaggtcaggaattcgagaccagcctggccaacatggtgaaaccccctctctactaaaaatacaaaaattagcctggcgtggtggcgcatgcctgtaatctcagctamtgaggaggctgaggcaggaaaattgattgaacccgggaggcagaggttgcagtgagctgagattgtaccactgtactccagcctgtgcaacagagtaagactccatctcaaaaaaataaaataaaaaatcaatgtattgtgggatttatgatgcatgtagacatatgacaacaacagcacaaagaaggaaagcagaaatggaggtgtacccctgcacagttcttacgctatacaggaagaaagactggggtaagttaaagatgtatatgtagaccctagagtaaccagtaaaaaatagaa

SEQ ID NO: 121972 - DNA, 601 bp, Human
tgattgattgaatgtatttccctgcgcaaacttaaattgacttattagcttcaaatattggaatagcatttgtagacacaaaccaagatttcagacggctccactacttgtactggattcctccacttcagtccagatccctctcccaagtcctgtaaaattagaataacataatatgtgtataattatattacagtgttgatgcgatgatttaaagagttaacatatatagggtgcgtaggataatacctgccctactgtaaccatcatataggtggatatgatgataatggtggtggtrgtaaaggtggtggttaaggcagaggggaggtggtgatggtggtaatgaaggtggtgaaggcgatggttgtaattgtattggcagtggtagtggtgataaaatccaagcaccataaaacaatttcaaaaagtctaacatacatgcaattggagtcccaggaagaataaaaaacgaagaataggttgaagctcagtaattccagggggagaaaaaagaaataggacaggagaaatatctgagacatagtactcaagaattttctaacattagacaaaaacaacaaaaccataggtcctagtt

SEQ ID NO: 121973 - DNA, 601 bp, Human
tatggagaggttaggaatgtgggagagggggacttattggaggaacaagtgagacagagatgaaggcaatttaaagtcttcagaaaaagagaagggtaagatgacaacaagaatgaaaagaaaagaaagagagaaagcatctcaaaaaatgcataaatttataagcatatataattagatataaaaaattacgattctaacataaagttttagctaatgcttaaatcagaacacatctgttacaggccaacaggcatataaaaattagaataacaatagtaagtcaccttggatttctatrggtcttttcttccagtaagttcaaagcctttccttctaatctctcatctacttatataaaatttatgagaactgttctcatttaacagatgagaaaacaggataaactacaacaaaattggatttgaggtttcttaacttcagatgaccatatgatttttcatctaataaccagtgctccttttgtgagcaaataggggagggtgcaattaataattacacttggacaacaggtggaagccaaaactgtcccaggcacacattaattctcactttaataatctgtgttccacagagaaaa

SEQ ID NO: 121974 - DNA, 601 bp, Human
tctagacagcggcaggctgctagggcctatctgttgccctgatgtaggccccagtagtttccctaacattcacatcaccaaagctgtctgctgctttttgaggagaggtatggagaggttaggaatgtgggagagggggacttattggaggaacaagtgagacagagatgaaggcaatttaaagtcttcagaaaaagagaagggtaagatgacaacaagaatgaaaagaaaagaaagagagaaagcatctcaaaaaatgcataaatttataagcatatataattagatataaaaaattacrattctaacataaagttttagctaatgcttaaatcagaacacatctgttacaggccaacaggcatataaaaattagaataacaatagtaagtcaccttggatttctataggtcttttcttccagtaagttcaaagcctttccttctaatctctcatctacttatataaaatttatgagaactgttctcatttaacagatgagaaaacaggataaactacaacaaaattggatttgaggtttcttaacttcagatgaccatatgatttttcatctaataaccagtgctccttttgtgagcaa

SEQ ID NO: 121975 - DNA, 601 bp, Human
atacaaaaggtaaaaatattttctgtcttgctctttacagacaaaggtcaccaatccttgctctagacagcggcaggctgctagggcctatctgttgccctgatgtaggccccagtagtttccctaacattcacatcaccaaagctgtctgctgctttttgaggagaggtatggagaggttaggaatgtgggagagggggacttattggaggaacaagtgagacagagatgaaggcaatttaaagtcttcagaaaaagagaagggtaagatgacaacaagaatgaaaagaaaagaaagagmgaaagcatctcaaaaaatgcataaatttataagcatatataattagatataaaaaattacgattctaacataaagttttagctaatgcttaaatcagaacacatctgttacaggccaacaggcatataaaaattagaataacaatagtaagtcaccttggatttctataggtcttttcttccagtaagttcaaagcctttccttctaatctctcatctacttatataaaatttatgagaactgttctcatttaacagatgagaaaacaggataaactacaacaaaattggatttgaggtt

SEQ ID NO: 121976 - DNA, 601 bp, Human
gactggacaatgggagcggacttcccacttgctattctcgtgatagcattctcattagacctggtggtttgaaagtgtgcagcacctcccacccccacctcctgctctgccatgtgaagatgtgcctgcctccccttcgccttccgccgtgattgtaagcttcctgaggcctccctagtcatgccttctgttcagcctgcagaactgtgactcaagtaaacctctttccttcattaattacccagtctcgggtatgtctttataacagtgtgagaacagactaatacaaaaggtaaaaatrttttctgtcttgctctttacagacaaaggtcaccaatccttgctctagacagcggcaggctgctagggcctatctgttgccctgatgtaggccccagtagtttccctaacattcacatcaccaaagctgtctgctgctttttgaggagaggtatggagaggttaggaatgtgggagagggggacttattggaggaacaagtgagacagagatgaaggcaatttaaagtcttcagaaaaagagaagggtaagatgacaacaagaatgaaaagaaaagaaagagagaaagcatctcaaaaaa

SEQ ID NO: 121977 - DNA, 601 bp, Human
actaccctcccacccacccccctcaactgactcctttagggactgcttacccacataaaaacaaagaaatttttcttttttccccaaagtaggtaaatatggatgtgaaaagtgggcagtggtccaaaaggaaaaatgatgaacgactagaggcctgtgcttagagctgtccacccactgcaagtgtttggcagggccctggagtctaggcacttccattttgtttcccaagtgaccatgattggtcaatacctaggatatcttttctttaaatgcttgataatgaacatacctgtacctrcccatcatcatccttagaaaacaccactttaccaaaagagagaagggggtgattattcgtcccctaaagaaggaactcctgaagccccctttaagtattaacttgtctcctatacctggttttgagtggtttattgagataagatcccaggccaaatcagggccctgaacagtcccctagactagggggcccaacaaactatggcccaagggcctttttataaataaagttttattgaaacgcagacactcccatttgttaactattgtctatggctgcttttgtgccacagtagcagat

SEQ ID NO: 121978 - DNA, 601 bp, Human
ccatatgctcgtcaggtgctaacctacagtattaatacttcagtccactgtgggttaaataggtatatgtgagctgggtgagacctgaccgcaattgtttctaggagagtacattccaggatccaaacagttggcttaattagacactttcagcacctaacatacaggtaattgagaattgcctttacacagctttcagtacattgaaattgtttaatcacagccagcaatgaggattcctcaaagaagagctgttctcaaagtttccattgtgaagagcccctttttgctattgtcctgmagtagcaatcccatgatggaaacagagagccaaaaaaaaagatcgtggctacattataatggacttggtgagcatgcactgaccttacttgctctttagggtgagtggacataggggcccatcaaccctgctccagccagcacctggtcagagtcactaactacaacaatgacaccatggggacccctggggctgctgtctgtggggctttgtatcttggccagtaaagccatcctaaggtcagggccaaaaccagaagcagagggggcccggcctcagctaacaatactgtggggaagt

SEQ ID NO: 121979 - DNA, 601 bp, Human
tcatttatcagtctggcaaagagtttcaaaattttttaacagccagtggtggaaaggcgcaggtgagccttctcacacactggggatggaagttactttggaaataagttaaacgctttaactcacacacacccattgttcgtttttggaattatccaaaggaaatatagtggatccatgcaaagacagcaatttcaagaggctcatcacagggttatttttgatagaaaaacctaacagtccaacaataggatgctggttaaataaggtatgatatacccatccattctgaaatgctgtaaaaaaaaaaaaaaaaaaagtatttaatggcatgaaaaatgttcacaacccattgtttaatgaagaacaaattataaacaatatgcaaagtgtgtgaatatataggtactgtacatgtgcacacatatgtgtaatgtcaaagacagaattacaacaaattttgttatagatctcattgacttttattggcgatgaatcagggcagcctccattctacaaaatagaatgagagcttccaccaggcaatggcagaaccgtgggttttgtaaggtagaaacaaggaatagaacagtaggaaaaa

SEQ ID NO: 121980 - DNA, 601 bp, Human
attcactttggttttgaatggccaaaacaatccagggattgttaagtgctgtgacttaagaaaggaagcagccaattcacaaaagagtgaataaacatatacaaatgtccaagctcaccaatacagaaaaaaaaaaaaaacacagctcaataacatttttcatttatcagtctggcaaagagtttcaaaattttttaacagccagtggtggaaaggcgcaggtgagccttctcacacactggggatggaagttactttggaaataagttaaacgctttaactcacacacacccattgttcrtttttggaattatccaaaggaaatatagtggatccatgcaaagacagcaatttcaagaggctcatcacagggttatttttgatagaaaaacctaacagtccaacaataggatgctggttaaataaggtatgatatacccatccattctgaaatgctgtaaaaaaaaaaaaaaaaaaagtatttaatggcatgaaaaatgttcacaacccattgtttaatgaagaacaaattataaacaatatgcaaagtgtgtgaatatataggtactgtacatgtgcacacatatgtgtaatgtcaaag

SEQ ID NO: 121981 - DNA, 601 bp, Human
tgcaggtttatctgcctggagcgaggtgtttacctttcaaagagtaataaaacctggatccattcactttggttttgaatggccaaaacaatccagggattgttaagtgctgtgacttaagaaaggaagcagccaattcacaaaagagtgaataaacatatacaaatgtccaagctcaccaatacagaaaaaaaaaaaaaacacagctcaataacatttttcatttatcagtctggcaaagagtttcaaaattttttaacagccagtggtggaaaggcgcaggtgagccttctcacacactggggatggaagttactttggaaataagttaaacgctttaactcacacacacccattgttcgtttttggaattatccaaaggaaatatagtggatccatgcaaagacagcaatttcaagaggctcatcacagggttatttttgatagaaaaacctaacagtccaacaataggatgctggttaaataaggtatgatatacccatccattctgaaatgctgtaaaaaaaaaaaaaaaaaaagtatttaatggcatgaaaaatgttcacaacccattgtttaatgaagaacaaattataaacaa

SEQ ID NO: 121982 - DNA, 601 bp, Human
tattttcggtctcttggcttttaaagccttccatgatttcctattgttttctgaccaattttatttcttgttcctattacctaaaagctcacagttccaaacaggtgagattccttggtccccactggatgtgacaaggaaatatgttagggactctgcacattcgggcagctgggtcaaaggatggacaaaccttgagggttagagaattaattgccctgggaaggtctctgcaggtttatctgcctggagcgaggtgtttacctttcaaagagtaataaaacctggatccattcacttyggttttgaatggccaaaacaatccagggattgttaagtgctgtgacttaagaaaggaagcagccaattcacaaaagagtgaataaacatatacaaatgtccaagctcaccaatacagaaaaaaaaaaaaaacacagctcaataacatttttcatttatcagtctggcaaagagtttcaaaattttttaacagccagtggtggaaaggcgcaggtgagccttctcacacactggggatggaagttactttggaaataagttaaacgctttaactcacacacacccattgttcgtttttgga

SEQ ID NO: 121983 - DNA, 601 bp, Human
acattaatattatatgtggtgtcaaattagcttattaaaagaaatataaaatctaaaatcatattaacttattaaaagaaatataaaacctaacagaaaaactaaaattagaggacagaaataccatatgtcagtggagtttaaagcaactggagctgtgatacaccgctgattggagtgtaaatttttttgttgtttccttgagaaactatttgacgttacctactcaaactaaacatacacctatactctgacccaataatcccacccctaggtaaatactcaaaacaaaatgaatgcrtgtgtccacggaaggacacacacctgcgcattcacaccaagtgtatttacaatagtcaaaaaccaaaataagtcaattacctgttaaccataggtagatattttcggtctcttggcttttaaagccttccatgatttcctattgttttctgaccaattttatttcttgttcctattacctaaaagctcacagttccaaacaggtgagattccttggtccccactggatgtgacaaggaaatatgttagggactctgcacattcgggcagctgggtcaaaggatggacaaaccttgagggt

SEQ ID NO: 121984 - DNA, 601 bp, Human
aaagggtaaaaaataggccgggcgcggtggctcacgcctgtaatcccagcactttgggaggccgaggtgggcagatcacaaggtcaggagtttgagaccagcctggccaacatggtgaaaccctggctctactacaaatacaaaaattagctggacgtggtggtgcatgcctgtagttccagctactcaggaggctaaggcgggagaatcgcttgaattggggaggcggaggttgcagtgagctgagatcgcaccactgcactccagcttggaggaaagagtgagactccttctcaaaaamaaaaaaaaaaaaaggttaaaaaataattataaaaggaatatacccagagtttttttattagaaagtgttgtataaaatcttgaaagtagaatagttctataaaatgtattatctatagatcagtaagagaagatataaaaagacatatttttaaaactaaacaaaatgaaaatggaaaagcaacattaatattatatgtggtgtcaaattagcttattaaaagaaatataaaatctaaaatcatattaacttattaaaagaaatataaaacctaacagaaaaactaaaattagaggacag

SEQ ID NO: 121985 - DNA, 601 bp, Human
ttatcttctagctgtacctatttttttaaatatatgttttatttcaacagcttttgggatacaagtggtttttggttacatggatgaattgtctagtggtgaagtctgagattttgctacactcttcacccgagtgaccccagtagtgtacattgtatctaatatgtagtttttttatcctttatcccctcccaccctgtatctatttttaattgctttgtgaactaaggcaaatgtgataaagaggcatctgatgtacctgcttctagcatacaagaaaacatatttcttgagcatgctrttacatgcttgacactttatatacactatttcatttaacatcccaacaatcctaaaacctgggttttgttattgaagaacccaaggctctgagagttaactaacttgcccaaggtcacacagttagcaagttgtgtgggcaggatataagcccagtctggctgcaaagctatgttctttacactgtaacttactcctgaaggaaggaggcttaaaaataatccatgcagaatttgtatcagcttgatatgtgtgccttattattattattattattttgagacggagtcttactctgttg

SEQ ID NO: 121986 - DNA, 601 bp, Human
ccgaatacctctcagtgctcagacattctcctctttctctgccgtgcctttctgccattcgtctgcttgtctccttgtctccttgtctgcttctggagcctggggtttggggtttatatgggtacaggatggccaaaaggcaaccttttgggtgtgaaaacaggaatccctgtcctcctttagggtcacgggtatctgggcttcagggtgggggcctttgccggagaaccgccctcttctacccagtgtttccctgtctcctgtccgtatcaccagcagatggtgcctacttttttaaagscatcatcttatcttctagctgtacctatttttttaaatatatgttttatttcaacagcttttgggatacaagtggtttttggttacatggatgaattgtctagtggtgaagtctgagattttgctacactcttcacccgagtgaccccagtagtgtacattgtatctaatatgtagtttttttatcctttatcccctcccaccctgtatctatttttaattgctttgtgaactaaggcaaatgtgataaagaggcatctgatgtacctgcttctagcatacaagaaaacatatttcttga

SEQ ID NO: 121987 - DNA, 601 bp, Human
tgctgagaattccaggtcacccactgcagcacaagctggctaccttttctctggcagttgttgttaagagcattttccagcaccctgaagttttcatcccccattgttcagccacccatttctaaagagttagcataataagtgggatcaggggttaggtggactgggcaccagcaccttaaccctgggggtagagatagatttctggcttttaggagtgaagttgattttagagtataaaatgctgcccccaccccattccagggctgctgggtgtaaaaggaaaagaaatcttgggacsccaaaatcactaagccaaagggaaaagtcaagctgggagctgcttagggcaaacctgcctcccattctactcctgaaaatgatagctactaagatcttttttaaaagctacaaacctccctcacaaggcatttccttacggacaaaggacagacagaactcgaagtcatccctctgctcactgagataaatgcatatctgattgcctcctttggaaaggctaatcagaaactcaaaagaatgcaaccattttgtctcttatctacctataacctggaagccccctcctcacttcgagttg

SEQ ID NO: 121988 - DNA, 601 bp, Human
gttcctttttcctatcaagtccgtatttgaagacttgattggcaatgactgctcctaactaggcaagctggcaccttcttgatgtcagtcccttttagcgaatgtgtacacactggtagggggcagaggggaaaagacaggaaaaagaaaagtgctgagaattccaggtcacccactgcagcacaagctggctaccttttctctggcagttgttgttaagagcattttccagcaccctgaagttttcatcccccattgttcagccacccatttctaaagagttagcataataagtgggatyaggggttaggtggactgggcaccagcaccttaaccctgggggtagagatagatttctggcttttaggagtgaagttgattttagagtataaaatgctgcccccaccccattccagggctgctgggtgtaaaaggaaaagaaatcttgggaccccaaaatcactaagccaaagggaaaagtcaagctgggagctgcttagggcaaacctgcctcccattctactcctgaaaatgatagctactaagatcttttttaaaagctacaaacctccctcacaaggcatttccttacggacaaagg

SEQ ID NO: 121989 - DNA, 601 bp, Human
atccgcccgcctcggcctcccaaagtgctgggattacaggcgtgagccaccgcgcccggcacatccctcttaaagaacctaaaattggtctttggagatgtcctttcaggattttgcatttctcatgaccagatgaccggaccttgactcttggcccaaccagtcctgcggacccacccagaagcagacttagtgcacaaggaccattttccacatccctatgattgcatccccaaccaatcagccgcatctgttcccctcgccccctgccagccaaataacccttgaaaaacctagcctsagaattttccgggaggtcgacttgagtaatatcttcatctcccacatggtgtggccagcctcatgtcaattaaactctttctttattgcaatgccatggtgtcattgaattggttttgtctgtgccgtcggcaggaagaacccatcaggtgattacaatatcattatcagaaacaagaggaatggggaggggagccagcaactgaaattggatgattcatttcagaatgctaaatggacctctgaagggacattggcttggagatctggcactttagctcaggggagaagtcagatttgg

SEQ ID NO: 121990 - DNA, 601 bp, Human
ggtctcgatctcctgacctcgtgatccgcccgcctcggcctcccaaagtgctgggattacaggcgtgagccaccgcgcccggcacatccctcttaaagaacctaaaattggtctttggagatgtcctttcaggattttgcatttctcatgaccagatgaccggaccttgactcttggcccaaccagtcctgcggacccacccagaagcagacttagtgcacaaggaccattttccacatccctatgattgcatccccaaccaatcagccgcatctgttcccctcgccccctgccagccaartaacccttgaaaaacctagcctcagaattttccgggaggtcgacttgagtaatatcttcatctcccacatggtgtggccagcctcatgtcaattaaactctttctttattgcaatgccatggtgtcattgaattggttttgtctgtgccgtcggcaggaagaacccatcaggtgattacaatatcattatcagaaacaagaggaatggggaggggagccagcaactgaaattggatgattcatttcagaatgctaaatggacctctgaagggacattggcttggagatctggcactttag

SEQ ID NO: 121991 - DNA, 601 bp, Human
ccggctaattttttgtatttttagtagagacggggtttcaccgttttagccgggatggtctcgatctcctgacctcgtgatccgcccgcctcggcctcccaaagtgctgggattacaggcgtgagccaccgcgcccggcacatccctcttaaagaacctaaaattggtctttggagatgtcctttcaggattttgcatttctcatgaccagatgaccggaccttgactcttggcccaaccagtcctgcggacccacccagaagcagacttagtgcacaaggaccattttccacatccctaygattgcatccccaaccaatcagccgcatctgttcccctcgccccctgccagccaaataacccttgaaaaacctagcctcagaattttccgggaggtcgacttgagtaatatcttcatctcccacatggtgtggccagcctcatgtcaattaaactctttctttattgcaatgccatggtgtcattgaattggttttgtctgtgccgtcggcaggaagaacccatcaggtgattacaatatcattatcagaaacaagaggaatggggaggggagccagcaactgaaattggatgattcatt

SEQ ID NO: 121992 - DNA, 601 bp, Human
atctaagaccctggttcctcttttccagttgctctgccatctctacggtgctgcccttgttggcattctccaaactggcttccccgtccccacaatgttctaggcaacaggatggaggatgggatagaaaaagatcacaccccttcctgttaaggatatgatctagaagttacatccaatgatttcactcacagtcttttggccagaactgagtgtgttaccacacccagagacaggggcatctaggaaatagagtcttgatcctaggccacccaaatgcaaatcctatcactatcaaagraggaatggatggatattggggctccaccaggcagtaaccactacccatagcacctcacttaaaacaacacatcacatcattttcaagcagtgtacaaagaatggcccaagataatgatagtattgaaaaaccacctttgcaaaaattataacagtgagaaaattatgacagtgaaagagatctgatctaaccaatccccatcttgtctttaacctccaaactgccttggtcattcctgggcttgggccaagctaacttggggagttacaaactttagtttacagtttaaatgataatagt

SEQ ID NO: 121993 - DNA, 601 bp, Human
actgccagtccacacgtgggctcttagtcttgagcccctccacattgatttctttcccttactgtacctatgttaaggcacggaagttttcaccatgggcatgtttaggtgaagcccgctgtccacaatgacctgggcaggtgggaggctctccagggacccttctctatttgcctaggcatttggctctctcctgcctctatcacaggtagaccggcctcttagactaagccactggacagcttggggaaaatggggcctctctgatggcttttttctttaggataagtttcaagtgctytaacagagactcacaagaatcgtggcttaaacaagatagatgtctattgctctgtctcccagtcgtccaggcaaatagtaagtcaaggctggaatggcagctgcacaggatctaagaccctggttcctcttttccagttgctctgccatctctacggtgctgcccttgttggcattctccaaactggcttccccgtccccacaatgttctaggcaacaggatggaggatgggatagaaaaagatcacaccccttcctgttaaggatatgatctagaagttacatccaatgatttcactca

SEQ ID NO: 121994 - DNA, 601 bp, Human
ttctgagttttattctaacatgatcaaagcagtagttggggtggggagcattctgaaaaggaggcatcagattaggactatctgaatttaaattctatttctacttgggaaaatatgcatttaaatcattgacagcttcaaaattctaatgattctgtgaactattggaattagtaagagactcatcaaaccaagagtaattaaatgaccagctgtgggcagtgtgggacttcagacaaagcagagagaggtctgtgtgaggaggcacaagcttggccctctgtggggcggggtgggtggygattttggtcaggaaaatacaccagcagcaaaggcaccactgccagtccacacgtgggctcttagtcttgagcccctccacattgatttctttcccttactgtacctatgttaaggcacggaagttttcaccatgggcatgtttaggtgaagcccgctgtccacaatgacctgggcaggtgggaggctctccagggacccttctctatttgcctaggcatttggctctctcctgcctctatcacaggtagaccggcctcttagactaagccactggacagcttggggaaaatggggcctc

SEQ ID NO: 121995 - DNA, 601 bp, Human
caaaaaacagagcaggtagaagcagaaattaggcgggaaataaagaccaagctggcgagaaattggagaaaggctttccaaagcaatgtgacaaggaaaagggaaacttgagaaagatatttttctctgagatcagagctgtgctccacagccaaagttaaggtgagccctgcaattgtcagccagtaagcatctattatgctcccagtacacacctggccttgtatttggaattagaggtcacctccgagtttacctaagctcttctagaaaaacagatccaccattatacatttaaatyatccagtctgctatgtggcttttcctgtcctgcttcttgtgacgtaagggattctgtctttgaaacaagggggccagagatgtactgtgatccataaattcaactcgggatcaaacaagatactcaggaccctgggatcttggccaggacgtgccctaacttgcttcatgtacaatgggctgtcatgtcactgttctctcaaaaactccagacgggaagtaagggttgtgactaatttcaaagggcacagcggggagccacactgcctggaaagcaggctgcaggcattgcctcccgggg

SEQ ID NO: 121996 - DNA, 601 bp, Human
gttgtgcatgacaaagtcttgaatgtgttttgactgtgatctgtcacgtgaagttaagtgtggaattttctacttgtggcatcatattgctgctcaaaaagctttggattttaaagcatttttgattttggattttcggattagggatactccacctgcctagactgcgggaacaaatatgccggcttcccacgcgtgggaagtgatagtgttttccaggagtgatgaggtatttgagctgcctgttgctccttccttattcccattccccttgtaaccaaaacaaacaaacaaaccagcyaggcatgtgtaagcccgaaggctaaggttgctcatgtctggccacagtaaagaagaagcccaaccagctccccctcccagaactggaatttctgtcccctgtaccatgaaaacatctcacctcctgagctgagtagccacagagacaaagagggtaaggaagggaaagaaccttaggcttggggctgtttcctatacctgtggtttttaaaaggaatctggcattcctaggcagacaagaatgcaaactggccaaggtacagagacacctgaatcctgttcctcagacccagagagacgc

SEQ ID NO: 121997 - DNA, 601 bp, Human
aagagagaaaagagaggagtaattcaaaacggctagttccctagaggaatgtttgagagagtggttgtaaaatgcaaatggcctttcagcttgaaaatttgcagtggcaggtagattcacacaacctgaattcagaatacaaagaaaaggcaagaaatgagatgtaatccttgactaaaaataaaaacaatcacaaaagccatacatagatatatagaaaatgttgacaaaaacaatatttgagtgcttactatgagccaagtaccattctaagagctttgcctttattatctcatctaakcttcatagcaattctatgaaataatactgatttatcagatgtggaaaatagggcatacagatgtaaagcaacttgtataaggccaaacagctagaaagtagcagtactttacagggatagatacagtaaacaaaaggcaggtggaagagggattacaggttgctcttatccagagtggttgcagccaggtgcagtagcatgtgcctgtaaccccagctacttgagaggctgagacaggaggaccttttgagctcaggagtttgaatccagcctgggcaatatagcttagacgccctcccc

SEQ ID NO: 121998 - DNA, 601 bp, Human
gtctaagcaggccaggcacggtggctgacgcctataatcccagcactttgggaggtcaaggtgggcagatcacctgaggtcaggagttcgagaccagcctgaccaacatggagaaaccccaactctactaaaaatacaaaaaattagccaggcatggtggcacatgcctgtaatcccagctactcgggaggctgaggcaggagaattgcttgaacccgggaggcagaggttgcggtgagctgagatgacgccattgcactccagtctgggcaaccagagcaaaactctgcaccaaaaaaaraaaagaaaaaagaaaagaaaaagaaaagaaaagaaagaaacttctaagtagcccatatctaatctggtggtgggagatagttagttctttttttccccagcaattctgcgtcccaaagtgccctatcacatcctagagccacacagctctcctgcggggatctagaccaagattaacacatgacgtgctgcatcccacaaggtggacaccccttccagtgtgcccaggattgagtggcttcctgggatgcaggactttcagggctaaagccagaacaaactggtcccctacccacatgac

SEQ ID NO: 121999 - DNA, 601 bp, Human
aagccacttcaaggtatccccatttgggatgaatccactttgaccccacttgccacagtactctggaagacagtggcttggtccagctccccattcatccagtgttgttaggaatgtctaagcaggccaggcacggtggctgacgcctataatcccagcactttgggaggtcaaggtgggcagatcacctgaggtcaggagttcgagaccagcctgaccaacatggagaaaccccaactctactaaaaatacaaaaaattagccaggcatggtggcacatgcctgtaatcccagctactcrggaggctgaggcaggagaattgcttgaacccgggaggcagaggttgcggtgagctgagatgacgccattgcactccagtctgggcaaccagagcaaaactctgcaccaaaaaaaaaaaagaaaaaagaaaagaaaaagaaaagaaaagaaagaaacttctaagtagcccatatctaatctggtggtgggagatagttagttctttttttccccagcaattctgcgtcccaaagtgccctatcacatcctagagccacacagctctcctgcggggatctagaccaagattaacacatgacg

SEQ ID NO: 122000 - DNA, 601 bp, Human
aagtggctgtgtgcagaggagagcaattagaggcaaaggtcggcaaactgctcaccaggcagggcatgctgcagcctgtcggggatggatggggtgtgggccaaggctctagtgccctcctgctgtgggatctgggtgcggggaggagctcctggacaaaggcaggaagccacttcaaggtatccccatttgggatgaatccactttgaccccacttgccacagtactctggaagacagtggcttggtccagctccccattcatccagtgttgttaggaatgtctaagcaggccaggcacrgtggctgacgcctataatcccagcactttgggaggtcaaggtgggcagatcacctgaggtcaggagttcgagaccagcctgaccaacatggagaaaccccaactctactaaaaatacaaaaaattagccaggcatggtggcacatgcctgtaatcccagctactcgggaggctgaggcaggagaattgcttgaacccgggaggcagaggttgcggtgagctgagatgacgccattgcactccagtctgggcaaccagagcaaaactctgcaccaaaaaaaaaaaagaaaaaagaaaagaa

SEQ ID NO: 122001 - DNA, 601 bp, Human
ttcatgaacatacattaccaacttggatgctggggaagaacggagtttggtccatgcccaagagccatgccaaagaaccagaagccctactcccaatctgaacacgcctgtgctttgggctcagataaactgacatcgctctaactcccaatcaaagccagggttggggccccatggaatagcaggggcggtgggtgcagagcagtggagcgagcatctgatggggcagggtgcgcacctcgccaaagctgggtgtggctttgtcacccaccattctaggttaggcttgacgtttcatggmcaattcacagcaatgggggctcgctctgtaagatgcagtgcagggttaaggggtgcggattgatcccaaaagagaacagagctggtcttgatagaggttggaccgccttagagcacaggatgctggcactgaaaagcagtgacagggctggggtgcagttcagggcagctgggcccggccagcagcagctcatggctggcgtcctcagcagcctctgatcccagtgatggcgtgaccaggtctcccctaggaaatgggttcttttgaacttttcagaggtatgaaggaaagcctcccttt

SEQ ID NO: 122002 - DNA, 601 bp, Human
aatcctacagaacaattaattgtacagcatgttataatgaagtgcagatgaaaagttcatgttttctctcatatcccaacccctcaacgggtggaaaggggtgtgtgtgtgtgcgcgcgcatgtctgtgtgtgtttgtgtgtagtgtgtttgcatatatgtatgtttatgtatatatgggcatgtttgtgtgtgagtgtgtgtagtgtgtgtttatgtatatgtgtttggtttgtaggtataagtatgtatatgcatatatttgtatgtatgtatttgtatgttttgtgtatatgttgtaygtgtctttgtgcatatgcgtgtttgtgtatatttgtgtgcatgcttgtattgtgtttgtgtatgtttgtctgtgtagtatgtgtttgtgtgtgtttgagtatatgagtgtgtttatgtttatatgtgtgtttgagtgtgtgtgagattctgtgtgtgtgtgtgtgtgtgctgcaacagcagccggggaaagggttaggatgcatggaatggtgaaggtgctggccagccttccactgcacatgctatttaataagcatatctgactcatccaccacttggcttgttgggtggtagaggag

SEQ ID NO: 122003 - DNA, 601 bp, Human
cgtttccagagttgtacaattattatcacaatctaatttagaacatttacctcaccccataaagaaactttatacccaatatctattctaatttttttaatgtcagtcataatgaaatgaaatctatttctttcatgggtcagaattgagaattgtaaaatcaatgtagctgtttcaataaaatgtctcatttattcctcacaagacctcaaaagcaggtgttaactatgcccaggtcacagaaccgagaggcagagagacgcacaacatgtccaaggtcacacactcgtaagcaacagamctgaaagtccaagctggtcctccaggcaccctttggagttcttccagtggcattgagacagcaagagccgctgtctgtcccctgaagggtgaatgctgcagtcacaaaagcaggccggccccacacatatctttgcagtgctgggagccaccgctcgtggtcagcaaggtgatctcactgcacaaaactgattacaatcagaaatgctgccagacaacctgggctcagagctcagcaatgaaattcataactgggctgagctggggtgatgcttagcacagcaggattcggaagatgact

SEQ ID NO: 122004 - DNA, 601 bp, Human
gaggcagaattgcttgaacccaggaggcagaggttgcagtacgcagagattgtgccactgcactacagagtggtgacagagcgagactctgtctcaaaaatatgtatatgtgatttatataccacaaaattcacccacttaaagtgtacacagctcagtagattttcgtacgtttccagagttgtacaattattatcacaatctaatttagaacatttacctcaccccataaagaaactttatacccaatatctattctaatttttttaatgtcagtcataatgaaatgaaatctatttcwttcatgggtcagaattgagaattgtaaaatcaatgtagctgtttcaataaaatgtctcatttattcctcacaagacctcaaaagcaggtgttaactatgcccaggtcacagaaccgagaggcagagagacgcacaacatgtccaaggtcacacactcgtaagcaacagaactgaaagtccaagctggtcctccaggcaccctttggagttcttccagtggcattgagacagcaagagccgctgtctgtcccctgaagggtgaatgctgcagtcacaaaagcaggccggccccacacatat

SEQ ID NO: 122005 - DNA, 601 bp, Human
ctacatgtgtgcactatgcaccactacactcaattaatttttttattttttatcttttttttttttttgtagctacagagtctcgctatgttatccaggctggtctcaaactcctggcctcaagagatcttcccacctcagcctcccaaagtgctggtgttgcaggtgtgcaccactacatccagcctatatctattttttttaattgagatgaagtctcactctgtcacatagactggagtacagtggcacaatctcagctcactgcaatctctgcctcctgggttcaagcaattctccsagtcagcctctcaagtagctgggattacaggcacgtaccaccacgcctggctaattttttgtgtttttagcagagacagggtttcaccatgttggccaggctactctcccaactcctgacctcaagggatctgccccctcggcttcccaaagtgctgggattacaggtgtgagccaccacgcccagccaaattttttaattgaagtctaacatatatactaaagttcatgaatcccaagtgtagaggttgatggatttttaagggcattttattgtataaccaactttattaagatatga

SEQ ID NO: 122006 - DNA, 601 bp, Human
cacatgcatacacacacatttacacatatagttcatgaaaatgatattaactattactacatgtgaggcactctgctattttctattctatttcttatgtctttttttttttttttttcattttttagagacaggtttttgctccatctcccagactagtgtgcaatggtgtgatcatagctcactgcaaactcaaactcccgggctcaagcgatcctcctgtctcagcctcccaaataggtaggactacatgtgtgcactatgcaccactacactcaattaatttttttattttttatcttttttttttttttgtagctacagagtctcgctatgttatccaggctggtctcaaactcctggcctcaagagatcttcccacctcagcctcccaaagtgctggtgttgcaggtgtgcaccactacatccagcctatatctattttttttaattgagatgaagtctcactctgtcacatagactggagtacagtggcacaatctcagctcactgcaatctctgcctcctgggttcaagcaattctcccagtcagcctctcaagtagctgggattacaggcacgtaccaccacgcctggctaa

SEQ ID NO: 122007 - DNA, 601 bp, Human
tcctccaccccacactcacctagaggaggaaggggccagggaagcctgccacatctgtcaagacaacctcccatccagggtcacagcagcaggtagctagtttaaattgtggtatttacaaccaaatgaaagaggtaaggagtcaagtggagatcactggaaagtaaacactgcaaaacctccaaaaccagaagcccagaggcacattttctttggcaataggccaactatttgttcctttggcaagtgtggggtttatttaactagaaaaagagagcctgatttaattgtgtgcatgcaygtgtgtgtacatacacacacggaaggggggtggtaacggggctcctccagctagtcagagtttctgctctcttatgtcagaaaacaggccaacactctgaagtcaaagtcaattactgaacatgggtgtgctcttcctctttatttgcatttctggaaaggaaggggagaaggggtataagtaatcattgttaaatgtctgctctgactggatagacgctaggccagtggatgtttacagcaacagccctctgttagaaacacatttctattgcagccccgtacacacatacacacacac

SEQ ID NO: 122008 - DNA, 601 bp, Human
tcaaaaggtcaccaggcactggatgacttcatctatttaccttgattgagcacaaagtccatgtcctgcttgtggcagtggctgccgtccctgccccacactcacccccacgacagccatgttcctgctcatgcccaccctcctccaccccacactcacctagaggaggaaggggccagggaagcctgccacatctgtcaagacaacctcccatccagggtcacagcagcaggtagctagtttaaattgtggtatttacaaccaaatgaaagaggtaaggagtcaagtggagatcactggraagtaaacactgcaaaacctccaaaaccagaagcccagaggcacattttctttggcaataggccaactatttgttcctttggcaagtgtggggtttatttaactagaaaaagagagcctgatttaattgtgtgcatgcacgtgtgtgtacatacacacacggaaggggggtggtaacggggctcctccagctagtcagagtttctgctctcttatgtcagaaaacaggccaacactctgaagtcaaagtcaattactgaacatgggtgtgctcttcctctttatttgcatttctggaaag

SEQ ID NO: 122009 - DNA, 601 bp, Human
aaaataatcatcagaaagcaacagaaacacaagtgtttcaaccctgatgaaatagtcttcccaaggctatttatactgcgtcatcttcaaaaggtcaccaggcactggatgacttcatctatttaccttgattgagcacaaagtccatgtcctgcttgtggcagtggctgccgtccctgccccacactcacccccacgacagccatgttcctgctcatgcccaccctcctccaccccacactcacctagaggaggaaggggccagggaagcctgccacatctgtcaagacaacctcccatscagggtcacagcagcaggtagctagtttaaattgtggtatttacaaccaaatgaaagaggtaaggagtcaagtggagatcactggaaagtaaacactgcaaaacctccaaaaccagaagcccagaggcacattttctttggcaataggccaactatttgttcctttggcaagtgtggggtttatttaactagaaaaagagagcctgatttaattgtgtgcatgcacgtgtgtgtacatacacacacggaaggggggtggtaacggggctcctccagctagtcagagtttctgctctctta

SEQ ID NO: 122010 - DNA, 601 bp, Human
gaaaataatcatcagaaagcaacagaaacacaagtgtttcaaccctgatgaaatagtcttcccaaggctatttatactgcgtcatcttcaaaaggtcaccaggcactggatgacttcatctatttaccttgattgagcacaaagtccatgtcctgcttgtggcagtggctgccgtccctgccccacactcacccccacgacagccatgttcctgctcatgcccaccctcctccaccccacactcacctagaggaggaaggggccagggaagcctgccacatctgtcaagacaacctcccayccagggtcacagcagcaggtagctagtttaaattgtggtatttacaaccaaatgaaagaggtaaggagtcaagtggagatcactggaaagtaaacactgcaaaacctccaaaaccagaagcccagaggcacattttctttggcaataggccaactatttgttcctttggcaagtgtggggtttatttaactagaaaaagagagcctgatttaattgtgtgcatgcacgtgtgtgtacatacacacacggaaggggggtggtaacggggctcctccagctagtcagagtttctgctctctt

SEQ ID NO: 122011 - DNA, 601 bp, Human
aggcccatctggtagttactgaaatgtgtcacaggggcaaacaaccaaaggaaaataatcatcagaaagcaacagaaacacaagtgtttcaaccctgatgaaatagtcttcccaaggctatttatactgcgtcatcttcaaaaggtcaccaggcactggatgacttcatctatttaccttgattgagcacaaagtccatgtcctgcttgtggcagtggctgccgtccctgccccacactcacccccacgacagccatgttcctgctcatgcccaccctcctccaccccacactcacctagrggaggaaggggccagggaagcctgccacatctgtcaagacaacctcccatccagggtcacagcagcaggtagctagtttaaattgtggtatttacaaccaaatgaaagaggtaaggagtcaagtggagatcactggaaagtaaacactgcaaaacctccaaaaccagaagcccagaggcacattttctttggcaataggccaactatttgttcctttggcaagtgtggggtttatttaactagaaaaagagagcctgatttaattgtgtgcatgcacgtgtgtgtacatacacacacgga

SEQ ID NO: 122012 - DNA, 601 bp, Human
acccaaggcccatctggtagttactgaaatgtgtcacaggggcaaacaaccaaaggaaaataatcatcagaaagcaacagaaacacaagtgtttcaaccctgatgaaatagtcttcccaaggctatttatactgcgtcatcttcaaaaggtcaccaggcactggatgacttcatctatttaccttgattgagcacaaagtccatgtcctgcttgtggcagtggctgccgtccctgccccacactcacccccacgacagccatgttcctgctcatgcccaccctcctccaccccacactcacctagaggaggaaggggccagggaagcctgccacatctgtcaagacaacctcccatccagggtcacagcagcaggtagctagtttaaattgtggtatttacaaccaaatgaaagaggtaaggagtcaagtggagatcactggaaagtaaacactgcaaaacctccaaaaccagaagcccagaggcacattttctttggcaataggccaactatttgttcctttggcaagtgtggggtttatttaactagaaaaagagagcctgatttaattgtgtgcatgcacgtgtgtgtacatacacac

SEQ ID NO: 122013 - DNA, 601 bp, Human
ttcaaataccttgcgtgctcctctctcccacctcattcccatctttccctttacttcgtactctttatgtgaatgccctgattcctgggtctttccttgccaaacacatcatttagggatggttataccaggtcggcagcagcagcggcatcaccatcgtcacctccaccacctctggatcactcccttgttgtcagtaacattactttggattcctgggaagatcgaatgactaccagaccatctctgaggacaccatgcctgctgtgtcagtgaagagacccagggaagagcaggggastttagcaaacatgggactgtcactgggtctaagtaggtgacttaatcctaaaccagactcagttcctgcctcagcagggttgactcagcatcgagtctgcacgggacaagcatgaccaagaccagccaggaacaactgtcatcctaccactcgccgagactgtgtacaaacagtccactgcctggaggaggcagtggagatgctacttcctgaagtcacatctaccgaccatctgactcagaattccctgaggcgcttgtggaaaatgcagatcctcaggcttcaccccatacctcctgg

SEQ ID NO: 122014 - DNA, 601 bp, Human
ccaccagggaacaaaaagaggaaggctgtagctgttctggaaacctgatgattccaaaggtgagatgggagggacctgagagtggatttccaactatttctctcgtgaggccttgagataaaagctttgagttattttattagtagtactattattactattattattgggacccacagtttgatttttatctgcagaaaaatacattctctgatagtcaggaattccctccccaacctcgccatctggagccaaactttctaaacgctatttcccattcacttcttcccttcaagaaggytttatgacaagtcaaggctctgtttcccattctcctagtcaactgtgagatccagacctgggctgagctccataaaacaaggggggctctatctgttcttgtacttaatcttattctccatgccctgcaaagtgcctggtacacacatggcattcataaaatgctggttgaacaaacagaagaataacttcaaataccttgcgtgctcctctctcccacctcattcccatctttccctttacttcgtactctttatgtgaatgccctgattcctgggtctttccttgccaaacacatcat

SEQ ID NO: 122015 - DNA, 601 bp, Human
attgatgaaagaagcaaagtactaaacggtatctaaaatacactagaatcttttttaaaaaaatgaagaaaaatatatgccttaatagagactatctctggaaagacacagaagaaatgagaagcattggttgcctctgggagaagtcatgactgggaggcaggaatggcaggcgcactattccttgggtcctcttggataacattgatttttctttttttttttttttttttgagatggagtatcactctgtcgcccaggcgggagtgcagcggcacgatcttggctcactgcagcctcygcctcccaggttcaagtgattcttctgcctcagcctcccgagtaggtgggactacaggcatgtgccaccatgcctggctaatttttgtacttttagaagagatggggtttcaccatattggccaggctggtctcgaactcctgacctcaggtgagccgcccgcctcggcctcccaacgtgctgggattacaggtatgagccaccgaccccagcctgatttttcaactatacaagtgcattatctacccaacaagtaagtgttagagaaaaataaacaaataagaaagaagtaaatgcagt

SEQ ID NO: 122016 - DNA, 601 bp, Human
catgcagtcacagaagaacaagatccctcatgatagggaatgatctccaagagatatttttaaattgatgaaagaagcaaagtactaaacggtatctaaaatacactagaatcttttttaaaaaaatgaagaaaaatatatgccttaatagagactatctctggaaagacacagaagaaatgagaagcattggttgcctctgggagaagtcatgactgggaggcaggaatggcaggcgcactattccttgggtcctcttggataacattgatttttctttttttttttttttttttgagayggagtatcactctgtcgcccaggcgggagtgcagcggcacgatcttggctcactgcagcctccgcctcccaggttcaagtgattcttctgcctcagcctcccgagtaggtgggactacaggcatgtgccaccatgcctggctaatttttgtacttttagaagagatggggtttcaccatattggccaggctggtctcgaactcctgacctcaggtgagccgcccgcctcggcctcccaacgtgctgggattacaggtatgagccaccgaccccagcctgatttttcaactatacaagtgc

SEQ ID NO: 122017 - DNA, 601 bp, Human
attcacacctcacatcttacaccaggataaatttaatacggatttaaatttttaatataaaaaattaaatcagaagtgttagaagacttgatgggatatttttaaaataatcttgctataaaaaaaatctaagtgcaaaacacaacagaagccacaaaaaaaagactgatccaatcaactatatacatttttttttaagtttgtagggcaaaccaacataagtaaatctaaaagacaaatgacaaactagaaaatacatttgcattcacgtcattaacagagagctaatttggcctaatayataaaaagtaaagtaaacaaaaagaaaaaaaaaaaaaaaactagaacccaatagaacaaataggaatggatatgggggaaaaacagttccttcaaaagaaaatgaaaatagattttaaacataagaaagaatgttgaaatccacttgtaataagaggaatgaaagttaaaatttcaatgggactcctctttttttacctgcaagattgcaaacataaaaaatgattattatggtggcaagggtttgtaaaatgtgaacacatagattgttgatggacgtgtcagttagtacctccatggt

SEQ ID NO: 122018 - DNA, 601 bp, Human
tttcaaaagtgtaaaatgacattttgcataaaaatattgattgaagtattgtctgtaacagcaaaagaactgaaaaaaaaaagtctgaaaagaggagactcctaaaataaatgctgaaacatccatttagtaaaatacaacaaaaacaatgcccccttaaaaataatgtgagatggccagggacagtggctcatgcctgtaatcccagcactttgggaggccgaggcggtcaaatcacaaggtcaggagatcaagaccatcctggctgacatggtgaaaccccatctctactaaaaaaaawtttaaaaatagtggggcatggtggcaggcacctgtagtcccagctactcaggaggctgaggcaggagaatggtgtgaacccaggaggtggagcttgcagtgagccaagatcaggccactgcactccagcctgagtgacagagcgaggactccgtctcgaaaaataataataataataatagtgtgagctgtctctacatgccaacagggaaaatgtatgctgcatgtggataagtggaaaaaagcaattatatatgacattatttcatttgtgcaaaaaaaaggaagtatatgcatatat

SEQ ID NO: 122019 - DNA, 601 bp, Human
acaaaaattagccaggcacagtggcaggcacctataatcccagatactcaggaggctgaggtaggagaatcacttgaacccaggaggttcaagttcagaacctctgaacccaggaggcagaggttgcaataagccaagatcacaccactgcactccggcctgggtgacagaaccagactccgtctcaatacatacatacatacatacatacatacatttgaagtatttaggtctccacaactctctgttcttcgtaccacaccaaatgtgctctacatgaatttcttgactcctatcttaktattcttttcactactccattctactatgtgagagtaaagatagacagatgtatcctccccagcttgtagccaaggatgttgctattctctcaaatgctataagtgagggtataaattagcaaaatgtctttagagagaagcttgttaatatctatgaaaattataaatgtgcatatttttgaactagcaattatatttccaggaaattctcctacagataaattttcaaaagtgtaaaatgacattttgcataaaaatattgattgaagtattgtctgtaacagcaaaagaactgaaaa

SEQ ID NO: 122020 - DNA, 601 bp, Human
ctcattaaacctttgtagcactgtaggggagcattatccccacttgtatagttgagaaaactgaagctcagggtgattaaataaactgccccatcttcaccatattagtggatagtggagtcacaattaaaattgaagtcttgggactgggtgtggtggctcatacctgtaattccagcactttgggaggccgaggcaagtggatcacttgagaccaggagttccagtccagcctggccaacatggcgaaaccttatctctactgaaaatacaaaaattagccaggcacagtggcaggcamctataatcccagatactcaggaggctgaggtaggagaatcacttgaacccaggaggttcaagttcagaacctctgaacccaggaggcagaggttgcaataagccaagatcacaccactgcactccggcctgggtgacagaaccagactccgtctcaatacatacatacatacatacatacatacatttgaagtatttaggtctccacaactctctgttcttcgtaccacaccaaatgtgctctacatgaatttcttgactcctatcttagtattcttttcactactccattctactatgt

SEQ ID NO: 122021 - DNA, 601 bp, Human
ctaggaattatctagacacagggagttctaagtaatttatttatttaacaaacatttacctaacacttactaagttccaggtctcatctaagcactttacatgtgctagttccttgagcctcaaaagagtcttattaggtagagcctatcatagtcttcattttaaaaataatggatctcctgtcaccactccttttcaatatcatactggaagtcctagttaatgcaacaagaaaaaaaaggaaataaaaagtataagaataagaagaaagaaataaaactggttttgcttgcagatgaygtgatgtctgtgtagaaaatctgaaagaacagaaacaacaaaaatctgaaactaaaacccaactatagcaaggttgcaagatacaagattaatatacaaaagtcaattgctttcctatgactcagcaataaacaagtggaatttgatattaaaaacataatactgtttatagtactgtgaagcaagtttactgtgcaatgattatttgcccaagtccagtgagacagaacactcatgcatgcaagttacacaaaacaggtttattactcacagataggcagtaagggacaacagaagcct

SEQ ID NO: 122022 - DNA, 601 bp, Human
caatgcaatgctgatggttgcccagtgacaatgcaaattaaggatgaactccagccttctaaagattctaccatgtcatctacaagtccttcctaaagagttttccttaaatgagcaagactcttcaaccactttccaagtctcttgattgtggccaaaagacaaattccaggaagccaaggtgggaagattgcttgacgtcaggagtttgaggctgcagtgagctataattgtgccactgcactccagcctgggcaacagagaaagaccccatctcgaaaaaatgaaaagaaaagaaaakaaaattaagtgaagaaaggagctctggcttccattctcacctctaattggaaacaacgaagagagtttccataatgagtctgggtcatttcccctccttgtggcgcataggtctagcaaggaaccagttgggcaggatagcttatcagacctaactcccttgtccccagctctcttacctgactggagcaccctgcctgcagttggacatagtgaagtcaccaagtctaggaattatctagacacagggagttctaagtaatttatttatttaacaaacatttacctaacacttactaag

SEQ ID NO: 122023 - DNA, 601 bp, Human
cagggcagaatgttgcatgctgggtgccacagaagaacagcctttccctcccatctatcagagcatgaatatcaaacattgatcttgtcctctccttgaccaggataattcaattctgttctcaatgttggctccacttcagcctctggaaggaacttcatcatggactgtcggatccagccagcaggcactggaagtgccaaggatctaggtcatgatgttttttctatggagatgctgcagcaattaattcctggtcagacccctactaaaaccacaggaaatcactgccatcttcagygtactggactgtgaatggcactcatgtaaaggtattttgctgaattctatatggttctacacataataattctaatttattacactctcaattccccagcagcagaggtggcacacacttgccgagtgtcaatgcaatgctgatggttgcccagtgacaatgcaaattaaggatgaactccagccttctaaagattctaccatgtcatctacaagtccttcctaaagagttttccttaaatgagcaagactcttcaaccactttccaagtctcttgattgtggccaaaagacaaattcca

SEQ ID NO: 122024 - DNA, 601 bp, Human
gaggatgcaaatcactaagcgcatgtggacaggagctctgcagcccaccaggtgaacttccaaggtagactggctgaatgagcagcaagtctcctcagacactcagctgtggccctgctcctccctctaggcagacattagtttctgctgcagagaataacaacacacagtgcaagatcaccacgttacagcttttcccagggcagaatgttgcatgctgggtgccacagaagaacagcctttccctcccatctatcagagcatgaatatcaaacattgatcttgtcctctccttgaccargataattcaattctgttctcaatgttggctccacttcagcctctggaaggaacttcatcatggactgtcggatccagccagcaggcactggaagtgccaaggatctaggtcatgatgttttttctatggagatgctgcagcaattaattcctggtcagacccctactaaaaccacaggaaatcactgccatcttcagtgtactggactgtgaatggcactcatgtaaaggtattttgctgaattctatatggttctacacataataattctaatttattacactctcaattccccagcag

SEQ ID NO: 122025 - DNA, 601 bp, Human
gtgatggagcaagactctgtctctaaaagagtgagagcgagagaaagagagagagagagagggaggatgcaaatcactaagcgcatgtggacaggagctctgcagcccaccaggtgaacttccaaggtagactggctgaatgagcagcaagtctcctcagacactcagctgtggccctgctcctccctctaggcagacattagtttctgctgcagagaataacaacacacagtgcaagatcaccacgttacagcttttcccagggcagaatgttgcatgctgggtgccacagaagaacagyctttccctcccatctatcagagcatgaatatcaaacattgatcttgtcctctccttgaccaggataattcaattctgttctcaatgttggctccacttcagcctctggaaggaacttcatcatggactgtcggatccagccagcaggcactggaagtgccaaggatctaggtcatgatgttttttctatggagatgctgcagcaattaattcctggtcagacccctactaaaaccacaggaaatcactgccatcttcagtgtactggactgtgaatggcactcatgtaaaggtattttgc

SEQ ID NO: 122026 - DNA, 601 bp, Human
tttcttacagggcatctgcccctcttctctctggaccctgagcagctctcactggaaccattgccaggaacagccagggtttatcatttcaaacaaccaaccttcaccccttcactgagcatcaatcacagactcaatgctgcataggaggtacactgaccctcagctggcctgttaacctgaatttaagagaacatgtaggccaaggcaggagaattgcgtgaggccaggagttcgaaaccagcctgggcaacatagcaagactctcatctctacaaaaaatctagaaaatcggccaggygtggtggcatatgcctgtagtgtcagctactcagaaggctgaggcagtagaatcacttgaatccaggagttcaagatgacagagagctatgattgtaccactacactccggcctgggtgatggagcaagactctgtctctaaaagagtgagagcgagagaaagagagagagagagagggaggatgcaaatcactaagcgcatgtggacaggagctctgcagcccaccaggtgaacttccaaggtagactggctgaatgagcagcaagtctcctcagacactcagctgtggccctgctcct

SEQ ID NO: 122027 - DNA, 601 bp, Human
gtcctataattagtcatgctttgctgcaaggctgttttcaatttacagcgctgctcacactcaagcatgccctcacatttggcacgtgtatatctgagtaccttctgcctctataaatgtgtctcttagaggcttactacttgagaagcttaactccttgctcagtggagacacagaaatgctggcagccggcttaggggctctcctccaccgtaagagccccgtttactccccactgtcctgagcacacaggctctgtcatagccgtcacccaagcaatgaagtagtgcctctttttttycccacagatgaggattctgatagctggagaagaactttcaagacaacacaaatgctcagtgctggaattgcgatttcagcttgggcctgtctggcttcttttctgctacattacctcaaatccagagatggagcaacggttgctccttaacgctctatcacccagcctccctggggagcacaaatcctgtttccaagccaggctgggactggatggagagccactcagggctctcccactttgcagcaattatgggtaaaccatgacttgcgaacagctccccttccacacttctgtcac

SEQ ID NO: 122028 - DNA, 601 bp, Human
ctttttgcccagggtgaaggagaaacgaagtagagagtgcagcctgggccccactgctccatattcaccacccgtcagtgctcagggggctgaaatgtgcaaatacagcacctctcaggccgggcgggtacaaaccataaggacaaagtgacggcatgtcgcactcagcctctgaaactcagctgaaaattctagaatgctctctttaacacaatcatctgaatgctacgaaggagctttggtaaggttcccaagtcctataattagtcatgctttgctgcaaggctgttttcaatttacrgcgctgctcacactcaagcatgccctcacatttggcacgtgtatatctgagtaccttctgcctctataaatgtgtctcttagaggcttactacttgagaagcttaactccttgctcagtggagacacagaaatgctggcagccggcttaggggctctcctccaccgtaagagccccgtttactccccactgtcctgagcacacaggctctgtcatagccgtcacccaagcaatgaagtagtgcctcttttttttcccacagatgaggattctgatagctggagaagaactttcaagacaa

SEQ ID NO: 122029 - DNA, 601 bp, Human
gcaatgtgccagccagaacttcactgagccagcggcctggggaactggagacatttctcttctctggcacatatgggggctccctacacttgagagaagtgggaaaggagtaaagaaaaaaattcctggacttttataaccaaaaaatatacttctgtttagtgtggcattaggtctggacaccagaaaacccaccagggatatgtgtgctggatgtgtacctttcatttaacttgaggacaaaacgaggcaacgtcattccagagaagcagtgcagagataagccccagccagggccttytgggagaggaaggagtgggtggagggggggcactgcctggtgggtgacgaaggggctccatgatcaaacactgcagttctcccactctctctgcctttcccctccctctgagccccttacccagtcaccagtacaactcccctgccagccccccaccagcttatgccactcaaaggaacaaaacaatgctcacagagtcagctcagatcacacagtcagctcggaaacaggaaagcctgctagctttttgcccagggtgaaggagaaacgaagtagagagtgcagcctgggccccactgc

SEQ ID NO: 122030 - DNA, 601 bp, Human
agttactctccacaaggcctggctcgctcccggctgtagagtccggtaagagcaaatctgatcctaaggatcccattcctaccagggtcccgagggagaaggcttcaggagcagtgtcgactgggcagggccctaagcttttataggaagtgcattacaatcaggtcggccatcgagaccgcatactccggggctaccggcttatgaacgaagcgggaggccgaggtgcggcgggccctcagggagaagcctaaggcccgtctccccggcgcggaggaaagggctcgacgcccgagttctyctgcgaagcaggcgagctccccgcgcaccctcgggctggcggcgcggtgccaaggcgccccggctccagggctctgcgggcagcgtagcgactccaggctcccctctccagaacgcgcttcgctgccagcgtcctgccaccccggtcgcccgcccgcgggccccggaccacgccgcccgcgctccccgcgaatgcagcatctccgcctctctccagagcccaccagtccccgcgtgccggccagcctagattgtggccatgtccttcgtcctcgaaaacaggagagggtcaggtatcgcc

SEQ ID NO: 122031 - DNA, 601 bp, Human
tttcgcccttttcatgaagggattcttggttaacatgttagtgaatttgaaatttgacacttttaagagaatggacacactcctttaagacgtgatttctaaatcaatcccccatttcttttctcctaaaaccaggcccaacttgctcaacttcaattaggccattgattttgcttctgatctcaaacgttttctccagaaaccagctaatgtctgcatacttcttctccaagtttcccgagactacaattccaagattctgtaaaatatgttttggctgtgattcgaaataaggggatayacagtactgaatacccagatgactacgagttatgaccacacagatttagggatggatgggattttctaaattctgaatgcactctggtggcccaaactgaaagttactctccacaaggcctggctcgctcccggctgtagagtccggtaagagcaaatctgatcctaaggatcccattcctaccagggtcccgagggagaaggcttcaggagcagtgtcgactgggcagggccctaagcttttataggaagtgcattacaatcaggtcggccatcgagaccgcatactccggggctaccg

SEQ ID NO: 122032 - DNA, 601 bp, Human
aaaaaattacatgggaaaagcaaaatgctatgttaactaactagtatgtgatgcacagggaatggtaaccccagacataaggcattagtactcgaaattttcaaagtcagtgtaatgcattgcagaacaccataccaatacagatttgctcacattaaagtaaaattaatttttttttaaaaaagagcccactactttacttaggccaaaatctccctcttggaagaaaatgttctactgaagtgttaagttaaaaacggaagctaggcattactgttctctgctgaattaaaaaaaaaacaaaaaaaaaaccaaaactttaaacaaccaaaatggctacaacggacccaactctaccagaacgtatcaaagcaatgtgaataacctaacagggcagctactgtttcagcacgcaggacatctttccattattacatacagtcagggacgggagagccgacaatgtgattaaagtagttacggagacgctgaatttacaaagggttttctggaccctgtatccaaacagctgctgcatgctccctgtgtcgaccacctgctaaaaaagctgacctctgaatgaaacaaatctaattactga

SEQ ID NO: 122033 - DNA, 601 bp, Human
aggtctgtatttattcagagcctgattgtggtgaagcccatgtattatacgttatctggatatcatccagccattcttttgtatcaagtcaattagtatcaggaatccagtattatatagggaaaaaattacatgggaaaagcaaaatgctatgttaactaactagtatgtgatgcacagggaatggtaaccccagacataaggcattagtactcgaaattttcaaagtcagtgtaatgcattgcagaacaccataccaatacagatttgctcacattaaagtaaaattaatttttttttwaaaaagagcccactactttacttaggccaaaatctccctcttggaagaaaatgttctactgaagtgttaagttaaaaacggaagctaggcattactgttctctgctgaattaaaaaaaaaacaaaaaaaaaaccaaaactttaaacaaccaaaatggctacaacggacccaactctaccagaacgtatcaaagcaatgtgaataacctaacagggcagctactgtttcagcacgcaggacatctttccattattacatacagtcagggacgggagagccgacaatgtgattaaagtagtt

SEQ ID NO: 122034 - DNA, 601 bp, Human
agggggcaatcgagcaagtatttccttctggcttgacccgattgcggatgtcactctgcatggaacccaatcgtggtttcaatggcttattttgtttaatggctgaaatggaaagtatggaaggcaaaaacaaaagtctagcttacttacaaggttgttcaggagagagggcgggaagactcaacagcacagagatttttctgtttttgactttaaggctgggcagcactaacatttttataatcctgtaatttacaccacctctaacagcctgccccattcaactcaaagtttaagactcacatttacgagtaaaattacatctaggtagagcccactgcttttggcatattggattactactcatttgaattaaaactaaattcctccctccccttttaaaaattgtattttatctttttttccagggtgggaaagacaaaactcacagaagagctctgtggctgagggagagggacaatgtgtcctgtttacctttgcttctcccatgcagcgggagagggagctgggtctgaaaagatggctgaaatcaaaaggtctctgttttcttttcagataaccccagccctacctatcccct

SEQ ID NO: 122035 - DNA, 601 bp, Human
agtaacaggcactggatatggccagcctatatgcaatactttaaaaatgttttgagtctatgaaagctacatagtaatggctacagtaattcccatagaaacgagaaaaacagtcaacaagggcaatgtatctacagccccaaacagatgctcaagtcagttgagaatttggaacaaaatcagtgaaatgggtctaaattataatattgctcatttaatgaccatttttgtcagacacagaatccaagagtctagaagggccctatgctgctctttaaaaaaaaaaaacaacaacaacaamaaaaaaacagcactgaattcccctttgtaaaacacaccaagatgcactccatcaagaaagacacagggtgtttgcagcctttggcattttcaatgtcttgagagttcagactcttccaaagtgtggagactttcctgtaatgccaaatagggggcaatcgagcaagtatttccttctggcttgacccgattgcggatgtcactctgcatggaacccaatcgtggtttcaatggcttattttgtttaatggctgaaatggaaagtatggaaggcaaaaacaaaagtctagcttacttacaa

SEQ ID NO: 122036 - DNA, 601 bp, Human
aaaaagaaggtaaagtaacaggcactggatatggccagcctatatgcaatactttaaaaatgttttgagtctatgaaagctacatagtaatggctacagtaattcccatagaaacgagaaaaacagtcaacaagggcaatgtatctacagccccaaacagatgctcaagtcagttgagaatttggaacaaaatcagtgaaatgggtctaaattataatattgctcatttaatgaccatttttgtcagacacagaatccaagagtctagaagggccctatgctgctctttaaaaaaaaaaaacaacaacaacaacaaaaaaacagcactgaattcccctttgtaaaacacaccaagatgcactccatcaagaaagacacagggtgtttgcagcctttggcattttcaatgtcttgagagttcagactcttccaaagtgtggagactttcctgtaatgccaaatagggggcaatcgagcaagtatttccttctggcttgacccgattgcggatgtcactctgcatggaacccaatcgtggtttcaatggcttattttgtttaatggctgaaatggaaagtatggaaggcaaaaacaaaagtct

SEQ ID NO: 122037 - DNA, 601 bp, Human
atggcagaacagcagtggttcattcacagcgctctaaatgtatgcccaccacagagtagtttgaacgcttacttactcgtgctttagagaatgaaaagagcacactattaatactccactactgtccactttttcttcctatcttgtttagagaattactaagggcagaaacaacttgtttaatggagctttcccttgctatgttttcttatttgaaatcagcaagtatgtgcttaccagccacagaatgctttggactagaattacatatttgaatttatacatgaaaggaaaatatgtkaataatctagagccactgctgattgtctgctggaataacagaaataggttcgcctggcattcaatgtgcatggaaagcattttataactggtcacctactcttttcactggtttgctagatcctccttccttatctctaatacttctgaaatatcttctcacaggtagactacaaagctaaatgttggatgaaggttagtaaacaaacggcagggctttcttgaatgattgctttaatcactttaaccctgtttctgatagaaagctggaggccagggcaattcagctttttcttttgtc

SEQ ID NO: 122038 - DNA, 601 bp, Human
ataaataaataattataataatacataaaaacaacaataaaataaaaataataatataaataaattaagtatggcagaacagcagtggttcattcacagcgctctaaatgtatgcccaccacagagtagtttgaacgcttacttactcgtgctttagagaatgaaaagagcacactattaatactccactactgtccactttttcttcctatcttgtttagagaattactaagggcagaaacaacttgtttaatggagctttcccttgctatgttttcttatttgaaatcagcaagtatgygcttaccagccacagaatgctttggactagaattacatatttgaatttatacatgaaaggaaaatatgttaataatctagagccactgctgattgtctgctggaataacagaaataggttcgcctggcattcaatgtgcatggaaagcattttataactggtcacctactcttttcactggtttgctagatcctccttccttatctctaatacttctgaaatatcttctcacaggtagactacaaagctaaatgttggatgaaggttagtaaacaaacggcagggctttcttgaatgatt

SEQ ID NO: 122039 - DNA, 601 bp, Human
ccatttatttcctgcttagtcaccacattcagcctggaattaccttgaccaaaacccaaaaacaccctagaagttaaatactataagtgattcaaacaagcagctactgagaactgcatgaaagtaattggacaaggaggaggaaggaggatgtgctggggactctgagttctaaaaggcatgaagatttggttgttggagacctctggccggcggctgcatggtctccaggtaagcagatgctaagcatggtgaaaatgcaaaccaaggggcaccacttggagtcaagagaaccccaggmccaccaatattcaccgcctggcttccttcaacaaatggctccaaacttgcagaacatcaaaagccagatgggctgtactgaatgaatccaccggcaagaagccagaatcccagtttgctgtagaaataagcctggacttgatttgagtcttctcagctctgacaagctggaagctggcacggatcccaaaatccaaaataaaatggcatttaattgtgactagactctaaaaaagatgtcatactatctccttagcttgacacacactcagcatctcaccaaatggatctcccctcaaaa

SEQ ID NO: 122040 - DNA, 601 bp, Human
actaaaaggaggatttcataaccttcagagacaagatgcactgcaggcttctttcccaactgtaatttgtgtgcacctgtacggtcttgttccaaaccatgctttcagcaagagtctataaaggaaggtggaactcctgttatttataggtgaggcaccagaaagaaaaatggtttacatagagaaagaaattcaaagggcatttccagctggttctctcttgttttagatatgagtgttcaaatccatttgctcatttacctgaatgggaaaaatcgcggagatgaaaggctcacgtaartcatacagggaatgccttggcattgaaaaaactcaaagaaatggaattcagctacagtgacaagcataacaatactacaatctagagttagggagagcatatcttttgttttaaccctctgcccatccctttccttcctaccatcatatttttttttaactacaaagaattttgcctattgacaaaaatgattcacccatgtattattaaaatgaaacctttcccttttggtggggccaacagcccagcgaggggctgccattcctgctcctccaggattgagtctgtctcgtttaccat

SEQ ID NO: 122041 - DNA, 601 bp, Human
aaaacaaatatcgtctgcaacatgaacctgatttattcaaggaaaagaaaaggggtctaagagcaggctatacaatttggaaccattaaagtgttataaatctgagagcaaagactagatgggtgggggtggggggtacaattcacaccaatgacaagcaaaatcttttcaagaaaaggaaagatgagaagcacagaaattcaaacacacggtgaactgatcggcacacaaaccagtttagcaactcttcaaggtgaggtgtatttgtgcctcttcatcacgcatacctttgaaaaaaagkaattaaactacagtctaaaggaaagttttatttgtcaaacttgaatctgcaataacagagctagagggcccccagttcctggcccaaagacctcaacttgtatttgatacagctgcgtgtgatgctgtgtatccttttatttaaacacaatccattttcctctgtcagtctacaattagcatatgagtcaaaataatattaaatttcacagcccacagtgctgcacaattgaatgaaaactgactccttttgatgttaatcttgttttttatttgtgatgtaatgctcaaaatcctgctg

SEQ ID NO: 122042 - DNA, 601 bp, Human
taaataaaggcagggcctacgaaagacacaggcagtaataagaaatacttggaaaatgtttttccttttttgtggatagcactttactgcccccttttgcactttaacatcagaacaagtttctacgcagacttattctgaaatcagagaaatactggggtgtagcgatagggtgtcaggtttatacggaattaggttaccagatactactgcttagagtaaaaagtaattaccttaaaacttccagcgagggcaccactatcttctcagcggctttaaacctccaagaaataaggtagtrattggaggctttgacattttctgctttaatttggatgtatatgtgtgttggaacaattgcgtgttttcacaggtgccccttctttcacactttcctaaaacaaatatcgtctgcaacatgaacctgatttattcaaggaaaagaaaaggggtctaagagcaggctatacaatttggaaccattaaagtgttataaatctgagagcaaagactagatgggtgggggtggggggtacaattcacaccaatgacaagcaaaatcttttcaagaaaaggaaagatgagaagcacagaaattcaa

SEQ ID NO: 122043 - DNA, 601 bp, Human
atatatggcatgttgttctgtttattttgctgactgcacggagacaaccataaacaaatggtcacacacaccgcctttacctgagaccactttgggctactgaatggtggacttagaatgatttttagctttctgtgttttctttgcaataaatagtcaatgcttttgtgataagattaaaacattatttttttaatgtagtttcagaaaaactttgtgctatctttcataattgactttaaaaataagcatttaaaatatttaatgcctacagacttaaacttttgatgcaattccctarcaagcagataaataaaattatcctagttgaagttgtggcctatttaatacataaatctctgagtccacagaagctgtagtaacaaacttgtttactcaaataagtgaaaaaaagggaatatatacaatttatgcttaatcattgaactgtacaaacatttcaaagattctaaatcccagctttacaaagaggctcagcctagcagttgcaaaccaaaagtcatgtaatatcacaggtttattcccaagccagtgttctgtatcaagtatacttcgaatttaccccattttggaaaacatg

SEQ ID NO: 122044 - DNA, 601 bp, Human
tgctgattttaagcccaaataaaaagcaaagaccaccaagagtgattcatgtcccacacaggagagagaactgagccagaccagttccatccctgagcgaagtcagagcaggctctctactatcttcctgggaggggaaggctgcctcttcctttccatcaagacaatctccaggttcaggactgcttcccaggccatggcgtgtggcttggtgcattctcactggagggcctgcctgggaaccatgggaagctactctaagagtgaggcatactgagtggaaataggcaactccagtggyttttcccagtgaatcagtcctaagcaagacaatagatgccctgcctttgaatcaaatatagacacaatataatgtggaaaaaactggaaacactcaagtagggcttccaaacttaacatgactatggtgaaaagatctgatattggaatctgtttttactcttggattacctattgaacttaagccaagctttttcaagtttttcaccaatctagactctaatacttctacatggatactttggctaagtctaatcatctcaattagacataaatatttagtaatctaaactggatctct

SEQ ID NO: 122045 - DNA, 601 bp, Human
ttaaacacccaaggggctgacacagagtagatgctcaataaataatgtattaattgaacaaaaaataggaatgaacaaatagaagctaacatttatacaaattgaagtcaaattaaataccactatttgcagatcacagacatgataggaattctgaagacagaaccactgagtcggtacaggacacactgaggaggagagactggatttctgaagatgccctcccaggcacactggcatttctggagagcaaggagccctgcagatgcagtttctgacccttcctctctggaaaaagttstaagtattggcagtcttctacaatccctctctacttaaaatgcaaggcaatcagccacctccagaaccactaataatacaaacacagctgcttttgagcacttgcttttggctcagcactgtccaaagccccatacatcccatgttcttcatttcagcatgacgcatggacctaacacacaaaacaggtgaagacacactggtgcccaatgagcatgacaggaaaagccccctttctctgcacacatttcagttttgactgcagcacattcaattataactccagcattgggaaacacat

SEQ ID NO: 122046 - DNA, 601 bp, Human
agtttattgggcatgccacagagaaagctcgtcaattggagggaacagtggatccactaatactttgttgtcctgttagtttccctgtgctgttgatgttaattaacagacaagtttcatcaagaatgtttcaaattacttatcataattagtcagtcactgatcaaacaatgggttttttattacactgaacaaaagcaatgtcttacaaatgcgtaaaagataaccagaaataattagttgtggtattgattcagctgcaaaatgaagtgtcctctacttgcaaggacaactactgtcyctgccctataaatctttttttttcttcccttgagatgtatttgctccaattaattctcagaagcaaatctttagaactaagactactgatacaatatccccttaatgcttatagctgaaagcctccctcctccctttcctctttcttggtagccatgttcctgaatgatctttcttaatggggagtttctctgaaaaactgaaacaagaacttcctaatgaacatccttctacaagtgctaacactaacaacacacttagaaatctcagctcgtttcgtaagcagccaagcctgcaggct

SEQ ID NO: 122047 - DNA, 601 bp, Human
atttgatatcttggtctggtttggcacagttgaggagaggggtattttccttcttaatagtgcatctgtctgcttggtctttatcaaccatataaactttataatattcatactggccaacagttttagagtccactttggggcaaataatatccaatttgtctcctatctgtgggtatagtaccagtccttgtccaggtagaaatctaaaagcataagaaaaaaaagccattgagttgataaaaattaacagtattaatgacagttacaagatagccaggcaatgcccataatcccaaastacacattttcagattcacactttaatttatcaaaagtctcttacttcagatcaatatgggatgaatgtattttggaattaagctttaaaagaaaaaggaaagacagaaagaaaccactttccttactctaagctgtaggatcaggctacctgctgacatttctttaccaccccctcgcttgtaatatttcagtactcctttgtgtaactttaccataactcttcctccgtggtgagtcagatctcccacatgtttgttattttttaaccattggcagctttagtttattgggcatgcca

SEQ ID NO: 122048 - DNA, 601 bp, Human
tgctgaatccctagcccttaagcacagtctctggcacagaataaatacgaaatgaatgagtgaatgaatggatggatgggtgaagagaaaaggcaatgcacaagatttacctatcaaaatccaccaatggtccttaaaaatggttttgtcagtagagatgctgaatatattcatataatacatttatttcaatactattaagaattctagtgttttttttttctctttgggtatgtatacttaatgaatactggtagcacagggtcccaaattcaatgaagttttctttgaaaaaaaaaarggggggggggacaatttttccacatagattttcatcaaattatttgtcacaataattttaaggaaacaaaaaattgatacaaacctatatagcttatcttaatttctataaaataaatgaataaaattatacttacatataatgtaataatctttgttcttctgaaattctagaccccagaggttagggctgaattcttgaaacttgatggtgaatttgatatcttggtctggtttggcacagttgaggagaggggtattttccttcttaatagtgcatctgtctgcttggtctttatca

SEQ ID NO: 122049 - DNA, 601 bp, Human
ctcttcttgaaacagcgtgtcaaattatatatatgtatgcaaaaaagagtaatgtactaagcaaaccaagtttcgtctttttcttctgaatctggttttaatgtgacctgtcatccccatctttcgaatttatgagctccatcttctctagactgttaacttcttgaggaaaacatgctattttaccacctttcactgctgaatccctagcccttaagcacagtctctggcacagaataaatacgaaatgaatgagtgaatgaatggatggatgggtgaagagaaaaggcaatgcacaagrtttacctatcaaaatccaccaatggtccttaaaaatggttttgtcagtagagatgctgaatatattcatataatacatttatttcaatactattaagaattctagtgttttttttttctctttgggtatgtatacttaatgaatactggtagcacagggtcccaaattcaatgaagttttctttgaaaaaaaaaaaggggggggggacaatttttccacatagattttcatcaaattatttgtcacaataattttaaggaaacaaaaaattgatacaaacctatatagcttatcttaatt

SEQ ID NO: 122050 - DNA, 601 bp, Human
aaagcaattattaaatgctcaccacattaagcaaagagatgttggtaaacaattatttgcatatcttgcatattatttcacactaaaggttaaactcttaatgtttactaaaattccacttgcgcccagtgcgaacttagaatttgcaaagcattcttcgtgaagtcataagctaaagtaagaagagagactctgggtgtgtcggcattatcggtggacgtgggctgcatccacgcattagggacatgcgttcactgccctagggcatctcatctctagtgtgtcccctcttcccgtaccrcgaccttctttctcccaccccacctaggggcattaaccttcttaataaatgcatctgatcagtttcagttgcctgtaaatgtcatgcctaacagtagctttcactgaaaaagtcttactttaaaagtctttactaaggccaggcgcggtggctcacgcctggaatcccagtactttgggaggccaaggcggaaggatcacaaggtcaagagatccagatgatcctggccaacatggtgaaaccccgtcttgactaaaaatacaaaaattagcgcacacctgtagtcccagctacttggga

SEQ ID NO: 122051 - DNA, 601 bp, Human
taatagatgtcgttattgtgtagattaatattataattataaattaaactgcttctaaatacaaatctctcatgtattaataaaaagcaattattaaatgctcaccacattaagcaaagagatgttggtaaacaattatttgcatatcttgcatattatttcacactaaaggttaaactcttaatgtttactaaaattccacttgcgcccagtgcgaacttagaatttgcaaagcattcttcgtgaagtcataagctaaagtaagaagagagactctgggtgtgtcggcattatcggtggrcgtgggctgcatccacgcattagggacatgcgttcactgccctagggcatctcatctctagtgtgtcccctcttcccgtaccacgaccttctttctcccaccccacctaggggcattaaccttcttaataaatgcatctgatcagtttcagttgcctgtaaatgtcatgcctaacagtagctttcactgaaaaagtcttactttaaaagtctttactaaggccaggcgcggtggctcacgcctggaatcccagtactttgggaggccaaggcggaaggatcacaaggtcaagagatccag

SEQ ID NO: 122052 - DNA, 601 bp, Human
ataataaagaaaaggtctcttcagaccacatggccataatatctccatctttgcattacttgaagattaggagatctcattatgcaaatcaggcccagggctaattactgaaataggtcacttgaaaaagtcaattctaaacaagaataaaaacccatatacagatgctccatgacttaggtggggctatgtcttgatacttgataagcacaaggtaagctgaaaatatcattaaattgaaaatacatttaatactccaataaacccatcagaaagttgaaaaatttaagtggaactattktaagtcggtgaccattcatatataattttgccacaagttaaaaaacaaataaccatctatgagaagaatgaatgaggatgcatatcagtttgccacatatctcctaaggggacttagttaatacttagtgtgtttaaaaatacagttcaaattaaaaattcatattcacgtctgaaactcacaagtgtgatgactatattttaaagcaggtaacaccacaaatcaaattaaatgtttttaaagaatttacagaggatcatgtccatttgaaaccacactaacaagtgatcctatattgca

SEQ ID NO: 122053 - DNA, 601 bp, Human
aataggcaatttcagaacagttatttcatgaacattaaaaaaaactttaaagacaataataaaataactagaggttaggtaaattagctactctatttttaaggcaattaaagatctgaacataataaagaaaaggtctcttcagaccacatggccataatatctccatctttgcattacttgaagattaggagatctcattatgcaaatcaggcccagggctaattactgaaataggtcacttgaaaaagtcaattctaaacaagaataaaaacccatatacagatgctccatgacttasgtggggctatgtcttgatacttgataagcacaaggtaagctgaaaatatcattaaattgaaaatacatttaatactccaataaacccatcagaaagttgaaaaatttaagtggaactattgtaagtcggtgaccattcatatataattttgccacaagttaaaaaacaaataaccatctatgagaagaatgaatgaggatgcatatcagtttgccacatatctcctaaggggacttagttaatacttagtgtgtttaaaaatacagttcaaattaaaaattcatattcacgtctgaaact

SEQ ID NO: 122054 - DNA, 601 bp, Human
cagtatcaactggagcatttagtaagtctaagacacagcttcccttgaaaataggcaatttcagaacagttatttcatgaacattaaaaaaaactttaaagacaataataaaataactagaggttaggtaaattagctactctatttttaaggcaattaaagatctgaacataataaagaaaaggtctcttcagaccacatggccataatatctccatctttgcattacttgaagattaggagatctcattatgcaaatcaggcccagggctaattactgaaataggtcacttgaaaaagycaattctaaacaagaataaaaacccatatacagatgctccatgacttaggtggggctatgtcttgatacttgataagcacaaggtaagctgaaaatatcattaaattgaaaatacatttaatactccaataaacccatcagaaagttgaaaaatttaagtggaactattgtaagtcggtgaccattcatatataattttgccacaagttaaaaaacaaataaccatctatgagaagaatgaatgaggatgcatatcagtttgccacatatctcctaaggggacttagttaatacttagtg

SEQ ID NO: 122055 - DNA, 601 bp, Human
acaggggttaagttacttgtcaaagggcactcaggaactcgggtcttccagaccccagactctcaacctaagatgttgatctgtttctcttggacagggggagggtggtggtggtgctgtatcccccaagatcccaaatgcacagtctctggcaagattctgatgaatatcctattacaaagatgacagctgtaggttagaaataaaaatgagtttaaatgcttgaacgcagccattatgcacaaggtatcaaacagaaatcctcacccctcaatcagaggacccaaatgacaggctgatrttgctgtatcaccaaatgggattacatttaatgatggaaatgtggcttttgctacatttatcgtacataaataattcatcaaataaagcacataatcgctttatacagcccacacattattctatattctaaaagaaatctatatgttaagaggacatttgaaagctcctgtaactatcttgctaaagaacagtgcattcagtacgtttcagtactacttgccaaacctacaccccagaaataagtaaatcaaaagcagagaagaaaacaaatatatgcttaacataagcaacagactct

SEQ ID NO: 122056 - DNA, 601 bp, Human
ctggattcccatcaaccctgtgaagcaggtgctgtcattatccccactttacagatgaagagactgaggcagacaggggttaagttacttgtcaaagggcactcaggaactcgggtcttccagaccccagactctcaacctaagatgttgatctgtttctcttggacagggggagggtggtggtggtgctgtatcccccaagatcccaaatgcacagtctctggcaagattctgatgaatatcctattacaaagatgacagctgtaggttagaaataaaaatgagtttaaatgcttgaackcagccattatgcacaaggtatcaaacagaaatcctcacccctcaatcagaggacccaaatgacaggctgatgttgctgtatcaccaaatgggattacatttaatgatggaaatgtggcttttgctacatttatcgtacataaataattcatcaaataaagcacataatcgctttatacagcccacacattattctatattctaaaagaaatctatatgttaagaggacatttgaaagctcctgtaactatcttgctaaagaacagtgcattcagtacgtttcagtactacttgccaaacc

SEQ ID NO: 122057 - DNA, 601 bp, Human
aggatgctactaaaattatcaataaagagacactattttcattgtgtaacagggaactgagaaaaagtcctggcaaggctggtaacatggaaattgggaaaaatgattatatgtatctgaagactcctcccctgtctgtctcttttgggtcttacaaaggatctgctaacaagcttgggcaattccatgaacaaaaagatacataaatgcatgtttcttggtaaaggaagctcaaggacaaaagagcttttataacactgaaagaagacaaagagagaagatcttataattaagttatgcrgcattactgaaacgtgtaaactctctggagttccattttatggatggacttcaaatcagccaagcttttggggtccatcctctccagcttgcagccgaacacaggtctgcctccagcctggagcctcacacttcctcccctgctccaaagttaactcttagttatatgtatttggtgtcaaaggtggaagtaataagcattttctatatcccaccacatctggattcccatcaaccctgtgaagcaggtgctgtcattatccccactttacagatgaagagactgaggcagacaggggtt

SEQ ID NO: 122058 - DNA, 601 bp, Human
ttcttagttcaactttgggggcagatgattgcaagctggttatatgttacacaatatatgacaaagcgtcagtaccaaaatgtctgatacaagcatacagtccatcctttatagttcatgagcttctctgctgttgctatgtatgcaacatgtgtgtacgtatactctgctgtctctacatatgtgttatgtatgcatacatactatctttactattgctacatgtgcacttagatgtttggacccaggaggcactgttgtaaactaacaacgccggcctaagggtccagcggccctggaytgagttttgtttctgacatttgatggccaactgaattgtactaagctactcacactaagtttcagctttctcacagtgataaaaattgctctaagacctgtgtttctagacttcaaagtgagacaagagtatgtgaaggccacaacacttccctaagtgatcaaacactcagcccgagattttgaaacttcaggaacaaatgtgactcttaagaactatacaaataagttaaagtagtatttgcttgtctggtctgtgcatcttggctattttcatgtgttttattttgctttaaagttt

SEQ ID NO: 122059 - DNA, 601 bp, Human
gcaactttctattgaggggcttaaagtacttgctaacataaaaacacaaaatagtatagatttattgaaaaaatggaattaagagtatgtctaaaaagaaaaagaaaattcataagagctaacaaattgccactataaccaccttttcccaatggccttcctttcctagtaccctgtaggattttcttagttcaactttgggggcagatgattgcaagctggttatatgttacacaatatatgacaaagcgtcagtaccaaaatgtctgatacaagcatacagtccatcctttatagttcrtgagcttctctgctgttgctatgtatgcaacatgtgtgtacgtatactctgctgtctctacatatgtgttatgtatgcatacatactatctttactattgctacatgtgcacttagatgtttggacccaggaggcactgttgtaaactaacaacgccggcctaagggtccagcggccctggattgagttttgtttctgacatttgatggccaactgaattgtactaagctactcacactaagtttcagctttctcacagtgataaaaattgctctaagacctgtgtttctagacttcaaa

SEQ ID NO: 122060 - DNA, 601 bp, Human
gaccagtagtaaccccaataaggtgcccctatctaaatttgccctacacatgaaccttattccgtccaggggacatgttctatcctctaagaatccagagcaatttcccgcgtttgtgccaataaaagaataccttcatcccctgtttaacatcaggaacaacaaaatgggctacttcaccaatgcaaaaaaccacttgcaaagcacaactgtcacccagcctggctcctctgtaatgagatcaattacactccagcttgagggtctgccaatccatcagtccttctatgcagccagccarccaacaaaactgctgcacttgtacttggctaagggaatttgaagtctcataccacctctacttgtatgtttgagagatttttatttttaatcactatatgatgtagcaactttctattgaggggcttaaagtacttgctaacataaaaacacaaaatagtatagatttattgaaaaaatggaattaagagtatgtctaaaaagaaaaagaaaattcataagagctaacaaattgccactataaccaccttttcccaatggccttcctttcctagtaccctgtaggattttcttagttcaa

SEQ ID NO: 122061 - DNA, 601 bp, Human
agaagcaggtgtttgagtgaattatttccagcacataatccagtgcctgctctgaagattctgacagtctcaatcattaaaatatccttgccaagatacgaaaaggtctagctgggaaagggtcagagtaaaaagttcatggtggggagggtgcacatcccacaaccctctagctctttctactgtcactaattgcatgcaatgatattaatgacccagtaattgcgagacgagtggcactgaagtggaaaacatccatcggaggcagagttcatctctaggcggtgggacttcaccagcraccgaattaatgtctgctgacagtttagaatataacaacactgcagaggagaaaatgcgtcactctcatggacacacacagcttagatggacatcacagcttagatggacatgttgtttgctttgaccatctagagaccagtagtaaccccaataaggtgcccctatctaaatttgccctacacatgaaccttattccgtccaggggacatgttctatcctctaagaatccagagcaatttcccgcgtttgtgccaataaaagaataccttcatcccctgtttaacatcaggaacaacaa

SEQ ID NO: 122062 - DNA, 601 bp, Human
aaggataccaggatacagaactgagtttacaggtgccatcatgctatgcgaggcttggacactgagggagaaggtcaatctactgagagaaaagtcacaaaataaagcaataaacaccacatctagaacaggagaaattctatcacagctttcgcataaagccttttaaccattaaaaaccgtatgaatgtcaaatagcaatcagtgaagacattcagggccataggtatctttgactatacagacctggaaagctactggctacagacactcaagagtgaaaagacggaagagcagaaagtgatggcaggtgcacatgtgtgcgtgtctacatgtgtgtgcgtgcaagcacatgtacacatagggggtatagatcaagaaaacataccgtccaggctcagtgatgtacactgacgcttttctgagaaagaccagacagtactggcaataaactgcacctcccccaacccccgacttttttgtttgtttgttttgctagagacatgtttaacaacataagattatttatggagttgtttattttatttcccctcaaactattgtttggaacagcttggtgtcttgatttttaataaattct

SEQ ID NO: 122063 - DNA, 601 bp, Human
ttattttccttttttttttttttgagacggagtctcgctctgtcacccaggctggagtgcagtggtgtgatcttggctcaccacaagctctgcctcccaggttcacgccattctcctgcctcagcctcccgagtagctgggactacaggagcccgccaccacacccggctcattttttgtatttttagtagagacggggtttcacagtgttagccagtttggtctcgatctcctgacctcgtgatccgcccgcctcggcctcccaaagtgctaggattacaggcgtgagccaccgcgcccrgcccagaatttattttcaagaagaaatttatacttagcaaagttaatttaaacaaaacaagccctctacttgatgagatggttctcactgacatttgattaactcttattttgcatgcagggagccacagctaaaacactgtataaactatcagtgatgtaggatgtgtgagtttttcacccgtgaaaatatcgttcaatatgataggaagaatcacttgaattaataccacattgctatggttgtgttttgaaaacttaaagcagtaaatcatgcattaagaagtaataactggcttag

SEQ ID NO: 122064 - DNA, 601 bp, Human
atacagctgcactggacacaagttactctcatgtaaccacaaaacaagtagcattttatgaacattctctgtcaatatctatgggaactattcttttccagcatgtcctcacatgctagccttgctaatttggacttcttaggcgagtcttcctacacatcagtttccttaagcttgatacagacttctgaagatcggaagactgttatcttggcaaactgaagaattaaaaaaagcataatccagtaacaacatggaaagcaaagccgtgactttaaaataaacacaaacacaacaacawaccaaactgtattactgttttcttctaccacagggctatcaaatctgagtgtcaaaaaaacaaaaagaataaggtaagttgaaaaataagaaggctgataaaaaaataattagtgtgaatatacaacctaggaagctaagatttatctatttaacaccctgacatcaattcaaactatgtactctagaaacaagaattcaatttctgaaactcaaattaatgtagttgaatgccttgagtttcacagttatcttttaagatgctaacttagaagagaagttctaaacatggaaatgatag

SEQ ID NO: 122065 - DNA, 601 bp, Human
atgtgaaacggggaagcacaaaaaaatcctacagaataatggtatcacagttcttatggaaagaatgaagcaccaggaaatataaatactattgagggtatttcaaattatttaaaaatgtagcgtatttgtatggggccaggatggaggagagggcagatggacacttggaagcaagtatttgtatcaactccgttgaagaagtccaacagagagacatgataagcatccagggtcatgaaaaccacagagtcgtcagaataaaaacgttgcccttacatacagctgcactggacacaasttactctcatgtaaccacaaaacaagtagcattttatgaacattctctgtcaatatctatgggaactattcttttccagcatgtcctcacatgctagccttgctaatttggacttcttaggcgagtcttcctacacatcagtttccttaagcttgatacagacttctgaagatcggaagactgttatcttggcaaactgaagaattaaaaaaagcataatccagtaacaacatggaaagcaaagccgtgactttaaaataaacacaaacacaacaacaaaccaaactgtattactgtttt

SEQ ID NO: 122066 - DNA, 601 bp, Human
tatgggtctcactggcacagagatgtgaaacggggaagcacaaaaaaatcctacagaataatggtatcacagttcttatggaaagaatgaagcaccaggaaatataaatactattgagggtatttcaaattatttaaaaatgtagcgtatttgtatggggccaggatggaggagagggcagatggacacttggaagcaagtatttgtatcaactccgttgaagaagtccaacagagagacatgataagcatccagggtcatgaaaaccacagagtcgtcagaataaaaacgttgcccttasatacagctgcactggacacaagttactctcatgtaaccacaaaacaagtagcattttatgaacattctctgtcaatatctatgggaactattcttttccagcatgtcctcacatgctagccttgctaatttggacttcttaggcgagtcttcctacacatcagtttccttaagcttgatacagacttctgaagatcggaagactgttatcttggcaaactgaagaattaaaaaaagcataatccagtaacaacatggaaagcaaagccgtgactttaaaataaacacaaacacaacaaca

SEQ ID NO: 122067 - DNA, 601 bp, Human
aaatacagttacacgttccaccaggaaagatttttgccatgagttagaaatgatctaaggtgccatgaactgttttaacccagttagtacactggtactaactgaaactccaggaggtaaactttacaagtataacgtaattcaaaatgacttcagtctattttatacttgatgtaagtatagcttcccatagtgaaaatcacctttcttctcccctgctacatcctcatcacagagtgtaattcttatgctgaggttccaaacccccctccttgaacagtgacacagctaaaaaaaaaaagtctcctatcccaattatacctccttcctggcagcgaactctgaaataaaaccacaagattaatattctgatttctcctgcaatagtcaccaagaagctctgaaaggcttagtggctgattttgaaaaataacaagaaattgctaatgcttgggaaaaaaaatctatttccatttcaggagacaattctgcaattattttcattgttcatttgaatgtactgggaatttttaacttagagaaagagtgaaaataaattgttagttcattatacttagtttttctttgtatctttctatca

SEQ ID NO: 122068 - DNA, 601 bp, Human
gcacattatttgatttttttttcttttaatttgtaggtcagtgccttttctgaatatcaatgcttttgtgcggagctccctaggtttaccaaaacggggtcttgacaaccacaaatgtaaaatctctagagtattaaaattcaattggaatctataatttaacatccacagactataagacagtaggaggaaggctgtgttgcataagaatgaaactgctttgcacctttaagagtgaaaacttttttatttcttggtttaaaaaaaaagtgtgtggggaagagggaaacattcaagtctyagagttgaagaaggaaaaatctacagatgctgcctttgtaggttcctctgaagccacaggctattgcttgtttgggggagtgtgcttgccacgtggggagcaaaagtgggctgaacagtctgaatgcagacagtttttctgctatattcagcattttgcttcttttccttttaagtcaacctgtgacttgcaaagggtactggaagatactgaaaaattcactactaatatcaaaataacatcccaaatacttggttgcttataaaggggcatttaaaatacagttacacgttccaccag

SEQ ID NO: 122069 - DNA, 601 bp, Human
aaaataaatcccaaagacattcttctaatgggattgtttgttttccaaacagtaggtcagcaaacaagttctatatgcatttatggtagaaatatgcattccactgaaattatattaactacaaaaataaggcacttatttacttgtctttgtggtcttgaattaactttactttcactgttttcctcaaaacaaagactgcctcttctgtgcatacatatcactgtgcttctctgagtgcttgcttaaactttacagtctcacaattgcatctcattcttctgtaactgtggataaattyttcccgggaaactgggcaataattgccataataatacttgtcttggaagggtagtaagaagcagacagtatctgtttgtagatacaaacattgtagaccattaagaaactattcagcagacagcttaaaaaaaaaaaaaacctaaaaattttgtacacttctgtgaatctaaaaaaaatctttttaattatttaatggggctattaaaatttttttttattatactttaagttctagggtacatgtgcacaacgtgcaggtttgttacatatgtatacgtgtgccatgttggtgggctgc

SEQ ID NO: 122070 - DNA, 601 bp, Human
aaaatctcccctttttcctccatcgttttgtaaatcagaagaacatacgtgttattactgccaatgtcaaccttagtcaacctcttcaaccaaactacctgttgcgggaaaactctggctgaatagagggttcacacacatgcccaccactcattctgggtcctgtggcagccctggagagaaagtggggacttttaccagccacttgctggtgttcaccaactgaattccctctccacctcagcagtgaggagtggaaggaaggacagaatcattttaccattttcagcattttttttttcaacagcctatgctctatttaaacacatccttgttctgtctctttagaccagcgaggtctctgaatagctttgtaactcaagctgtaaagagataggctgccaggtactttaatgagaaacaggctttgaattacagttcaagttccaggagagaaaagaaggtggagagtgctagacattttcattcccctaaagttcaaggggcaaggaacaaaagtgtttcatatacatttctgcaatttaaatccattttctacctgattatcaaagtcttggcttgtaacactgtactttgcaag

SEQ ID NO: 122071 - DNA, 601 bp, Human
acccctccctcctggttatccaggccctccaaagacccatttgatgtagctgattaaaaataaaatggacaaaacaaaaaaataaagaaaaatcaggaaatcaataagccaagtttacatgaacatgaaatgtctgaaaacaatttgaaaaataagaattcactcttagtcacaagttttctgaaagtatggggatgctgaaagccaaaaagaaaaagaaaaagaaataaagagaaatggatatcggaaacactgccgcacgtatgctatctgactccaaatttatttaggcactttctcyttccttcacaaatgactgatttaatgttagtctataaataaaagggatggcatccttcaaaaagtctatggactcttttggggccaaactcagaagagcaaaatagttaatgcagccatttccaaacgtggtaatcatccccccacacctgcttcctccactgcagatttcctgcttcaagaacaattagcttgacgctctgtttgtcaagcatccaagttctgtaaacactagaccaggagcctcccacaacccttgtcttcttttttcagccttatgcatgcttaagaagtataccag

SEQ ID NO: 122072 - DNA, 601 bp, Human; identical to SEQ ID NO: 29313

SEQ ID NO: 122073 - DNA, 601 bp, Human; identical to SEQ ID NO: 29314

SEQ ID NO: 122074 - DNA, 601 bp, Human; identical to SEQ ID NO: 29315

SEQ ID NO: 122075 - DNA, 601 bp, Human; identical to SEQ ID NO: 29316

SEQ ID NO: 122076 - DNA, 601 bp, Human; identical to SEQ ID NO: 29317

SEQ ID NO: 122077 - DNA, 601 bp, Human; identical to SEQ ID NO: 29318

SEQ ID NO: 122078 - DNA, 601 bp, Human; identical to SEQ ID NO: 29319

SEQ ID NO: 122079 - DNA, 601 bp, Human; identical to SEQ ID NO: 29320

SEQ ID NO: 122080 - DNA, 601 bp, Human
gctggcagggagcaggcatgtccacccgcaagcctgggaggctaactctggcattcctggccggagccgccatgctcattggtgggccagtttgggacatccccgtactcaaagaccatatggcagcctctgggaaaacaaaaccaaaacatcaccttctattaaactctgtatattattattttttacaatagaaagttaaaaatcaagacttagatttactatacattttttctctcagattacaaagtttatattatataactggggttccctaaattgatttcttttaaaacagtcttaaagagaccagaagtgaatacaaaagaactaaacaaaataaaaaattagaatgtgctgtagctgaaagctgtctatacctgtaagcctccaagtttcatacaaaaaaaaaaaaaaaaaaaaaccacaaagaaaaaaaccaaaaaacccaacaaacccaggggcgagcgcgcgaacagacgtgggtgagcaccgcgcggtggcaggagttagcacctggagacgacaggccgccgccagacaggacccgcgcccggcacaccactggcaaggcctgcatctctgcgactgtgtgaatgca

SEQ ID NO: 122081 - DNA, 601 bp, Human
acaaaataaaaaattagaatgtgctgtagctgaaagctgtctatacctgtaagcctccaagtttcatacaaaaaaaaaaaaaaaaaaaaaccacaaagaaaaaaaccaaaaaacccaacaaacccaggggcgagcgcgcgaacagacgtgggtgagcaccgcgcggtggcaggagttagcacctggagacgacaggccgccgccagacaggacccgcgcccggcacaccactggcaaggcctgcatctctgcgactgtgtgaatgcatttcttctgcggttttttcttattttcttttttktaaaaatgaccaatgatgttaataaataactatttatatacacataagctcgggaagtggttcccaagggtggcgcggcagcagcagcaggggcagcgctagccaggcggggactcacagcgggctggacttccgtagaaaattgccgaaccttacaaaaaaagtctcctttttttttttttttaaatcttttcttctttttttttttttaaagttgaggtaaaagcttcagtgtatggaaacctgcaggctgcatacacagccgctctgttccctccgaggagctcctgacatcaccac

SEQ ID NO: 122082 - DNA, 601 bp, Human
aggagttagcacctggagacgacaggccgccgccagacaggacccgcgcccggcacaccactggcaaggcctgcatctctgcgactgtgtgaatgcatttcttctgcggttttttcttattttcttttttttaaaaatgaccaatgatgttaataaataactatttatatacacataagctcgggaagtggttcccaagggtggcgcggcagcagcagcaggggcagcgctagccaggcggggactcacagcgggctggacttccgtagaaaattgccgaaccttacaaaaaaagtctcctttttttttttttttaaatcttttcttctttttttttttttaaagttgaggtaaaagcttcagtgtatggaaacctgcaggctgcatacacagccgctctgttccctccgaggagctcctgacatcaccacgagcggagaacgcacatcccacccgaccaccccccaagggctccacgctccgggctggggctgcgatgacccttcgcttaggcccagcctggtctccacaagcaggcacatctgtcctcagcccctccagaaagaggtggccgcgtcagacacgagggtcagagctcggg

SEQ ID NO: 122083 - DNA, 601 bp, Human
aatgaccaatgatgttaataaataactatttatatacacataagctcgggaagtggttcccaagggtggcgcggcagcagcagcaggggcagcgctagccaggcggggactcacagcgggctggacttccgtagaaaattgccgaaccttacaaaaaaagtctcctttttttttttttttaaatcttttcttctttttttttttttaaagttgaggtaaaagcttcagtgtatggaaacctgcaggctgcatacacagccgctctgttccctccgaggagctcctgacatcaccacgagcrgagaacgcacatcccacccgaccaccccccaagggctccacgctccgggctggggctgcgatgacccttcgcttaggcccagcctggtctccacaagcaggcacatctgtcctcagcccctccagaaagaggtggccgcgtcagacacgagggtcagagctcggggcccaaatgacaaggacaatgcgtgttgacaaagctaacagctttcaaatacagtacccatatccgagacatttccttggaaaaaattctttctcgagctatcgaccaggttgggcctaagcaaagggattccac

SEQ ID NO: 122084 - DNA, 601 bp, Human
aagctcgggaagtggttcccaagggtggcgcggcagcagcagcaggggcagcgctagccaggcggggactcacagcgggctggacttccgtagaaaattgccgaaccttacaaaaaaagtctcctttttttttttttttaaatcttttcttctttttttttttttaaagttgaggtaaaagcttcagtgtatggaaacctgcaggctgcatacacagccgctctgttccctccgaggagctcctgacatcaccacgagcggagaacgcacatcccacccgaccaccccccaagggctccaygctccgggctggggctgcgatgacccttcgcttaggcccagcctggtctccacaagcaggcacatctgtcctcagcccctccagaaagaggtggccgcgtcagacacgagggtcagagctcggggcccaaatgacaaggacaatgcgtgttgacaaagctaacagctttcaaatacagtacccatatccgagacatttccttggaaaaaattctttctcgagctatcgaccaggttgggcctaagcaaagggattccacaaggttcttcggtacgaatctcacacggttttctggggtca

SEQ ID NO: 122085 - DNA, 601 bp, Human
ttgccgaaccttacaaaaaaagtctcctttttttttttttttaaatcttttcttctttttttttttttaaagttgaggtaaaagcttcagtgtatggaaacctgcaggctgcatacacagccgctctgttccctccgaggagctcctgacatcaccacgagcggagaacgcacatcccacccgaccaccccccaagggctccacgctccgggctggggctgcgatgacccttcgcttaggcccagcctggtctccacaagcaggcacatctgtcctcagcccctccagaaagaggtggccrcgtcagacacgagggtcagagctcggggcccaaatgacaaggacaatgcgtgttgacaaagctaacagctttcaaatacagtacccatatccgagacatttccttggaaaaaattctttctcgagctatcgaccaggttgggcctaagcaaagggattccacaaggttcttcggtacgaatctcacacggttttctggggtcatcgggttagcatttgaagttgtcatctccaagtgactgaattcagtgatgaagaagagactttctgcagagttcacaccttctcatcaagtctaacg

SEQ ID NO: 122086 - DNA, 601 bp, Human
gttaaactgtttttggcagcaactctaacaagactaatttcagatatggaattgacctggtcactggaaaccgaccaggcttcccgtgatcaaatcttttaacagatttgcttgacattaattagtctctgatttaaaacaaacaagcaaacaagatctaacacttggcattagcacttaagctggaacttttttttggtcccagctttggtgttgccgtccagaaggctgacgggatgactggaccatgtcaggcagggcagagaagccgtccccaacacaccagttccctgaaagggayagacgatccaaacctataaacagaaaggctgtttctttccgaggacagaccccagtctcccaacattcggcgatgaaatgggacacggaggcctggaaggaaactaaaggagatttggaaaggggaaggaaaaaacaactgtcccccatcccccatgcttcctttccaggccattagtgcgccaggcattccgttccttcagctgcccttgagggccactccccacgtctatagaaggaaagggaagggatgtccacccttgatgtaaagttggagggagtaagaagcgcccgcgactct

SEQ ID NO: 122087 - DNA, 601 bp, Human
aatgcgaagaattgaaaatgactagtgttttactgcacagcccttagtcacagtgctgaacgtcccctttgcctaaaccatcattgctcccagaagactttgcccccacaaggccaaggacagagcagatcggttgggaaggaattgggaatagctctgtgggactccagcaacaggtgagagacccttgagactaatactccaggatgttagtttcttagcctaacgaactgaagttaagtccagaggtgtttaggtaccatgacttttaggggtgcagggtgctatgtgacactgttamctttatctgtggaatatttgaattgtcactgaaggaagggatgtctgctgtcagggaagggcaggggcaagttccttgagcttgggcaacggattactgttggatcggggagcaggtttgctgtgagccatttactagatatctattttgaaatgtgtatctcctcaggagccaacaccccaaagggagattctgaatttgcagttaacttcccccccccaccgcccccaccccgcctcagagatttaaacgtgtgcactcatgcacatacacaaaacactagtcaaacaacaatctctt

SEQ ID NO: 122088 - DNA, 601 bp, Human
aagtgacaaggtagcagatttcagggaggtaggccaaagcagcatggtaagagctggctgctctggacacagcacctcttgtgcccccacttagaggacaagaggctcctggtagccccagagctttccatatcatcttggcaaagcccttttcctccatccgtccatcagcagggctgtgagtgtggcaaggtgagatgacagatttccaggcaagggctgccctggtggcctgcacctgcacgtgtgggcttcaatgtgcaatgtccactccccatttgcatcctccacccacaaaacytcatgttctggcagcaaacttaacccaccagagaagacagtgcattcactttccatccagtgcaatgccatgcaatgcctagatggtccaaacacaccttgtttataaaattttttccacaaactataccattaaacattttattctgatagagagcaatgcgaagaattgaaaatgactagtgttttactgcacagcccttagtcacagtgctgaacgtcccctttgcctaaaccatcattgctcccagaagactttgcccccacaaggccaaggacagagcagatcggttgggaagga

SEQ ID NO: 122089 - DNA, 601 bp, Human
cacaaatacttctgaagcacaaagtaccttgcccccttaagcctgatcatgtttccctcccctaagcaagcccttaagtttcttagcccaatcaccagcacctctaaaggcatctaaaacttcattcggtatcagagaattataggggtggggaggtgcagatcccggttctggtcttgactttgccatcaatcagcctagggaacctggacatgtcaccttgtacccttcatctccagtttccctctcgaagagggcctttgagatgccagtgaaccctaacacgctagaaactgccatmgcagtggcaatcaggactcatcaggacttgaagaggatgtgcaatctgagacttcatctttcttaggctgggtggctatagctgctaccatagcctgaaggtgaggcaggtctcctctcgccccagtgtgactcatcagcaggcaatgcccacacctcctcccttctgaaccccatatcttggcaggcctcaaaactgggagtttctgtggttttccacactaaacccacagaatcatgaacataccaacatgtgttctccatgaaggctgaccctcccttcggagcttttgaggggtat

SEQ ID NO: 122090 - DNA, 601 bp, Human
ccttagtcacagctgtcacaaatacttctgaagcacaaagtaccttgcccccttaagcctgatcatgtttccctcccctaagcaagcccttaagtttcttagcccaatcaccagcacctctaaaggcatctaaaacttcattcggtatcagagaattataggggtggggaggtgcagatcccggttctggtcttgactttgccatcaatcagcctagggaacctggacatgtcaccttgtacccttcatctccagtttccctctcgaagagggcctttgagatgccagtgaaccctaacaygctagaaactgccatagcagtggcaatcaggactcatcaggacttgaagaggatgtgcaatctgagacttcatctttcttaggctgggtggctatagctgctaccatagcctgaaggtgaggcaggtctcctctcgccccagtgtgactcatcagcaggcaatgcccacacctcctcccttctgaaccccatatcttggcaggcctcaaaactgggagtttctgtggttttccacactaaacccacagaatcatgaacataccaacatgtgttctccatgaaggctgaccctcccttcgg

SEQ ID NO: 122091 - DNA, 601 bp, Human; identical to SEQ ID NO: 60218

SEQ ID NO: 122092 - DNA, 601 bp, Human; identical to SEQ ID NO: 60217

SEQ ID NO: 122093 - DNA, 601 bp, Human; identical to SEQ ID NO: 60216

SEQ ID NO: 122094 - DNA, 601 bp, Human
tccaagattcgtgtgccagtatgattgagctcttggcgagggctgtcttcctggcttgcagatggttgccttctcaccgtgtcttcatatggtagagacagaaagttctgaactcttcctgttcctatagggacacctcaccctcatgacgtcatctaagcctaattaccttttaaggatcccacttccaaataccattacattgagggttagagcttcaacatacaaattttgggggaaggggcacaactattcagtctatagcaggttgtctcatttggtcttgatgttgtgtttcagccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgagtacaaaagactggggttttaattttatcagcaataaatagatattatttattgccagttatctaatttagagataaaccactttaaacaagatctgtctttcattctgtttgttctcttagaaatcgtgacattggttttcctgggcatgttgtc

SEQ ID NO: 122095 - DNA, 601 bp, Human
gaagttgaagtcatatttatagcatttcttctggacatttctctcagtcttgagtgtggatttctttttttttgagactgagtcttgctctgtcgcccaggctggagtgcagtggcgcggtctccgctcactgcaaactctgcctcccgggttcatgccattctcctgcctcagccttccaagtagctgggactacaggcgcccgccaccacgcccagctaattttttgtattttagtagagatggggtttcaccgtgttagccagcatggtctctctctcctgaccttgtgatccgcccrccttggcctcccaaagtgctgggattacaggcgtgagccaccgcgcccagccaggtgtggatttctttaatggtcagcttagaggctgctataaaaaaataccatagaccaggtggcttcaccaacagcatttatttctcacagttctagaggctaaaaatccaagattcgtgtgccagtatgattgagctcttggcgagggctgtcttcctggcttgcagatggttgccttctcaccgtgtcttcatatggtagagacagaaagttctgaactcttcctgttcctatagggacacctca

SEQ ID NO: 122096 - DNA, 601 bp, Human
cagaaatattcccttgtgtttataaagattttcagatctcagatttgttcttttagctccacagtcagttaaaaaagatatcttaaagaatttaagatctagagcttacagtttgttttgtggggctgctttctctatgactattttcttctttcttgccaactctcttctctcgcaacctctccttattcattccttaacttattttctgatcttccagaacttgggttttacttaatgcagagattgaagttgaagtcatatttatagcatttcttctggacatttctctcagtcttgrgtgtggatttctttttttttgagactgagtcttgctctgtcgcccaggctggagtgcagtggcgcggtctccgctcactgcaaactctgcctcccgggttcatgccattctcctgcctcagccttccaagtagctgggactacaggcgcccgccaccacgcccagctaattttttgtattttagtagagatggggtttcaccgtgttagccagcatggtctctctctcctgaccttgtgatccgcccgccttggcctcccaaagtgctgggattacaggcgtgagccaccgcgcccagcc

SEQ ID NO: 122097 - DNA, 601 bp, Human
gaagaaccagttcctccatgactctgtcattttccccaccttaatcctatattcttggatccccactttaacctgtatgtatctttaatctatttttttctgtattgaaatgtgaaacatgaaaaagttattgcttcttaacactaacgttacagtattaaaatgtctttaaataagagttaaaagtttaatttaaaaaattatccaagttaaataatcctttcctaatcttctccagtagatttttgtgtgccccaaatgagacattgttattataaatctctgtgtaagatttatgagstctagcttgtctgagcactcaaatgacatttccagaatcatgacacaggttctcattagcagtttgattctatagtatgttgtactcatatctttattttcttatctgccctctgctcctaagtttagtgataggattagatagccaacagcaccctggggattggtgtttatttgattggtggacttctgctttttatattaacagtactgccacttcaaaaatgtttctctgatagaatggctagctctctgagctctgaattcagtgatgtgtactcccatctttacaggagctctt

SEQ ID NO: 122098 - DNA, 601 bp, Human
gttaacattaaatatgaacatagctatgccttcatggtttgatattattgggctttcaccagattcacaggaggatgaatctgggattaaacaggcagcacaaaatataaaagctttgattgatcaagaagtgaagaatggcattccttctaacagaattattttgggagggttttctcagggaggagctttatctttatatactgcccttaccacgcaccagaaactggcaggtgtcactgcactcaattgctggcttccactttgggcttcctttccacagggtcctatcggtggtgcyaatagagatatttctattctccagtgccacggggattgtgaccctttggttcccctgatgtttggttctcttacggttgaaaaactaaaaaacattggtgaatccagccaatgtgacctttaaaacctatgaaggtatgatgcacagttcgtgtcaacaggaaatgatgaatgtcaagcaattcattgataaactcctacctccaattgattgacgtcactaagaggccttgtgtagaagtacaccagcatcattgtagtagagtataaaccttttcccatgcccagtcttcaaatttct

SEQ ID NO: 122099 - DNA, 601 bp, Human
tggaaaactctgttcttacagcttagctcttttcattgaaattcccagataattatcttgtaatttccctgtgcctaaaaaagtcttatagtagtcaaactagaatagaggtacaatttgtaattcttaattaatatcagaataaatgtgagttagaaagagatcttctcgccggtggggccggctgggactcgccgctcgcacgcccttgggcagcggcggggcgcctgctcttccttccgcttgcgctgtgagctgaggcggtgtatgtgcggcaataacatgtcaaccccgctgcccrccatcgtgcccgccgcccggaaggccaccactgaggtgattttcctgcatggattgggagatactgggcacggatgggcagaagcctttgcaggtatcagaagttcacatatcaaatatatctgcccgcatgcgcctgttaggcctgttaacattaaatatgaacatagctatgccttcatggtttgatattattgggctttcaccagattcacaggaggatgaatctgggattaaacaggcagcacaaaatataaaagctttgattgatcaagaagtgaagaatggcattccttctaac

SEQ ID NO: 122100 - DNA, 601 bp, Human
cggggcagggcatatacttttcaatgaccagatctcccaagaagtcactcactatcttgaccacagtaccaagaggatactactaaaccagttatgagaaatctgctcccaagatccaatcacctctcaccaggccccacctccaatactgggactacagttcaacttgagatttgggtggggacagcatccaaactatatcactatctttaacactctcccttgccattccagatatcttcctaaaatacttccgcttcctacaatgaaatccctgctcaccatgccaggacctaagacrctgcaaaatctggccacactctacctgtgtcctagccacacatcttagccttctctatcattctttctctttcctgaaaagcaattcctgagtacccaaccagaaagaacctttgtccctcacacctggctgcattgatttctagatttgctgattgccaataacatattgaaatacaaactgctctctaattgtcttcttttttaaatggatggcttattttaattaatgagtaacttgtggatttggtgggcaaaaaccatggaatgttcccagtcaagggaagggtgacacagggag

SEQ ID NO: 122101 - DNA, 601 bp, Human
ctgcaagtgacgtgaaaccaacaagtgttcatccattctccctaacaaataggctatttggtataagagacaaaaattgtgaagtgaaattacctttctgttacaagtttctaaggacaattaattttaggtggttggcaaatacaatgtgaaaagaagtggattgttaagtagctatgtgagttcagcttttttccccctcctaatgaggcacttaaaatcttaccttttaagtatattgcttgattattgtgaattatgtttgcagtgtgacaaatatttttaaaaaacaaaggatttycatggagggaaatcaaatcaggaataaatgtatgggtgtgaaatcctttcattgctacaataataggataatttatgtaatacctcaagcatccaaatcttttaatagcttttttgaaatataaaacactgaaaaaaatcagttatgcctgttcccgcccttactgagtgtttatttgaaaaacttcttgttccgttaatgttctcttgaaaaataaaagcagccttgtctggaatgaaaagaattgaattcttatggttttcttctcagaaatttctacagtagttgtgggggaaatgt

SEQ ID NO: 122102 - DNA, 601 bp, Human
atgctcatgaaggtgctcccaacagggttcccttcctgaacaccatgttgttttccccagtcagagcactgcctgttacttgctcggcaatcatattcctgcaggttgcagcaaaggctagtcatgttaatccctccagaggtgttttctgccttatgcagggttttctgaatgtaatccttttgctcaaaggaagtactcctcaggaggaaatgctacactttgtaggattagagggggtgtgttttagcatggaaatgggagtggggtggtgtgtgtgtgtgtgtgtgtgtgtgtgtgtatgtgcatgtgtatgtgtgtatgtgtgtctgtagagatttctccttgcatccctgaatcccaactcttgacagacacctgatccatttacgtgaacagttttacggagaccatttgccccattctgattatggcacttaagaatttaagtaggatttttttgtttctgactttgctttcaagttttaagaaacaagctaatagactggaggcttactgtgatagatttagccatgtctctttctcttaattgcttcatgtttaaacttgaggtgcttttcaatttgctcttgtttctcac

SEQ ID NO: 122103 - DNA, 601 bp, Human
gtactgactgagtcccatctgttaagaataacagtgggattaatagccataggctcttctctgtgtgagagagacaggacaacacagctccctgttctgtagcttttgtctctgactggcattccctttctccttccctacagagcactttggacagagttctgcaagggcctcctcagttaggcccaaccaatcccaagaccatgtgcaggggacagtccactgtcattttgctaagaaatcgctcttcctatggtagtttctaaacctcacaaatatgcagtaaagatgtctttcctcsaatgatgtttgattagtcccttttcttttcctctgcagtagttctttaactttgatagaattcctctagaattgtaccacctcttagataaaatagacatcttgaatatggaatctgagcttcctaatgtttccctaacatcctttatgggagaagcacatatagccttgcagatctgtggaatagaatatatgtaatgcctagcgttgaatttcaagagccctaaatggagtagaatttgtttacaactttttatgcacttgacaacttatagaatataggggcagttatcttgaaagt

SEQ ID NO: 122104 - DNA, 601 bp, Human
tggggctctttattcttacatttataaattatgaaatcaatgagtctaatattttgctgataatgggtatataatacattaagtcttgcttgctttaaacagttatttttcttgatagcaattaagatgggaaaaagaatgtcctttgtcatggtctacattttcatactacaaactatacttatagtttggcttagtgatgatagcaatacaattattaaagcaatatgaatgtaagccctccagaaattttaaaacaattgtaaaaatcaaaagatgaataaaaactgaaatgaaaaartacaataaatgaggacattgagcattttttcaagatatatatgagtgaatttatatgcaaggacaaagaagaaaagtcttgcgttgttatatctggaaagatattctgtgttactttgacttttatgccatccaaagccttgaatgtcttcctcttgtttttttttgtttgtttgtttgtttgttttttttatactttaagatctgggatacatgtgcagaacatgcaggtttgttgtttttaagatccaccccaaagcaagtcattcaagagctgccacaagcagactccagcctttct

SEQ ID NO: 122105 - DNA, 601 bp, Human
atgtaggattgtcaaccaggatctggggaaatgtcaatggcagtgacaaaatgactgttgtatacattcaaagctttcccaaatagtctttaaaataataaaagaatgaaataaagtcaaactgctgttgggaatatttatataacactactcattttcttcaatgaatatcccttctataatatagacagaccatagatacggactagtataaatatttgacatcactttaatttgccaaaatgactatttccctgtacagtgttagatttgtgctttcaggctcttgtggccagagagyccccaaaagtagagcctgagaaaaagacttgtgatcaggtagtttatgtgggaggtgaggttggaagtgaaaaggcaaagaagggaccacccaggcctgctgtgggtggctgaggcttgatgccaccagtacctttttgtcagcatgtttaataggatgcttatcagaattgtccacctgagggaggaatagaagaagcatgtatttatctcagtctcccttgagcatgtgtggggactgagtgggcgctcacaccaaatatgggctgcatacagaaggagaggccctgttgatggagtg

SEQ ID NO: 122106 - DNA, 601 bp, Human
tggagacggggttttgccatgttggtcaggctggtcttgaactcctgacctcaggtgatccacctgcctcagcctcccaaagtgctgggattacaggtgtgagccaccacgcctggcgagatttgacttttctaccagctcgaaagtctaagtcatcatgttcctagtcttacgccagtgaagactgaaaagacataatctgtcttctggcctctcaagaggacctacagcccatcccaggtcacagcccacccgggtcacagcccaccccaggtcacagcccacccgggtcacagcccaycccaggtcacagcccacccgggtcacagcccatcccaggtcacagcccaccccaggtcgcagcccacccgggtcacagcccaccccgggtcacagcccactccgggtcacagcccaccctgggtcacagcctctactcgcagcctgtgatactgaccccctccattctggtaacatatgtaggggaagcgccagacattgcccaggtccacagcatagccaatcactgagagaaggaaatccaccttcttgccccaggtctcccgttccccttgatgaagctcagccactagggtggtgg

SEQ ID NO: 122107 - DNA, 601 bp, Human
atgcccaggctaaaggtgagtcctctggagcaggagataaggtgattatgacttttgctcctcctaggcaggaagcgctgagcttcccaggggccccctggaactacctttgcaactacatggacagaaatctttaaaagagagtaaatccaggccactctgtgttaggtcacggaagaagtgagggtgacacaaatggatgatccccaaacctctttgtagctgccctcccaaatctgttgtcagagttcccatgaaaatcaagcttgacgcatctgacacccacttcttgttattttcytgtgctgataacaagtccagaggccccaaacccattcacttttccccactgctctgctctcccccaggttcccatcttcatgcctacagtcagctactattttttataatctacaagttaactacttgagaggctttaggggtacaaggaacaagatagggcctctggcctcaaaaatctaacatcccaggaggagataggagggccagccatgcgtggtttgaggttggtattaatgtcatgctgtggatctaatccagcttaaattctgcccagactggtaattaagatttaggactt

SEQ ID NO: 122108 - DNA, 601 bp, Human
tgctccctgacaagcgccgtttgcaggagtggctggacagggtagtttttcacagaacaagcaagcacagagctgctacctaactggagatgctggtgtctcctggatcttgtggctgaggctgaatttaaaaataccaagttggggaatgctaacctgcagcctgagtttttagcctaaagggtggatcagctgtgattttccctaattttccctgctgtaaaatgctctgaacccagaaacctgaggtctgtgcaaatcagaaaggtccatgtaatttacagtcacactgggtaaaccyggctcgagaataaaaccatgtgttctcgtgatggccttcctccaaagagtttgcttgatcagctttacgctggggaatgagtgtcggggaaatgtcaccagtgacccagccccttacataatgcccaggctaaaggtgagtcctctggagcaggagataaggtgattatgacttttgctcctcctaggcaggaagcgctgagcttcccaggggccccctggaactacctttgcaactacatggacagaaatctttaaaagagagtaaatccaggccactctgtgttaggtcacggaagaa

SEQ ID NO: 122109 - DNA, 601 bp, Human
aagaagatctgagcggctgcatctatccacacctggaacacagcaggggtaagggcatggggtgagggggagacacaggcttaccctggcaccaacagggtcgccactcctgcctccatgtggctaagtgcagaggcagaaaaacagcttttaaggctcattccaggcatagccataaaccaagtgccaacaaatgtgatttctcttcctatgattcaggcataaacccatccagtggcctcaactgtactttaatgcttgtatttcttggttaaagtatcattgcagacttgcacactgaagccacatttcagttgtccctactgtcctatttggaggaggaccagcttcgtttagtaaaatgacagacaggtacacatatttccctcatcatcttacccctgtctccaggagtttctgccaattgggtttcaagtagaagagaacacccctccaggctccagggagggtggcacccctcaccagcaggacagaaaggatgatataagggaaggtggctgtcacccacaccacctgtaaggaagaagggttatcaccatgctgttccagggaggggaggggaggggaggggagaaggaga

SEQ ID NO: 122110 - DNA, 601 bp, Human
tctctctttctttctttctggaatcttgctctgtcactcaggctggagtgtagtggcaagatctcagctcactgcaacttctcgtgcctcagcctcccaagtggctgtgcttacaggtgtgcaccaccatgcctggctaatctttgtatttttagtacagacagggtttcgccatgttggccaggttagcctggaactcctgacctcaggtgatccacctgccttggcctcccaaagtgctgggattacaggcgtgagccaccatgtccagcctcttattatttttatatacaggagcgcwgacaaaaccgaagggcatggggcccctctcagcctgagtggcccaggtgaagccacggcctggatgagtgctctggccatgggtgagctggtcaggggcctgcagcacccctgaggggcagtggtatcaaggcctaagcctggccagattcgaggccgtcggtccaatcaccttcctccacactagctgactttcactcacgccactttcaagctttgcttggggaccccagatactcactggtagcagttgttgttgaacttgttgtagctagcaaaagccagcaggaccccaaagccc

SEQ ID NO: 122111 - DNA, 601 bp, Human
aaagtgttgagattacaggtgggagccaccgcaccccgtctctctctttctttctttctttctttccttccttctttcttctttctttctttttctttccttccttcctttctttctttctttctttcttttttctttctttctttctttctttatttctctctctctctttctctctctctctttctttctttctggaatcttgctctgtcactcaggctggagtgtagtggcaagatctcagctcactgcaacttctcgtgcctcagcctcccaagtggctgtgcttacaggtgtgcamcaccatgcctggctaatctttgtatttttagtacagacagggtttcgccatgttggccaggttagcctggaactcctgacctcaggtgatccacctgccttggcctcccaaagtgctgggattacaggcgtgagccaccatgtccagcctcttattatttttatatacaggagcgcagacaaaaccgaagggcatggggcccctctcagcctgagtggcccaggtgaagccacggcctggatgagtgctctggccatgggtgagctggtcaggggcctgcagcacccctgaggggcagtg

SEQ ID NO: 122112 - DNA, 544 bp, Human
aactccgtctcaaaaaaaaaaaaaaaaaaagaaaagaaaagaaaaattatggtattttgtgttagtcaaaataatgtgatcatcatactttttgtttatacataatacaaataatcacattacaatttttattgttaaacacattgactagttaaacctaactacttaattgtatgttgcagctttttgtaaacttgctttgcaatttctctttctttctttcttttttttttttttttttgayggaatctcactctgtcgcccaggctggagtgcagtggcacaatctcggctcaccgcaaactccacctcctgggttcacgccattctcctgtctcagcctcctgagtagctgggactacaggcgcccgccaccacgcccggctaatttgtttgtatttttagtagagatggggtttcaccgtgttagccaggatggtatcgatctcctgacctcgtgatccacccgcctcggcctcccaaagtgttgagattacaggtgggagccaccgcaccccgtctctctctttctttctttctttct

SEQ ID NO: 122113 - DNA, 601 bp, Human
tgggattacaggcgcccacgaccacgcctggctaatttttgtatttttagtagagatggggtttccccatgttggccaggctggtctcaaactcctgatctcacacttttaaatgacagcctcatcatacaactgcagggtggtgtcccagtgcaaggccacattgcttagggtacatgtgaatctccctcccacctttaaaaaaatcagttttacaattatcttatgcatagcacaaagagattgatggatgctgccatctgtgatcaattaaaattaagtctaaagatgatgggtgacttttatttatttatttatttatttttgagatagggtctccctctgttgcacaggctgaagtgcagtggcatgaacacagctcactgcagccttaacctcccgggctcaagcaatcctcctgcttcagcctcctgaagagctgggaccataggcatgcaccaccacactcagctaatttttaaattttttgtagagatgggatctcaccatgttgcccaggctggactcaaactcttaggctcaagtgatcctcctgcctcagcctcccaaagggctaagattacaggtttgagcaactgca

SEQ ID NO: 122114 - DNA, 601 bp, Human
gcatacgtgatgaagaggaggctgggacctgagacagaggggagagaggaggaggtggttgacaagacctgtcctacaaagatgtcacagaggaaaactcagccacaacaacagttacaattctcatcacaagaccttatgtgtgaatcaggttttgacacacaccaagtgcgtcctcacactctactccgtctgacgtggccaccccagttcctgggaggcaggaagggtggggcttccatcttgaaaactgtgtgccctccattaaccctgggggtgggtaacagatccaagacccagrgactggcaaagctgcacatgagaataagagtttccaccatataacaattccatgggatttctcaggaccaggattgatatttctaaagtccatgacagttagccccctctgatgtcttcagcttcagaacagtaggaaatgttaaattgatttccgtagagtcacagaggctttggaataaagacctctttctattttaaagtcccttttgaaagtgtgagggacatgtcttcagcctctcatgggttagctaggggtgccctcgtttggggtatggggttggtcaaagcaccgaatcag

SEQ ID NO: 122115 - DNA, 601 bp, Human
ctgggatggccagggatgggagggaattgagtccagctgagtcctcctcctttcctcttcatcctcccacagcccatttccccttcccatttcctcaccgtgctgtccaagcccagcgtgattaacatcagaaagaagatgatggcaaagaaagtggacgctggcatgttggctatcgcttctgcatacgtgatgaagaggaggctgggacctgagacagaggggagagaggaggaggtggttgacaagacctgtcctacaaagatgtcacagaggaaaactcagccacaacaacagttayaattctcatcacaagaccttatgtgtgaatcaggttttgacacacaccaagtgcgtcctcacactctactccgtctgacgtggccaccccagttcctgggaggcaggaagggtggggcttccatcttgaaaactgtgtgccctccattaaccctgggggtgggtaacagatccaagacccagagactggcaaagctgcacatgagaataagagtttccaccatataacaattccatgggatttctcaggaccaggattgatatttctaaagtccatgacagttagccccctctgatgtct

SEQ ID NO: 122116 - DNA, 601 bp, Human
tgtaaacacagaagtactagtaccccatccagggcccccatgaagagcatagcagatccttccctggtcttgaacagttctttttgttatgtgactttggacccttcactttacattgctaagcctcaatctccttttttcttttcttttcttttttttttttttttttttttttgagacagagtcttgctctatcgcccaggctggagtgcaatggcgcgatctcagctcactgcaacctccgcctcccaggttcaagcaattctcctgcctcagcctcctgagtagcacctagtaccaygcccagctaatttttatatttttagtagagacggggtttcaccatgttggccaggctggtcttgaactcctgacctcaggtgatccaaccacctcagcctcccaaagtgctgggataacaggcatgagccactgcacccagcctcaatctccttaaatgtaaaatgggagtgccagaactataaccacttcatagaactattgtgaggatttatagaaaagtgagtgtaagttgagcctgaagtctggcctggcatttagcgctccataaatgttatgcatcactatcactgccagagtg

SEQ ID NO: 122117 - DNA, 601 bp, Human
gttcacgtcctgctaatttttgtatttttagtaaagacagggtttcgccatgttgcccaggctggtcttgaactcctgacctcaagggatccacctgcctcggcctcccaaaatgctgggattacaggtgtgaaccactgcacccagctgttttgaaaggggacacagaacagctggatgccaaagagatgtcctaaaacaaaatgggatagcccatatactcctaataggctggaggtggactgaaggaagaatctaacaacatttctggctctaaaagacaaaaaaaaaaaaaaaaacmcaaaaaaaacaaagttacagataaatgaaagaactgaagaatagtgcctgctggtgtgcatgacatcagtttaccccaggctacttcagcacacacttggcaggccagcaggctgttatccatcttggacaggggcacgtgaaccaaggacaaagtgaatattgaacacatctcaacacgtggacaacccttgggactcaactttctcacccaggtcctttggtaataaatggattctacttttgacgtggatttttgcttagagagctttgtatcatcttgaagaagatgcatacaaaa

SEQ ID NO: 122118 - DNA, 601 bp, Human
aaatcaaaataaataatattttattacaattttttaaaagacaggatctaacagggccagatgagggtaaagcgagtgaagtacgatgtacaagtacagggctggctcctgtgtttattgaaaatgttgatactttgttaatcatggatctttttgaattaatttttatttttaaaaaatattgtgtgaaaataatatttatcctgagtcctgagctctttggtgccttcttaaattttatacccacagtgaatgtttcacttgccttcaagtctcccctagacatcatttcctcactgcrtggggaataaatatggaagtaaacaaacaaacaaacaaacatctttctgccctcaaggaattaatccaatgactcttcttcctttgaaaaacaaataaaaatatttaagtagattattgagaagtactggtaataatataaattaataacccatttatgtcagggcttctgcttctggtaggatgggctaggcgatttccaacaaccctctcactgaaaacaactaaaacttctggatttaaaaacacacgcattttaaatgtgcctaaatgcatcagcaagctgataaggtcataagga

SEQ ID NO: 122119 - DNA, 601 bp, Human
ctggtttggctgtaggaaattagtaactacggagctcagagttctgttcacccagaatacagttttcctgtttcaaaaaagaaatgaacgcagttgttctcagaaagggctgatatttggccgggtgcagtggctcatgccggcaatcccagcactttgggaagctgaggcaggaggattgagctcaggagtttgagaccagcctgggcaacatagtgagatcttgtttctattaaaaatttaaaaatttagccaggcgcttgtagtcccagctagtcaggaggctgaggtgaaaggatcrcctgagcccaggagtttgaggctgcagtgagccatgattataccactgcactccagcctggggtacagagtgagaccttgtctgaaaaaaaagaaagagctgatgtttaactgcctatgttctcttgcttctcatttcttatgaaatgtcttaggatgactattgtgatggactcatgtctaaattttgcgtaagatctcaaattagcccacctccgttctcaggctattatagattatgctgagtagctgggactacaggcacgtgccaccatgcgcagctaatttttgtaattttagt

SEQ ID NO: 122120 - DNA, 601 bp, Human
agatgataacaagttaatctaagaaatggattcctcttcatatcttcataaacgtgtactcattagggaccattttccagtatctttgggtggattattagtagtttctgcaaaaatgacctaagccagtggatgactccaaccgcaagacttccagaccgtgggtgtgtatggtacccttcaaattacaccagtaagcggtggctcactccacaaactccaaccttgcatatggccagggcccaaaaggattttatatgaggcttccctccctcacacatagaaagttacagactagcamgtctggtattcataaagaattgtgaagaattctagacctttggcaaaaaacacagcatgctttattcttctcagagattaaacatgcacatgggcatattaaagtttttttgagaagtcctcaggtaaacaaacctgtttatttacttatttaatttttttgagacagagtctcgctctgttgcccagggtggagtgcagtggctcgatgatctcagctcactgcaatctctgcctcccaggctcaagcaatttccatgcctcggcctcctgagaagctggaactacaggtgcccgccac

SEQ ID NO: 122121 - DNA, 601 bp, Human
acagagaagtggctgagaaggtctactatagaaacagctgaggtacacagaagctttaagatggatctgaaatatacttgggcttaggtgtgaaatatacaactggccttgtaaaactcagcatcagagtggcaaaaagcagctcagggatatagaggagaaaaaaaaaaaaacagccacactgcagaggctttgaaaaatctttattaagttgcttaataaaatctttgttggccaaaagtctgtatgtatcataagcagacaatttggatctgaaagcatcctttgatttactgatctytaggtgaagttctgcccctgtcatttttattttggactgaaaatgtctggagttgccttcaagcttttctattttctcattctgggagtttgttctttaagaaatagggcctctataattcaaaaagttccagtcctacagttaatgaaatgcactatagggcaaaatgcacaaaattgcacattttgtgctcctcatgaccttagtatctgtgtactgaactttcacactagaaatccgtttaaaaaggagtcattgcagggagtttaaaaaggagtcatccgtttaaaaaggagtcat

SEQ ID NO: 122122 - DNA, 601 bp, Human
cccagcatgactattctgggatccccaacctcccaggtctggcccagcgaacgtgcactcaggggcctccctagcgagttccacatggtctcatgggcccagcgttaacggcggaggatgtccaggttcttggtgtctggaacaaaaaattggacaaaacgcacaaagaaaggaaggaaggaagggatttattgaaaatgaaagtcaactccacggtgtgggaggagaacgggcctgagaataggggctcaaaggccccattacagagtttttgtgtttaaataccctctacttgaggtaygccctatataaacgaaaaggatgaagtaaagttacaaagtcatttacggcatacgtcctatggagaggacatttcctgttatggctcaagtgcgaattggccttatgttccctgcctctggaccctattttcctgactcactgggccatatgggctccccatctcccaccaacccctccccacaggcttcttccccgacttggacttccctgtcccacagggcgacacagtagtgaagttgaggaaatgatgagtgctaggtaggaacccctcctggggttcacctgaggctggtgaccg

SEQ ID NO: 122123 - DNA, 601 bp, Human
tatccttacccaaagtctcctgatactaaatgatagcaactaactccattaaatacacacacacacacacacacaaccatgctctagcctgggtaacacaggaagatacctcatctcttaaaaaaaaaaaaaaaaaaaaaaaggaaaaaattcacccagtgtggtggcatgtgcctgtggtcccagctactcaggaggctgagttagcaggatcacttgagcccagggaggttgaggttgcagtgagccatgatcacaccactgcactccagcctgggcgacagagcaagaacctgtctcmaaaaaaaatttaaaaatggcatgcttgctgacccacccaaatatgtccacgggcccagccacaggcctgcccttgccattgtctgacagatcaggaagtgaccttggggctattagatcctgatacggcttttcttccaaagagccagcaacctccatcttcccacctccctcacaccaagccctggcattggccctggtctttcctttcagggccacttttcacaaagaaacaaagttccaggtggttcacaagagctaatttcaaagcagaggagccaccagtgacagctgcgaggct

SEQ ID NO: 122124 - DNA, 601 bp, Human
gtctattggagcatctcagtctgctggagtatgtcagtctattggagcatctcagtctgctggagtatgtcagtctattggagcatctcagtctgctggagtatgtcagtctattggagcatctcagtctgctggagtaggtctattggagcatctcagtctgctggagtatgtcagtctgttggagcatctcagtctgctggagtatgtcagtctgttggagcatctcagtctgctggagtatgtcagtctgttggagcatctcagtctgctggagtatgtcagtctgttggagcatctatctgctggagtatgtcagtctgttggagcatctcagtctgctggagtatgtcagtctgttggagcatctgtctgctggagtgtcttggctgctgtcgaggaaagctgggcacagccaccagggcattcctgagcccacttacccatcagaggggctgcatctcccagaagcgtgcctgcccgagtgccatgctcgtctcagtcactagctaggagcagcctgggagtggcattgcctcaacacaaacgtggtggtggattttggagcatggcagctgctgccagagatccaagaggtgtg

SEQ ID NO: 122125 - DNA, 601 bp, Human
cctgaggtgaaaatcccttaggaaggggccgggcctcctgtgcccggagaagccagcacggcacagatgaggcccctttgtctccagcaccgggacagaccggaacgcggatcactggcctgcgagcaggggccaagttcccaaaaaatgctcttcttaagtacgtgggtctcccaggatcccaagagatgcccactccctgagtggccctgaggctgaaggagggacggggtttcacgtctccacccacacgcccgccgggcgcccactcgccgcggggcgctgggcagggcctacactygaagctgctcccccaggaggctgctgtcccccaggaccgcggagccgggcgggcctccgttactggggccctttagtggggctcctgcggggcgtccagcactcgcctttaggtctgaggggagaacagagagagaaggctggaggggaggccgggatccaggagtgccggctgcacccatgcctcggaacttccactccatttgtcagggaaccaaggccagtgtgaggtgtctgtgccgggacaggagagaggggccgggcgggtgaagtatggcctggccaggagagggtgggggcc

SEQ ID NO: 122126 - DNA, 601 bp, Human
tacagaggaaggcggcctgaggtgaaaatcccttaggaaggggccgggcctcctgtgcccggagaagccagcacggcacagatgaggcccctttgtctccagcaccgggacagaccggaacgcggatcactggcctgcgagcaggggccaagttcccaaaaaatgctcttcttaagtacgtgggtctcccaggatcccaagagatgcccactccctgagtggccctgaggctgaaggagggacggggtttcacgtctccacccacacgcccgccgggcgcccactcgccgcggggcgctgrgcagggcctacactcgaagctgctcccccaggaggctgctgtcccccaggaccgcggagccgggcgggcctccgttactggggccctttagtggggctcctgcggggcgtccagcactcgcctttaggtctgaggggagaacagagagagaaggctggaggggaggccgggatccaggagtgccggctgcacccatgcctcggaacttccactccatttgtcagggaaccaaggccagtgtgaggtgtctgtgccgggacaggagagaggggccgggcgggtgaagtatggcctggccag

SEQ ID NO: 122127 - DNA, 601 bp, Human
gcgtccaggttacagaggaaggcggcctgaggtgaaaatcccttaggaaggggccgggcctcctgtgcccggagaagccagcacggcacagatgaggcccctttgtctccagcaccgggacagaccggaacgcggatcactggcctgcgagcaggggccaagttcccaaaaaatgctcttcttaagtacgtgggtctcccaggatcccaagagatgcccactccctgagtggccctgaggctgaaggagggacggggtttcacgtctccacccacacgcccgccgggcgcccactcgccgyggggcgctgggcagggcctacactcgaagctgctcccccaggaggctgctgtcccccaggaccgcggagccgggcgggcctccgttactggggccctttagtggggctcctgcggggcgtccagcactcgcctttaggtctgaggggagaacagagagagaaggctggaggggaggccgggatccaggagtgccggctgcacccatgcctcggaacttccactccatttgtcagggaaccaaggccagtgtgaggtgtctgtgccgggacaggagagaggggccgggcgggtgaagtatg

SEQ ID NO: 122128 - DNA, 601 bp, Human
aggccgagacccctgcgggcaggtagcgggagcaagcaggcctcaggcagaggggtgaggcctggaagaatggggtagaggttggtgagggtggtggtggcaggggactgaggagggcacccgatagaggggcggctccaggggatgcacatggcgtccaggttacagaggaaggcggcctgaggtgaaaatcccttaggaaggggccgggcctcctgtgcccggagaagccagcacggcacagatgaggcccctttgtctccagcaccgggacagaccggaacgcggatcactggcctgmgagcaggggccaagttcccaaaaaatgctcttcttaagtacgtgggtctcccaggatcccaagagatgcccactccctgagtggccctgaggctgaaggagggacggggtttcacgtctccacccacacgcccgccgggcgcccactcgccgcggggcgctgggcagggcctacactcgaagctgctcccccaggaggctgctgtcccccaggaccgcggagccgggcgggcctccgttactggggccctttagtggggctcctgcggggcgtccagcactcgcctttaggtctgagggg

SEQ ID NO: 122129 - DNA, 601 bp, Human
aagtggaatcacaattaaaatccctttctgctgactaaaggaaagttctttaggtgttaagggttccacattcaaactaagccttttttttttttttaagtttctttaaaatgtggtccatccttgtgattctgcaaaaaaattatgtttcctcccctttgaatttgccttgcagaaagaatctcagatattccctcccacaaccgggggcgcggagctcatgtgccaggacttggaggtccctctcctcggcagagtgcccctggatccgctcataggtgggtgaccccagtgtggggcrgcacctcactcctcggtcagccccacaggcacgggtcgggcacaacagggggcggctacagagaggggcaatggaaggaggagggtcaatggggcgctggagccagacccaccctccagctggcaccccaagaggccaccgggagagaggccgagacccctgcgggcaggtagcgggagcaagcaggcctcaggcagaggggtgaggcctggaagaatggggtagaggttggtgagggtggtggtggcaggggactgaggagggcacccgatagaggggcggctccaggggatgcacatg

SEQ ID NO: 122130 - DNA, 499 bp, Human
tgtaagtgaaagaagtcagacacaaaaagccacatagtacgtgattccttttagaggctgtacccagaataggcaaatctgtagagccggaaagcggattagccgttagcaggggataggagaggggaggaagcgggagtggttacagtcatcccttgctgtccctgagggatgggttccaagtcccctaaggatgccaaaggccacagttgctcaagtccctgatgtatgcatagtattttcttataacctatgcacatcctcccacacactttaaatcacgtcgaggttacttaccatrcctaatacagtgtaagtgctatgtaaatagttgttacacagtatttttttaactttttcatcacctcataaaaacaccctgttccagctgggcgtggtggctcatgcctgtaatacccggcacttgggaggctgaggtgggcggatcacttgagatcaggagttcaagaccagcctggccaacatggccaggtacagt

SEQ ID NO: 122131 - DNA, 601 bp, Human
ctcgaacccgggaggtggaggttgtggtgagcggagatcatgccattacactccagcctgggcgacaagagcgaaactctgtctcaaaaaaaaaaaaaaaaaaaaaaaagacgacacaaggcagttccaggggcagagatttggaatattttgaataaagggggaaaaggtaagaagatactacacaatgagggctttagaagaatagtaagaatttttgaggctgcgtgcaatggctcacacctgtaatcccagcactttgggaggtcgaggtggtggattattcgagcttgggcaacayagcaagacctcatctctactaaaggttttttaaaaaattagccgggtatggtagcacatacctgtagtcccagctactgaggaggctgaggtgggaggatcacctaagcctgtgagttcgaggctgcagtgagccaagatcatgccactgaactccagcctgggcaacagaacgagagcctgtctcaaaaaaaaaaaaaaaaaaaaaaaaaaaaagtaagaatttttggaattcaaatgtgaatttttaatctttttaattttacgaatcatagagaaaagaatctgaatgaagatctgg

SEQ ID NO: 122132 - DNA, 601 bp, Human
cccagaaacttgtcctcgcccactccacctgcaagtcctctaggggctgagcactacacaggaacacgtgcagattccagcacccagaggtccttcacacctagccacagggcctctggcagcctcggccatcctctctgcgtgcctgcctgaggcggctgcgctgagcagtgggggacccaggaaaggtcacggctcccccagcacatctgacacacctcccgccgggccagctgctggcttcagcaagcagacgtccccttcctatggaaaagcccatgaaagctgatttgaaatatcygagcagctgtttgaaggacgtggatcagccctgttcagcggcctgagcggagagcggggccagaggtacaagcctgggacggcccgcaggctctgggagacacaagtcttctcagacttaggcctcatgggaccccaggggcctggtcagctgggttccccaagggctcacccacagagagcctccgttctcagtgtcgctgtggatgaccaacactaaaacccccaagcccagaccgcacctcgttcccgctcacctcggaatccctggagaaatcagacatcagccctttaaaagttc

SEQ ID NO: 122133 - DNA, 601 bp, Human
gagccccgagacctcgaatgcaacgtcttcagatcccaattccctccctgcatggagcagaacagtgtctctcaaaaactcacgcccacgagaagtctcagaatgtggcttttagtagaaatagggtctctgcagatgtctttcattaagctgaggccatattgagtgagggtggatcccaatccagtaactggggtctgtataaggagagagaacagaggcacatgaacggaaggtcaagcgacaacgggtgcagggatggcagccaggcagccacaagccaaaggacgcccaggatggycagcagccctggaagccgggaaagacaagggaggctcttcccctacagcctgcagagggagcaggtcattatctgttaatatcttgatgttgcagtttggcctccagaactgtgagaaatgtgatgttgtttgatgccacccagtttgtgttcctctattacagcagccccggagactagtaagtgggtccctggcagaggaaggggacggagcgtcgaattctcctccccgcagggagccacctgggctccgagaaacccttgcaccggccagaggccatgacactaatgctggaatgt

SEQ ID NO: 122134 - DNA, 601 bp, Human
gagagagctcggagctggggagcctcggtgatgctctgaggtgactcccacccaacagagtcctttgcctgtttcccaaagtgcagttaacgagagggcagcaaggaaagcaagtcagagtccacgttggtctgaatatcgctgatgcaggtagagacaaaccccagggaaaaaagacttaaaagtgaaaaatggagctggacaccgtggctcctacccgcagtctcagcactttgggaggctgaggtgggaggatcgtttgagcccaggagtttgagaccagcgtgagcaacatagtgakaattcatctctactaaaaaacaaaacaaaacagccagacatgggggtgtctgcttgtagtcccagctacttgggagacggaagtggcaggatggcttgatcctgggaggttgagtctacagtgagatgagattggtccattgcactccagcctgggtgacagcaagaccctgtctggaaaaaaaaaaaagtgaaaaaaaagtcccagaccctttaaaagcttgaaggatccttctgtgtgtgggactaactgagatgcaataagagaaatggaaaaccacccgagtcactgtcgcaagat

SEQ ID NO: 122135 - DNA, 601 bp, Human
gtgaccttcaccacacggggctcaggctcctcaaccaccaaatgaggaaggagaactaagctgtcccaaaaccattcttttttccatttctaaatcctttgggtgttctaaatagacactaggatctctcaagtgattctgtaacacaggaaacattacctcagcaggcctggtttaaaacccaaccctcccctctctctcattcaccagctgtgaaagtgtaagtaatgcattattcttctttgtcctcggcctccccttctgtaaaatgggtataaaagaacccggctgggcgcggtgrctcacacctgtaatcccaacactttgagaggctgaggcaggtggatcacctgaggtcaggagttcgagaccagtctggccaacatggtgaaaccctgtctctactaaaaatacaaaaattagccaggcatgttggtgggcacctgtaatcccagctacttaggaggctgaggcaggagaatcgcttaaacctaggaggcagaggctgcagcgagccgagatcatgccattgcaaaatgccaggctgatgatttccatgtacctttgatagtccagaaaccaggaattttgtgatgttctg

SEQ ID NO: 122136 - DNA, 601 bp, Human
ccaaaaccattcttttttccatttctaaatcctttgggtgttctaaatagacactaggatctctcaagtgattctgtaacacaggaaacattacctcagcaggcctggtttaaaacccaaccctcccctctctctcattcaccagctgtgaaagtgtaagtaatgcattattcttctttgtcctcggcctccccttctgtaaaatgggtataaaagaacccggctgggcgcggtgactcacacctgtaatcccaacactttgagaggctgaggcaggtggatcacctgaggtcaggagttygagaccagtctggccaacatggtgaaaccctgtctctactaaaaatacaaaaattagccaggcatgttggtgggcacctgtaatcccagctacttaggaggctgaggcaggagaatcgcttaaacctaggaggcagaggctgcagcgagccgagatcatgccattgcaaaatgccaggctgatgatttccatgtacctttgatagtccagaaaccaggaattttgtgatgttctgtgttcaattggagagtttcagcataaaatctgtaacagtgtcgagacttctcactgtggcctaag

SEQ ID NO: 122137 - DNA, 601 bp, Human
agagcagttaaagatggtggagccaggccaggcacggtggctcacacctgtaatctcagcactttaagaggctgaagcagggggatcacttgaggccaggagttcaagaccagccggggcgacatagtgagactccatctcttctaaaatcatatatatgttatatattatatgtaatatgtgttatatgtatgttatatatgcaatatatgttgtatattgtatgtgatatgcattatatattatatgtaatatatgtaatatatgtgtgatatgttatatattatgtgtaatatatgcaatgttatatgtaatatgtgcattatgtataatatatgtaatatatgtatgttttatatataatatatatgtaatatgttatatacgtaatatattacatataatatataacatatatatgattttagaagagatggagtcttgctatgttgcccaggctggtcttgaatatgttatatattatatatgatatatatgttacatattatatatgatatatatgttatatattatatatattatgtgatatgtgttatatatgtgatatgtgttacatatgttatatacgtgatatatatgt

SEQ ID NO: 122138 - DNA, 601 bp, Human
tcacttgaggccaggagttcaagaccagccggggcgacatagtgagactccatctcttctaaaatcatatatatgttatatattatatgtaatatgtgttatatgtatgttatatatgcaatatatgttgtatattgtatgtgatatgcattatatattatatgtaatatatgtaatatatgtgtgatatgttatatattatgtgtaatatatgctatgttatatgtaatatgtgcattatgtataatatatgtaatatatgtatgttttatatataatatatatgtaatatgttatataygtaatatattacatataatatataacatatatatgattttagaagagatggagtcttgctatgttgcccaggctggtcttgaatatgttatatattatatatgatatatatgttacatattatatatgatatatatgttatatattatatatattatgtgatatgtgttatatatgtgatatgtgttacatatgttatatacgtgatatatatgttatatattatatatgatatatatgttatatatatccagacatggtggctggcacatgtctgtggtcccggctacttgggaggctg

SEQ ID NO: 122139 - DNA, 601 bp, Human
atgtaatatgtgttatatgtatgttatatatgcaatatatgttgtatattgtatgtgatatgcattatatattatatgtaatatatgtaatatatgtgtgatatgttatatattatgtgtaatatatgctatgttatatgtaatatgtgcattatgtataatatatgtaatatatgtatgttttatatataatatatatgtaatatgttatatacgtaatatattacatataatatataacatatatatgattttagaagagatggagtcttgctatgttgcccaggctggtcttgaatatgttatatattatatatgatatatatgttacatattatatatgatatatatgttatatattatatatattatgtgatatgtgttatatatgtgatatgtgttacatatgttatatacgtgatatatatgttatatattatatatgatatatatgttatatatatccagacatggtggctggcacatgtctgtggtcccggctacttgggaggctgaaacaggaggatcgctttagccaagaggttgaggctgcaggagccgtgatcatgcaccactacacttcagcctgggtgacagagaa

SEQ ID NO: 122140 - DNA, 601 bp, Human
aaaaagaaaggctgtcggggccgggcacggtggctcacgcctgtaatcccagcactttgggaggctgaggtgggcggatcacctgatgtcaggagttcgagaccaacctgaccaacatggtgaaaccctgtctctactaaaaatacaaaaattagctgggcatggtggcacacgactgaatcccagctacttgggaggctgagacaggagaatcgcttgaaccctggaggtggaggttgcagtgagccaagatcacaccactacactccagcctgggcaacagagtgagactctgtctccaaaaaaaaaaaaagaaaagaaaagaaaagaaaggctgtgggatgttgggatgttcccgactgaagaaggctaaagagagagaacagggtcctgcccaaccctgggctggaccccaggctcggaggaaggctatgaatgacttcattgtgtcaacccacaagatttgaattcaaacagcagatctggccaggcacggtggctcaagcctataattccagcactttgggaggccaaggtaggtggatcgacctgaggtcaggagttagagaccagcctggccgacatgacgaaaccccatctc

SEQ ID NO: 122141 - DNA, 601 bp, Human
aaaagaaaagaaaagaaaagaaaggctgtgggatgttgggatgttcccgactgaagaaggctaaagagagagaacagggtcctgcccaaccctgggctggaccccaggctcggaggaaggctatgaatgacttcattgtgtcaacccacaagatttgaattcaaacagcagatctggccaggcacggtggctcaagcctataattccagcactttgggaggccaaggtaggtggatcgacctgaggtcaggagttagagaccagcctggccgacatgacgaaaccccatctctactaaaawtacaaaaaaaattagccaggcctggtggctggtgcccataatcccagacactcaggaggctgaggcaggagaactgctggaacccaggaggcggaggttgcagtgagctgaaactgtaccacttcactccagcctaggcgacagagtgggactctgtctaaaaaaaaaacaaaaaccgatcagacggaagtattgtgtccatgttcaatctgctgacattgatgactgtacagtggttacataagggaatatcccttttcttaggaaatatgcccaaaactgttagggccaaaggtctga

SEQ ID NO: 122142 - DNA, 601 bp, Human
tattttactacatgtttatcttcttttcttgttccagacaggcaagaacaccttcacagactgcaaagacataagatttctttcaagagacatttatgcaggtgataaacataattaagctggtcatatatttagtttgagattttacttctcagtttgaggtagcaaggggcccccctggactcacacgccttagaccccgtcttcattctcaaggtttctcctggaggaaatgggttccaggaggggagctccagtgagggcgccccagagtccaaggcagttcagatgcgcaggcccygccttggggtcctcctcaatgcattgcagccaatgacgggaaaaaggactctgccctgagcccttctgtgcagggaggaggctctctgggctgctggtcagctggaaacgggaggtcttgcagtagagttttccccctgagcatggggaggagtcctggtatttggggggaaaacaggacttccaaattagagctccctaaatatttccccacaaatgatcctttgggaaatcacctgacacttcagaggagcttgtccctctgatgccacttctctatttaccagagacaaacattcct

SEQ ID NO: 122143 - DNA, 601 bp, Human
cagatgcgcaggccccgccttggggtcctcctcaatgcattgcagccaatgacgggaaaaaggactctgccctgagcccttctgtgcagggaggaggctctctgggctgctggtcagctggaaacgggaggtcttgcagtagagttttccccctgagcatggggaggagtcctggtatttggggggaaaacaggacttccaaattagagctccctaaatatttccccacaaatgatcctttgggaaatcacctgacacttcagaggagcttgtccctctgatgccacttctctatttaccrgagacaaacattcctgctttcaaggctattgacagtggccacgtcggatctgtcccggagttctgcttccaaggctgatggtgtgtgttaaggtcgtggggtggatgcagcagtcaactgtgcattcattcaacaaacacccagcctgatgcgtgccaggcactgggagtgccctggaggtaagaagcacctctcattaatttattcttgttcttccaaggaagcactggaagcacagggggctcgagcccatgctccctgactatgctttttaaacaggacaaaatatgtttaatgctt

SEQ ID NO: 122144 - DNA, 601 bp, Human
ctgaatgaaaaaaggaagatttagttaatgaattgtgttggcattatcaattaccttcctggagcaaaataaacttaaatcccttccatctaaaaataaactttagataaattagaaatctaaaggttaaaaaaattaaaaattagaggaaaattcagggaattattaatattggaataaagacaatctccttaaataagacacaaaactaggccaggcatggtggctcatgtctgtaatccaagcactttgggaggctgaggcagacagatcacctgaggtcaggagttcaacaccagcmtggccaacatggcaaaactccatctctactaaaaatacaaaaattaactggacttggtggcaggcgcctgtaatcccagctacttgggaggctgaggcaggagaatctcttaaactcgggaggtggaggttgcagggggccgagatcacaccattgtactccagcctgggtgacagagggagacttcatctcaaaatcaaacaacaaagaacacacaaaaactacacaggaaaaatgaacatatttgatcctatgaaattaaaactttggaagacataacaaatgtaatcaaaagacaaa

SEQ ID NO: 122145 - DNA, 601 bp, Human
aaataaacttaaatcccttccatctaaaaataaactttagataaattagaaatctaaaggttaaaaaaattaaaaattagaggaaaattcagggaattattaatattggaataaagacaatctccttaaataagacacaaaactaggccaggcatggtggctcatgtctgtaatccaagcactttgggaggctgaggcagacagatcacctgaggtcaggagttcaacaccagcctggccaacatggcaaaactccatctctactaaaaatacaaaaattaactggacttggtggcaggcrcctgtaatcccagctacttgggaggctgaggcaggagaatctcttaaactcgggaggtggaggttgcagggggccgagatcacaccattgtactccagcctgggtgacagagggagacttcatctcaaaatcaaacaacaaagaacacacaaaaactacacaggaaaaatgaacatatttgatcctatgaaattaaaactttggaagacataacaaatgtaatcaaaagacaaatattatacttagaaaaatatctgtagtacacatgtaagcataggtttcatattacttaacataagt

SEQ ID NO: 122146 - DNA, 601 bp, Human
acctgaggtcaggagttcaacaccagcctggccaacatggcaaaactccatctctactaaaaatacaaaaattaactggacttggtggcaggcgcctgtaatcccagctacttgggaggctgaggcaggagaatctcttaaactcgggaggtggaggttgcagggggccgagatcacaccattgtactccagcctgggtgacagagggagacttcatctcaaaatcaaacaacaaagaacacacaaaaactacacaggaaaaatgaacatatttgatcctatgaaattaaaactttggaaracataacaaatgtaatcaaaagacaaatattatacttagaaaaatatctgtagtacacatgtaagcataggtttcatattacttaacataagtacctaaacatcgatttttaaaaaaggacaaaccaatagaaaaatagtcaaagggcatgaattggcaattcacagaaaaaaaaatttaagtcaacataaaagaatatgcaccatctccaggagtcagggagatacacatccaaactgcatgagatatcattttcactttgtggacagaaaatattttacaaatattttcccccacact

SEQ ID NO: 122147 - DNA, 601 bp, Human
gcctgtaatcccagctacttgggaggctgaggcaggagaatctcttaaactcgggaggtggaggttgcagggggccgagatcacaccattgtactccagcctgggtgacagagggagacttcatctcaaaatcaaacaacaaagaacacacaaaaactacacaggaaaaatgaacatatttgatcctatgaaattaaaactttggaagacataacaaatgtaatcaaaagacaaatattatacttagaaaaatatctgtagtacacatgtaagcataggtttcatattacttaacataagyacctaaacatcgatttttaaaaaaggacaaaccaatagaaaaatagtcaaagggcatgaattggcaattcacagaaaaaaaaatttaagtcaacataaaagaatatgcaccatctccaggagtcagggagatacacatccaaactgcatgagatatcattttcactttgtggacagaaaatattttacaaatattttcccccacactgtggtttatgtctgagtcattaatttttttcttttatgaaatttttgtctgttctctaagaaatatttgcttactccaaaggttataaagata

SEQ ID NO: 122148 - DNA, 601 bp, Human
aaatcaaacaacaaagaacacacaaaaactacacaggaaaaatgaacatatttgatcctatgaaattaaaactttggaagacataacaaatgtaatcaaaagacaaatattatacttagaaaaatatctgtagtacacatgtaagcataggtttcatattacttaacataagtacctaaacatcgatttttaaaaaaggacaaaccaatagaaaaatagtcaaagggcatgaattggcaattcacagaaaaaaaaatttaagtcaacataaaagaatatgcaccatctccaggagtcaggsagatacacatccaaactgcatgagatatcattttcactttgtggacagaaaatattttacaaatattttcccccacactgtggtttatgtctgagtcattaatttttttcttttatgaaatttttgtctgttctctaagaaatatttgcttactccaaaggttataaagatattcttctatgttttctcttagaagtttcatagtttaaggtttggagctaggtctataatccatctcaaaataatttttctgcacataatgtagtagtagttgaggttcaattattttcatttgttggc

SEQ ID NO: 122149 - DNA, 601 bp, Human
aaatgaacatatttgatcctatgaaattaaaactttggaagacataacaaatgtaatcaaaagacaaatattatacttagaaaaatatctgtagtacacatgtaagcataggtttcatattacttaacataagtacctaaacatcgatttttaaaaaaggacaaaccaatagaaaaatagtcaaagggcatgaattggcaattcacagaaaaaaaaatttaagtcaacataaaagaatatgcaccatctccaggagtcagggagatacacatccaaactgcatgagatatcattttcactytgtggacagaaaatattttacaaatattttcccccacactgtggtttatgtctgagtcattaatttttttcttttatgaaatttttgtctgttctctaagaaatatttgcttactccaaaggttataaagatattcttctatgttttctcttagaagtttcatagtttaaggtttggagctaggtctataatccatctcaaaataatttttctgcacataatgtagtagtagttgaggttcaattattttcatttgttggccgggtgcggtggctcacacctggaatcctaacactgtag

SEQ ID NO: 122150 - DNA, 601 bp, Human
ttttttcttttatgaaatttttgtctgttctctaagaaatatttgcttactccaaaggttataaagatattcttctatgttttctcttagaagtttcatagtttaaggtttggagctaggtctataatccatctcaaaataatttttctgcacataatgtagtagtagttgaggttcaattattttcatttgttggccgggtgcggtggctcacacctggaatcctaacactgtaggaggctgaggcaggcagatgacttgagcccaggagttcaagaccatcctgggcaacatggtgaarctctgtttctacaaaacataagaaaattagctgggtgtgatgatgtgtgcctgtggtcccagctactcaggaagctgaggtgggaagattgatcacctgaactcatggaggtcaaggctgcagtgagccatgattgcgccactatactccagcctgggtgacagagtgagaccctgtctcaaaataaataaataaacaaacaaattaaatattcccatgtgtttattccatttttccagtactagttgttgaaaagtctttcctttccccattgtattgccttggtgactttgttaaaca

SEQ ID NO: 122151 - DNA, 601 bp, Human
ttttatgaaatttttgtctgttctctaagaaatatttgcttactccaaaggttataaagatattcttctatgttttctcttagaagtttcatagtttaaggtttggagctaggtctataatccatctcaaaataatttttctgcacataatgtagtagtagttgaggttcaattattttcatttgttggccgggtgcggtggctcacacctggaatcctaacactgtaggaggctgaggcaggcagatgacttgagcccaggagttcaagaccatcctgggcaacatggtgaaactctgtytctacaaaacataagaaaattagctgggtgtgatgatgtgtgcctgtggtcccagctactcaggaagctgaggtgggaagattgatcacctgaactcatggaggtcaaggctgcagtgagccatgattgcgccactatactccagcctgggtgacagagtgagaccctgtctcaaaataaataaataaacaaacaaattaaatattcccatgtgtttattccatttttccagtactagttgttgaaaagtctttcctttccccattgtattgccttggtgactttgttaaacaactggtc

SEQ ID NO: 122152 - DNA, 601 bp, Human
tgtctgttctctaagaaatatttgcttactccaaaggttataaagatattcttctatgttttctcttagaagtttcatagtttaaggtttggagctaggtctataatccatctcaaaataatttttctgcacataatgtagtagtagttgaggttcaattattttcatttgttggccgggtgcggtggctcacacctggaatcctaacactgtaggaggctgaggcaggcagatgacttgagcccaggagttcaagaccatcctgggcaacatggtgaaactctgtttctacaaaacatawgaaaattagctgggtgtgatgatgtgtgcctgtggtcccagctactcaggaagctgaggtgggaagattgatcacctgaactcatggaggtcaaggctgcagtgagccatgattgcgccactatactccagcctgggtgacagagtgagaccctgtctcaaaataaataaataaacaaacaaattaaatattcccatgtgtttattccatttttccagtactagttgttgaaaagtctttcctttccccattgtattgccttggtgactttgttaaacaactggtcatatattcatataa

SEQ ID NO: 122153 - DNA, 601 bp, Human
gtctgttctctaagaaatatttgcttactccaaaggttataaagatattcttctatgttttctcttagaagtttcatagtttaaggtttggagctaggtctataatccatctcaaaataatttttctgcacataatgtagtagtagttgaggttcaattattttcatttgttggccgggtgcggtggctcacacctggaatcctaacactgtaggaggctgaggcaggcagatgacttgagcccaggagttcaagaccatcctgggcaacatggtgaaactctgtttctacaaaacataagaaaattagctgggtgtgatgatgtgtgcctgtggtcccagctactcaggaagctgaggtgggaagattgatcacctgaactcatggaggtcaaggctgcagtgagccatgattgcgccactatactccagcctgggtgacagagtgagaccctgtctcaaaataaataaataaacaaacaaattaaatattcccatgtgtttattccatttttccagtactagttgttgaaaagtctttcctttccccattgtattgccttggtgactttgttaaacaactggtcatatattcatataat

SEQ ID NO: 122154 - DNA, 601 bp, Human
gtgtgatgatgtgtgcctgtggtcccagctactcaggaagctgaggtgggaagattgatcacctgaactcatggaggtcaaggctgcagtgagccatgattgcgccactatactccagcctgggtgacagagtgagaccctgtctcaaaataaataaataaacaaacaaattaaatattcccatgtgtttattccatttttccagtactagttgttgaaaagtctttcctttccccattgtattgccttggtgactttgttaaacaactggtcatatattcatataatctgcatgaaagtycttgtctgccagtctttacattgggtcatcttgggctctgtttttacttgctattttttcttgattatgagttgcatttttgtgtttctgcacatctagttattttgtattatatattggaaagtatggataatatagtgtagccaatctgaattagattgtcctcctttacagagttgtgagatttgtctggcaggtagtttgatgactggaaggctctttggtcccatctggtttgctttattcttggctagggcagggctattttggtcttgaacatagtcctaggaaatagttcct

SEQ ID NO: 122155 - DNA, 601 bp, Human
tcccagctactcaggaagctgaggtgggaagattgatcacctgaactcatggaggtcaaggctgcagtgagccatgattgcgccactatactccagcctgggtgacagagtgagaccctgtctcaaaataaataaataaacaaacaaattaaatattcccatgtgtttattccatttttccagtactagttgttgaaaagtctttcctttccccattgtattgccttggtgactttgttaaacaactggtcatatattcatataatctgcatgaaagttcttgtctgccagtctttacatygggtcatcttgggctctgtttttacttgctattttttcttgattatgagttgcatttttgtgtttctgcacatctagttattttgtattatatattggaaagtatggataatatagtgtagccaatctgaattagattgtcctcctttacagagttgtgagatttgtctggcaggtagtttgatgactggaaggctctttggtcccatctggtttgctttattcttggctagggcagggctattttggtcttgaacatagtcctaggaaatagttcctctaagactggacctttctgggg

SEQ ID NO: 122156 - DNA, 601 bp, Human
agattgtcctcctttacagagttgtgagatttgtctggcaggtagtttgatgactggaaggctctttggtcccatctggtttgctttattcttggctagggcagggctattttggtcttgaacatagtcctaggaaatagttcctctaagactggacctttctggggtcacacctgaatgcgaggtctcttcatcctggctgggctgaagcacctcttcttccccagtacatcaagacctccagtatcacgtttggccctcagccctggaacaggcaatctctgctgggcctcatggagtyttgccctaccccatacagctcagctcttgaacaaagacctgtgatgagtgttgctgtggacttctagagctacccgtttttctctgggattctcatttgtaaacttcagccactttgacagcccagcactctggcctcttccatcttagctcagcgatcgcaccactctgctcggtctcttcctcctcaactgtgacacaaaagtggctgcaagtcagaggcagtcacgggagcttcagctcatgtgattctctgctctcaaaaatcacagtcccgtgctgtctgttgtccaatacctga

SEQ ID NO: 122157 - DNA, 601 bp, Human
ttctggggtcacacctgaatgcgaggtctcttcatcctggctgggctgaagcacctcttcttccccagtacatcaagacctccagtatcacgtttggccctcagccctggaacaggcaatctctgctgggcctcatggagttttgccctaccccatacagctcagctcttgaacaaagacctgtgatgagtgttgctgtggacttctagagctacccgtttttctctgggattctcatttgtaaacttcagccactttgacagcccagcactctggcctcttccatcttagctcagcgatygcaccactctgctcggtctcttcctcctcaactgtgacacaaaagtggctgcaagtcagaggcagtcacgggagcttcagctcatgtgattctctgctctcaaaaatcacagtcccgtgctgtctgttgtccaatacctgaaaacatttacctcttatatttgtccagtttatttgtctgtttgagacagtctcgctctgtcacccaggctggagtacagtggcgcgatctcaatcactgcaacctccgcctcccagattcaagcgattctcatgcctcagcctcccgagtagctgggat

SEQ ID NO: 122158 - DNA, 601 bp, Human
acacctgaatgcgaggtctcttcatcctggctgggctgaagcacctcttcttccccagtacatcaagacctccagtatcacgtttggccctcagccctggaacaggcaatctctgctgggcctcatggagttttgccctaccccatacagctcagctcttgaacaaagacctgtgatgagtgttgctgtggacttctagagctacccgtttttctctgggattctcatttgtaaacttcagccactttgacagcccagcactctggcctcttccatcttagctcagcgatcgcaccactcygctcggtctcttcctcctcaactgtgacacaaaagtggctgcaagtcagaggcagtcacgggagcttcagctcatgtgattctctgctctcaaaaatcacagtcccgtgctgtctgttgtccaatacctgaaaacatttacctcttatatttgtccagtttatttgtctgtttgagacagtctcgctctgtcacccaggctggagtacagtggcgcgatctcaatcactgcaacctccgcctcccagattcaagcgattctcatgcctcagcctcccgagtagctgggattacaggcatg

SEQ ID NO: 122159 - DNA, 601 bp, Human
aaaataataaaattaaaaaataggctgggcgcagtggctcatgcctgtaatctcagcactttgggaggctgagacgggcggatcacgaggtcaggagatcgagaccatcctggctaacacagtgaaaccccgtctctactaaaaatacaaatacaaatacgaattacaaaaaaattagccgggcgtggtggcaggcacctgttgtcccagctacttgggaggctgaggcaggagaatggcgtgaacccaggaggtggagcttgcagtgagccgagattgcgccactgcactccagcctggrtgacagagtgagactccatctcaaaaaaaaaaaaaaaaaaaaatagaagcaggagggctgactgcgcagcctgacctggtttcggcctgaccctcgtgtccccctgtccccatcatctgtcccgtgttccattctcccaaatgtgaaaaactgcagccaccaagtccctatgtcctccaagtgtgacgtcttgtggactgagacgttgcccccagactcctagcccagcataccctgttccagcgagtgccacgcacaggccattccccagcacctggtgctattgccacttcctgtcac

SEQ ID NO: 122160 - DNA, 601 bp, Human
agggtgaagctgctgccctccagggtgtgatgggcaaggtctgtgtagagatagtgagggccaaagccggcaacatagtcacccaggggtgagggccgaggctagccctgcccaaaggctggagcccaggagaccagccagggagagaacatggtcctgcaggagggtgggaggtcaccccacttgttcagcacagctcatggagggcaggcgaggaggctcggcccccgccacactgcccctccggagcactttacttctccgtattcaagactctgcgtcatgccattggaataacacraaaaacatgcttttgtatttgctcaccaacagtagtctgttcattcgagtaacgtccttctggcaggcacctgttgttgattttggaaagtttaggaaaacatgagattcaggagcctcatatgcagtcaccggatccgggtgccctggaatggccccagcccccaagtgcagctgctcacgggccacaggctgccacgttcctcctgacggggatcgtggagatggcgcagcaggagaggaagactaacaggctgccacgttcctcctgacggggatcatggagacggcgcagcaggag

SEQ ID NO: 122161 - DNA, 601 bp, Human
cgaggaggctcggcccccgccacactgcccctccggagcactttacttctccgtattcaagactctgcgtcatgccattggaataacacaaaaaacatgcttttgtatttgctcaccaacagtagtctgttcattcgagtaacgtccttctggcaggcacctgttgttgattttggaaagtttaggaaaacatgagattcaggagcctcatatgcagtcaccggatccgggtgccctggaatggccccagcccccaagtgcagctgctcacgggccacaggctgccacgttcctcctgacrgggatcgtggagatggcgcagcaggagaggaagactaacaggctgccacgttcctcctgacggggatcatggagacggcgcagcaggagaggaagactcaagaggattcaagcctgacagtgcttttggcttctgggtctaggagactcaacattcttcccagtcaacattagatgaatgaatgagtgatgaagggggtggccaggagtggtcaggagcaactctacacaaaatagaaggccaggcgcagtggctcacgcctctaatcctagcactttgggaagctgaggcgggtggatc

SEQ ID NO: 122162 - DNA, 601 bp, Human
tagtctgttcattcgagtaacgtccttctggcaggcacctgttgttgattttggaaagtttaggaaaacatgagattcaggagcctcatatgcagtcaccggatccgggtgccctggaatggccccagcccccaagtgcagctgctcacgggccacaggctgccacgttcctcctgacggggatcgtggagatggcgcagcaggagaggaagactaacaggctgccacgttcctcctgacggggatcatggagacggcgcagcaggagaggaagactcaagaggattcaagcctgacagtrcttttggcttctgggtctaggagactcaacattcttcccagtcaacattagatgaatgaatgagtgatgaagggggtggccaggagtggtcaggagcaactctacacaaaatagaaggccaggcgcagtggctcacgcctctaatcctagcactttgggaagctgaggcgggtggatcacctgaggtcgggagttcaagaccagcctggccaacatggagaaaccccgtctctactaaaaatacaaaattagccaggcatggtggcgcatgcctgtaatcccagctactcgggaggctga

SEQ ID NO: 122163 - DNA, 601 bp, Human
tgtgaccgaaagggtgcaccagatgctatggagcagacacacacaagttacccttgaacaaggcagcgtgcagagttcagaaaccagtagcacaagcatggggcgggggcgctgctctaagacatcatcagcatgaatgggcgaatacctgacaggtgtgagtggattcggttcggtgtgagttaatagcattgcgtcacacaagcacctgaacaaagctgatgacatcggggggctctcgggtgaaggaagctggggtcccggttttaggggaattcctcctccaggagccctcctggcrtctctctttgccacccagccccagcttaggatggagggccctaggctgggttcctaaggccccgggtgattccctgaggcggccatcatccacatacatgcacgcttgtctgcctgtggacggtgtaaagcccctcgaaccctcccacgggccgtccttatctctgtacccacggggctggtgtgcactagagcagtgttccaccaataaatgagaaggcgctttgaagaatgagcaggcgctcacctggctgggagaggggtgggcgagacccatggctgggaatgagcagggctaagg

SEQ ID NO: 122164 - DNA, 601 bp, Human
atctctgtacccacggggctggtgtgcactagagcagtgttccaccaataaatgagaaggcgctttgaagaatgagcaggcgctcacctggctgggagaggggtgggcgagacccatggctgggaatgagcagggctaaggcagcagcattccaggtcccctcagtcccatggctggagcagggctgtcgggggaggctgcaggagatggaatggggaggccaaaagggactccagcctgggaggtgcagtctccccctctaaggagtttggggctaccccattgtcaggaaggtgttttraggggtttccaggaggtggctggtgggacacaatcacattatctgagccctgaaaagaccaggcaacaccatgggaaactggctggagggaaaccagtgtggagcctactgtggtcccggggcgggagaccagatcctctctgggtgttcgtggctgtccgtggtgtccaaggcaccagggacaaggctacgcaaggggcacctctagctcatggcggctagttccgacgctgcagccgtcagacgtgttaaatcacacagggcatgaaccgggaaacatgaaatccaccctcagcttca

SEQ ID NO: 122165 - DNA, 601 bp, Human
gccaaaagggactccagcctgggaggtgcagtctccccctctaaggagtttggggctaccccattgtcaggaaggtgttttgaggggtttccaggaggtggctggtgggacacaatcacattatctgagccctgaaaagaccaggcaacaccatgggaaactggctggagggaaaccagtgtggagcctactgtggtcccggggcgggagaccagatcctctctgggtgttcgtggctgtccgtggtgtccaaggcaccagggacaaggctacgcaaggggcacctctagctcatggcggmtagttccgacgctgcagccgtcagacgtgttaaatcacacagggcatgaaccgggaaacatgaaatccaccctcagcttcaattgctccaataattatttgttagctcagaagttcaagacatttggaacaggtccaacaatgatgtcaacttagttcccatctctgaatctgtggtggagaaacctggacactggaaacagggtgggtttggggatccggctgacctggggcccaattctgacttccctgtttctgcgagcccctggatacgtacgtttctaaatgtctctgaacctcg

SEQ ID NO: 122166 - DNA, 601 bp, Human
tggaacaggtccaacaatgatgtcaacttagttcccatctctgaatctgtggtggagaaacctggacactggaaacagggtgggtttggggatccggctgacctggggcccaattctgacttccctgtttctgcgagcccctggatacgtacgtttctaaatgtctctgaacctcggttttcctgtctttatcattcgtgcattcattcatgacattgtcatttattcaacaaatacgtactgagcacctactatctatcaggcaccgttccaagtacagggaatataggtgtgaaaaaaagctcctgccctcactgattttacatcctgggacagggagacagaggaataagtcatgaggtgccactgggcagggaaggggctggggagagctgcgggcggctgtgatcgtggtagcaatgagccctagcagcactgctttcatctcggggctgctatgaggactgagttagagaatgggtgttagaagagggctggcacctgccggggcccagcatctcatcctgcaccagcctggtgggaaggcttgattcccttcaagtatcaacagccatggaagctaaatctcgaccagacctcg

SEQ ID NO: 122167 - DNA, 601 bp, Human
tctctctccgttgagtatgaggttggctgtggtgttttcatagatggccttgtactgtgacaggtcctccaccaggttacttaagggcatatgtctgctgcctgaaccctgaaggccacatggtgagtccacgccacggtgcccagccaaggagtaggtgtccctgagaacccacacagcccagagaggatctgagaacccgccaaggaaaagtcccatggcacacacacacagtaggcaaagagccagaaaatcagcgtaaaagcagcctagagatgggggcggcgtggatctctcgagytgtcctgctgctgtccggcagtgccctgtgtgcgggtccccatcaactctgctactcaccaggctggacttgccccagtccttctttggggcctgggaaggaggggacgatactgtctcaagtgtgtcccgcagtaggccttgcttgtgttgaaagggttccttctgcgcctgccccgttgggtgtatttcctggtggagtttcatttcgtccaatgcttttcctgcatcgatggagatgatcaccccgttttctccttcattctgttaacggtgtagatcacactggtagatgtttgtg

SEQ ID NO: 122168 - DNA, 601 bp, Human
agcatgaaaaataacaaaggaattcttaacatgacccgtttaggactaaacaagttttactgaggccatgaaccacaagcccttccccaggtggaccattgggaagccacatgtgaccagtaggtggtcactcatctttctgcagagctcccaatgtgaccagccagctccccacctgccggccattataagagtcatcctcttcttgacacctccagaagagaacctggatttccagcccaagtctgtccttgtcggctgcccaggcccaacacttaggactcatcctgatttctccttytccctccatttctacctccaagttctgctgcccctccctcgaaggcacatcatgaatttttaattgtcccctacacctctctcacggttgtcccagtacaatccccatcacccccaactgagtcatgtcacagcctcgtgctggcactgtcctcccccaacaattctccctccagcagccagagtccctctccagcccccaagctccacgccacctcagacgtcccctaccatggccctggtcccgctccatctggcccctgctgacctctcctctgcatcccctgccaccccaggcctt

SEQ ID NO: 122169 - DNA, 601 bp, Human
ccattgggaagccacatgtgaccagtaggtggtcactcatctttctgcagagctcccaatgtgaccagccagctccccacctgccggccattataagagtcatcctcttcttgacacctccagaagagaacctggatttccagcccaagtctgtccttgtcggctgcccaggcccaacacttaggactcatcctgatttctccttctccctccatttctacctccaagttctgctgcccctccctcgaaggcacatcatgaatttttaattgtcccctacacctctctcacggttgtcccrgtacaatccccatcacccccaactgagtcatgtcacagcctcgtgctggcactgtcctcccccaacaattctccctccagcagccagagtccctctccagcccccaagctccacgccacctcagacgtcccctaccatggccctggtcccgctccatctggcccctgctgacctctcctctgcatcccctgccaccccaggccttagccagcccatcccagcaattccttcaggatccctccaccccaccactagctaccctactctaagcggcgccccgggcccttgcctggtggcctc

SEQ ID NO: 122170 - DNA, 601 bp, Human
cacctccagaagagaacctggatttccagcccaagtctgtccttgtcggctgcccaggcccaacacttaggactcatcctgatttctccttctccctccatttctacctccaagttctgctgcccctccctcgaaggcacatcatgaatttttaattgtcccctacacctctctcacggttgtcccagtacaatccccatcacccccaactgagtcatgtcacagcctcgtgctggcactgtcctcccccaacaattctccctccagcagccagagtccctctccagcccccaagctccaygccacctcagacgtcccctaccatggccctggtcccgctccatctggcccctgctgacctctcctctgcatcccctgccaccccaggccttagccagcccatcccagcaattccttcaggatccctccaccccaccactagctaccctactctaagcggcgccccgggcccttgcctggtggcctcctcttcagctcagcaacctcttctcagtggggccttccctcatcagcccgttcaagttacctcctccgcttgctctttccaatagccgcccacctgtttgctcctggggttagc

SEQ ID NO: 122171 - DNA, 601 bp, Human
ctccctccatttctacctccaagttctgctgcccctccctcgaaggcacatcatgaatttttaattgtcccctacacctctctcacggttgtcccagtacaatccccatcacccccaactgagtcatgtcacagcctcgtgctggcactgtcctcccccaacaattctccctccagcagccagagtccctctccagcccccaagctccacgccacctcagacgtcccctaccatggccctggtcccgctccatctggcccctgctgacctctcctctgcatcccctgccaccccaggcctyagccagcccatcccagcaattccttcaggatccctccaccccaccactagctaccctactctaagcggcgccccgggcccttgcctggtggcctcctcttcagctcagcaacctcttctcagtggggccttccctcatcagcccgttcaagttacctcctccgcttgctctttccaatagccgcccacctgtttgctcctggggttagccccccacaccccgggatcacttcactcaattttctcatgtctgctctacccagactctgagcgccagacacgggttctcactgctcccagt

SEQ ID NO: 122172 - DNA, 601 bp, Human
ccacagcctttctgccgacctagcatccattctccaccctctgcttgccggcgtccggcccacggtaccccaactgtgtctgcaggatgtgtgcccagccccagtgaggcatcaaatgggcctaagcggaggattggctgagaggtggagacgagacccagggtgatgctgaaacgtaaggacacgtctgcagggaatccggggaaagacacttcctccttgatgaagggaggcaagcatggggggccctggctgcccctcgctccctgctcctccttctgagtgccactgtgtgaggatrtggtatcccctccttctaactgtgccacgaccgggtcaatatgagtgttccaggagagcggaggaggaggaaagctccgggttacatcccagggcagccgaacaacctggagcgcacatttgggacttcctgttcttatttgtgtcctcatgagtcatgtccccactaggtgagctctctgtgacgtgcagcctcacgcgcactgacaggcatgaagcccagcgctgggcgcatgggacctgctccatcaggttagaagcagggaacaaacgcctcacggctcctgctcccaacacaacc

SEQ ID NO: 122173 - DNA, 601 bp, Human
atatgagtgttccaggagagcggaggaggaggaaagctccgggttacatcccagggcagccgaacaacctggagcgcacatttgggacttcctgttcttatttgtgtcctcatgagtcatgtccccactaggtgagctctctgtgacgtgcagcctcacgcgcactgacaggcatgaagcccagcgctgggcgcatgggacctgctccatcaggttagaagcagggaacaaacgcctcacggctcctgctcccaacacaaccatggagacaggcacgtccgcataagccatcccagaaccragtggactcactgctcaggagcacgaggaggcccttcagcctggggaaaaagctgggccaatctggacggcgcaaggcttcgaagaatgagaaggttttgcacaaacaggctggcagaggagatggcaaaaggaagtctcatgagcaaagctattagctattaaacggtggctgtggagcaagagcttgggacacagggcagggagggcgcagttaaggatagaaacagctagagataaggcgaacagagcctggtggagaaggccttgagcatcatgcagattcacgttctcttctgca

SEQ ID NO: 122174 - DNA, 601 bp, Human
agcaaagctattagctattaaacggtggctgtggagcaagagcttgggacacagggcagggagggcgcagttaaggatagaaacagctagagataaggcgaacagagcctggtggagaaggccttgagcatcatgcagattcacgttctcttctgcaagcaaagggacaggttctgtttgcttgttttactaaatggaggaatgacatgatcagtagatgaaaattccacagccgcatcaatcacggagtagaagatggcaaagcctagaggtccgcagaccagtggggaagccacccccrcgggccaggcctgtgatgaaggtcttggggcggcgacagtggctggaggagccactccagaggtccacagggagggcttgggaatgcctgggtgtagggagagagggggagacacatgagaaagggctccaagcctacacaggctctctgagggtggcagcagagtccccaggacaaggggcagtcttggggctatcagctgtggacaggctgagctggggaggcccggcagccactctggtggagacgtcccacaagcagtcagaggtggaaaggggagcctggaacgggccggaattg

SEQ ID NO: 122175 - DNA, 601 bp, Human
gtggctgtggagcaagagcttgggacacagggcagggagggcgcagttaaggatagaaacagctagagataaggcgaacagagcctggtggagaaggccttgagcatcatgcagattcacgttctcttctgcaagcaaagggacaggttctgtttgcttgttttactaaatggaggaatgacatgatcagtagatgaaaattccacagccgcatcaatcacggagtagaagatggcaaagcctagaggtccgcagaccagtggggaagccacccccgcgggccaggcctgtgatgaaggttttggggcggcgacagtggctggaggagccactccagaggtccacagggagggcttgggaatgcctgggtgtagggagagagggggagacacatgagaaagggctccaagcctacacaggctctctgagggtggcagcagagtccccaggacaaggggcagtcttggggctatcagctgtggacaggctgagctggggaggcccggcagccactctggtggagacgtcccacaagcagtcagaggtggaaaggggagcctggaacgggccggaattgcacaggcacacataggggcccaca

SEQ ID NO: 122176 - DNA, 601 bp, Human
aatgtttgttccctggtgtcacaaggaaaaattagcattcagacaaaaagttctctcagcgaggcaatttttactttctgcagaaagggtgtcccttgcagatggaacaatggggagggcacacacagaataaagagacgccagaatatccattctatatgcatgaggcctctattgctgtgtcctgtctccattggctggagccggacctcacaatctaaattaaaacccgattggctaataatttattctcaaataaggaaggagcataggctgtgagctggaacatgcctatgagcaygtgagcacagatatcttggttaaggtacaaggacatggaatgtactacgtgccttgagcatgtctaacagctacctaggatagggcttaacaaagagttattagcacaaagcaaggaggcttgaaggaagttagtctttaaaagaaactattatttctaacacttatgatttattctttaataagaagggaaactttgaagaggaaactttttactttctacagtcctgcaaccacacaaacaactgcagagaaaggcagcagcagcaggcctcctaacagccaagaggcggaagcaacc

SEQ ID NO: 122177 - DNA, 601 bp, Human
tctttaaaagaaactattatttctaacacttatgatttattctttaataagaagggaaactttgaagaggaaactttttactttctacagtcctgcaaccacacaaacaactgcagagaaaggcagcagcagcaggcctcctaacagccaagaggcggaagcaacccaaacgcccatagatgaatgaataacaacgtggtctccatacgatgaatgttatctgggcataaaggggaatgaggctctgacacacgctacagggatgagtcgtgtaaacgtaacgctaagtgaaagaagccaracgcgaaggcccatgtagtgtatgattccatttgtatgaaatgcccagaagaggcaagtgcatagacagaaccattaggactgcccgggaccaggggaagaggaggagaggctgctgatgagtagacagggtgtgctttggggtgatgaactgttctcaaatggattttattggcgttttaataacttcgtggatgtattactattgcaggatttttccttagttcagctaaacacctcttaaaggtcctaccttttcatactgtaacaatggcagttacatttcaacatgagttttgga

SEQ ID NO: 122178 - DNA, 601 bp, Human
aatgctgaatagaagtggtaagagtggacatctctgtcttgttcctgagcttagggagttttcaaatgagatgggcgtttctgtggtttgagggaaagaaattaatggggaaagaaactggggatatgtataagacaaaggataattgacagagatggatccaggggagacaggaaaaaagcaggccacttcttctggcgatgggagggaacaaaaacaactctgactgatgtggaaaggtaggaatgctgcccttcacacctaatggtcgtctcttctcagtaaagtggggcagtcaccyggggaatggtcagggtagactgggggcttgaagcaaggaggaaacatcaggcatgactgctgctgtgtggaagaacgcggaccagcccgtggagatggacccacagaaggggccagcctggtgctttgctgtctctctgttcggtgccggttcaccaagcgccttcccctgcttctgggttctagcccacctgagacttttccctgtttattccctggcattatgaagtcatctctggaaactgaaatcatactaaaaatgtattatattgactgaaggcatatttcttgatcttaattt

SEQ ID NO: 122179 - DNA, 601 bp, Human
acagagatggatccaggggagacaggaaaaaagcaggccacttcttctggcgatgggagggaacaaaaacaactctgactgatgtggaaaggtaggaatgctgcccttcacacctaatggtcgtctcttctcagtaaagtggggcagtcacctggggaatggtcagggtagactgggggcttgaagcaaggaggaaacatcaggcatgactgctgctgtgtggaagaacgcggaccagcccgtggagatggacccacagaaggggccagcctggtgctttgctgtctctctgttcggtgcyggttcaccaagcgccttcccctgcttctgggttctagcccacctgagacttttccctgtttattccctggcattatgaagtcatctctggaaactgaaatcatactaaaaatgtattatattgactgaaggcatatttcttgatcttaatttaaaactgatgtttcacgtttcttctaaaaaagtgggggcggtgcaaagactaagttacttatcttttctgactctgctcttcttaacagaagacagaaccctcctcccactttcaaggtgttacaactgaactcaaggtgcagctgga

SEQ ID NO: 122180 - DNA, 601 bp, Human
cttttccctgtttattccctggcattatgaagtcatctctggaaactgaaatcatactaaaaatgtattatattgactgaaggcatatttcttgatcttaatttaaaactgatgtttcacgtttcttctaaaaaagtgggggcggtgcaaagactaagttacttatcttttctgactctgctcttcttaacagaagacagaaccctcctcccactttcaaggtgttacaactgaactcaaggtgcagctggagtaacaccctcctgcacaagtgtccggtcagcacccctttcccacctcragggccccgcctgagcccagagacaccgcgaacaacaaagatggcttgggcagagttggagtttatttgctgcagttccttggcgctagtttacaaggcaaaaacaaacaaacaaaaacaattagaataattatttcttaaaaaccctgtcaacaactttcagtcatttctttatatttttgtattttgacaaaacttcttttaaacaaatacaaaataatctaaaaggagaaaaactatacatagattatttacacctctgataaatagactaatactgacccaggtgcctctctgtct

SEQ ID NO: 122181 - DNA, 601 bp, Human; identical to SEQ ID NO: 31192

SEQ ID NO: 122182 - DNA, 499 bp, Human; identical to SEQ ID NO: 122130

SEQ ID NO: 122183 - DNA, 601 bp, Human; identical to SEQ ID NO: 122131

SEQ ID NO: 122184 - DNA, 601 bp, Human; identical to SEQ ID NO: 122132

SEQ ID NO: 122185 - DNA, 601 bp, Human; identical to SEQ ID NO: 122133

SEQ ID NO: 122186 - DNA, 601 bp, Human; identical to SEQ ID NO: 122134

SEQ ID NO: 122187 - DNA, 601 bp, Human; identical to SEQ ID NO: 122135

SEQ ID NO: 122188 - DNA, 601 bp, Human; identical to SEQ ID NO: 122136

SEQ ID NO: 122189 - DNA, 601 bp, Human; identical to SEQ ID NO: 122137

SEQ ID NO: 122190 - DNA, 601 bp, Human; identical to SEQ ID NO: 122138

SEQ ID NO: 122191 - DNA, 601 bp, Human; identical to SEQ ID NO: 122139

SEQ ID NO: 122192 - DNA, 601 bp, Human; identical to SEQ ID NO: 122140

SEQ ID NO: 122193 - DNA, 601 bp, Human; identical to SEQ ID NO: 122141

SEQ ID NO: 122194 - DNA, 601 bp, Human; identical to SEQ ID NO: 122142

SEQ ID NO: 122195 - DNA, 601 bp, Human; identical to SEQ ID NO: 122143

SEQ ID NO: 122196 - DNA, 601 bp, Human; identical to SEQ ID NO: 122144

SEQ ID NO: 122197 - DNA, 601 bp, Human; identical to SEQ ID NO: 122145

SEQ ID NO: 122198 - DNA, 601 bp, Human; identical to SEQ ID NO: 122146

SEQ ID NO: 122199 - DNA, 601 bp, Human; identical to SEQ ID NO: 122147

SEQ ID NO: 122200 - DNA, 601 bp, Human; identical to SEQ ID NO: 122148

SEQ ID NO: 122201 - DNA, 601 bp, Human; identical to SEQ ID NO: 122149

SEQ ID NO: 122202 - DNA, 601 bp, Human; identical to SEQ ID NO: 122150

SEQ ID NO: 122203 - DNA, 601 bp, Human; identical to SEQ ID NO: 122151

SEQ ID NO: 122204 - DNA, 601 bp, Human; identical to SEQ ID NO: 122152

SEQ ID NO: 122205 - DNA, 601 bp, Human; identical to SEQ ID NO: 122153

SEQ ID NO: 122206 - DNA, 601 bp, Human; identical to SEQ ID NO: 122154

SEQ ID NO: 122207 - DNA, 601 bp, Human; identical to SEQ ID NO: 122155

SEQ ID NO: 122208 - DNA, 601 bp, Human; identical to SEQ ID NO: 122156

SEQ ID NO: 122209 - DNA, 601 bp, Human; identical to SEQ ID NO: 122157

SEQ ID NO: 122210 - DNA, 601 bp, Human; identical to SEQ ID NO: 122158

SEQ ID NO: 122211 - DNA, 601 bp, Human; identical to SEQ ID NO: 122159

SEQ ID NO: 122212 - DNA, 601 bp, Human; identical to SEQ ID NO: 122160

SEQ ID NO: 122213 - DNA, 601 bp, Human; identical to SEQ ID NO: 122161

SEQ ID NO: 122214 - DNA, 601 bp, Human; identical to SEQ ID NO: 122162

SEQ ID NO: 122215 - DNA, 601 bp, Human; identical to SEQ ID NO: 122163

SEQ ID NO: 122216 - DNA, 601 bp, Human; identical to SEQ ID NO: 122164

SEQ ID NO: 122217 - DNA, 601 bp, Human; identical to SEQ ID NO: 122165

SEQ ID NO: 122218 - DNA, 601 bp, Human; identical to SEQ ID NO: 122166

SEQ ID NO: 122219 - DNA, 601 bp, Human; identical to SEQ ID NO: 122167

SEQ ID NO: 122220 - DNA, 601 bp, Human; identical to SEQ ID NO: 122168

SEQ ID NO: 122221 - DNA, 601 bp, Human; identical to SEQ ID NO: 122169

SEQ ID NO: 122222 - DNA, 601 bp, Human; identical to SEQ ID NO: 122170

SEQ ID NO: 122223 - DNA, 601 bp, Human; identical to SEQ ID NO: 122171

SEQ ID NO: 122224 - DNA, 601 bp, Human; identical to SEQ ID NO: 122172

SEQ ID NO: 122225 - DNA, 601 bp, Human; identical to SEQ ID NO: 122173

SEQ ID NO: 122226 - DNA, 601 bp, Human; identical to SEQ ID NO: 122174

SEQ ID NO: 122227 - DNA, 601 bp, Human; identical to SEQ ID NO: 122175

SEQ ID NO: 122228 - DNA, 601 bp, Human; identical to SEQ ID NO: 122176

SEQ ID NO: 122229 - DNA, 601 bp, Human; identical to SEQ ID NO: 122177

SEQ ID NO: 122230 - DNA, 601 bp, Human; identical to SEQ ID NO: 122178

SEQ ID NO: 122231 - DNA, 601 bp, Human; identical to SEQ ID NO: 122179

SEQ ID NO: 122232 - DNA, 601 bp, Human; identical to SEQ ID NO: 122180

SEQ ID NO: 122233 - DNA, 601 bp, Human; identical to SEQ ID NO: 31192

SEQ ID NO: 122234 - DNA, 601 bp, Human; identical to SEQ ID NO: 36997

SEQ ID NO: 122235 - DNA, 601 bp, Human; identical to SEQ ID NO: 36998

SEQ ID NO: 122236 - DNA, 601 bp, Human; identical to SEQ ID NO: 36999

SEQ ID NO: 122237 - DNA, 601 bp, Human; identical to SEQ ID NO: 37000

SEQ ID NO: 122238 - DNA, 601 bp, Human; identical to SEQ ID NO: 37001

SEQ ID NO: 122239 - DNA, 601 bp, Human; identical to SEQ ID NO: 37002

SEQ ID NO: 122240 - DNA, 601 bp, Human; identical to SEQ ID NO: 37003

SEQ ID NO: 122241 - DNA, 601 bp, Human; identical to SEQ ID NO: 37004

SEQ ID NO: 122242 - DNA, 601 bp, Human; identical to SEQ ID NO: 37005

SEQ ID NO: 122243 - DNA, 601 bp, Human
gacagttcttaaagagtactcccaggtttccagattggggagccacattgctggtgatgcccccaaatgtgattgggaatgcaagaaggccaggcattatagcaagaagtttgcggtgctggtggggcatctagcaggaaggcccagcagacactgcatctatgagtccagcaacactgagttccaggcagctaaggactcagaagtccactgtaatcaccagcaggctcctggggaccttagcttctggacacagcaagaaggtgactgggatgtgaagaagatcagtaagggaatctgractgaccttttagaagtttaagaggggaagaaggttggggcagtatctaagcaggtaaaaagggtcagaggaagcctattctagaatgggagaaattttagcatgttttgttgacagaaagacacagtaagaaattttgaaatggggtgatgggggcggtgggatcatgtatgaatcaagtccaagaaaaggcaaaaaggagatatctccaaggcagagtttggtcttggacagaaaccgcacacatcctcttctgaaactggaggatatggatgtggatgcttatgcagtaggagagtg

SEQ ID NO: 122244 - DNA, 601 bp, Human
actgcatctatgagtccagcaacactgagttccaggcagctaaggactcagaagtccactgtaatcaccagcaggctcctggggaccttagcttctggacacagcaagaaggtgactgggatgtgaagaagatcagtaagggaatctggactgaccttttagaagtttaagaggggaagaaggttggggcagtatctaagcaggtaaaaagggtcagaggaagcctattctagaatgggagaaattttagcatgttttgttgacagaaagacacagtaagaaattttgaaatggggtgatrggggcggtgggatcatgtatgaatcaagtccaagaaaaggcaaaaaggagatatctccaaggcagagtttggtcttggacagaaaccgcacacatcctcttctgaaactggaggatatggatgtggatgcttatgcagtaggagagtggggaattaaggaatattccaatggagggacttgattttctatagacattaggacaaggtcatctactaagagtgagggggcaggggttgatgggatggtttaagagtacaggtttaaggtcatttttgggaaaagaaagatgaccaagggca

SEQ ID NO: 122245 - DNA, 601 bp, Human
gtaagaaattttgaaatggggtgatgggggcggtgggatcatgtatgaatcaagtccaagaaaaggcaaaaaggagatatctccaaggcagagtttggtcttggacagaaaccgcacacatcctcttctgaaactggaggatatggatgtggatgcttatgcagtaggagagtggggaattaaggaatattccaatggagggacttgattttctatagacattaggacaaggtcatctactaagagtgagggggcaggggttgatgggatggtttaagagtacaggtttaaggtcattttygggaaaagaaagatgaccaagggcaagagtgaggctggccaggctggctaaagccagctgggagggaagacgtgaacgcataggggcaccagaccatgaactgtgagattctctctagcacgctcagctaccctgaagtagaagccaaaaacgcagatgcagcactgatggggatttgctaaggaagcagaagaagtgaggggtgtgagggttcataagagagtaatttagatcatcaacacaggatgaatcttgggttaggaagaaagggaggtccagagagggctgccaggtaggtgg

SEQ ID NO: 122246 - DNA, 601 bp, Human
gtaggagagtggggaattaaggaatattccaatggagggacttgattttctatagacattaggacaaggtcatctactaagagtgagggggcaggggttgatgggatggtttaagagtacaggtttaaggtcatttttgggaaaagaaagatgaccaagggcaagagtgaggctggccaggctggctaaagccagctgggagggaagacgtgaacgcataggggcaccagaccatgaactgtgagattctctctagcacgctcagctaccctgaagtagaagccaaaaacgcagatgcagyactgatggggatttgctaaggaagcagaagaagtgaggggtgtgagggttcataagagagtaatttagatcatcaacacaggatgaatcttgggttaggaagaaagggaggtccagagagggctgccaggtaggtgggaaccaaggaaccagaaacctagagtctacaagagttccaagcaacagatgtggaaaatgagaccatgaatacagtggaaagacaggaggttgtgggccaaggtagaaacaggaatccagccatctgctggtgagcagtgttaggtgtttccaggaacaatgt

SEQ ID NO: 122247 - DNA, 601 bp, Human
tgaggctggccaggctggctaaagccagctgggagggaagacgtgaacgcataggggcaccagaccatgaactgtgagattctctctagcacgctcagctaccctgaagtagaagccaaaaacgcagatgcagcactgatggggatttgctaaggaagcagaagaagtgaggggtgtgagggttcataagagagtaatttagatcatcaacacaggatgaatcttgggttaggaagaaagggaggtccagagagggctgccaggtaggtgggaaccaaggaaccagaaacctagagtctayaagagttccaagcaacagatgtggaaaatgagaccatgaatacagtggaaagacaggaggttgtgggccaaggtagaaacaggaatccagccatctgctggtgagcagtgttaggtgtttccaggaacaatgtgtttctagggtgggtagcttgaatgccctggttgaggtgacagggccttatgtggaaagcaaaaaggccttaagccccgagccaacccaaatgcattgagtgttaattaagagacatatagtaggctagcaattggaaaaccagcggagaagcaagaaagacagcag

SEQ ID NO: 122248 - DNA, 601 bp, Human
ttagatcatcaacacaggatgaatcttgggttaggaagaaagggaggtccagagagggctgccaggtaggtgggaaccaaggaaccagaaacctagagtctacaagagttccaagcaacagatgtggaaaatgagaccatgaatacagtggaaagacaggaggttgtgggccaaggtagaaacaggaatccagccatctgctggtgagcagtgttaggtgtttccaggaacaatgtgtttctagggtgggtagcttgaatgccctggttgaggtgacagggccttatgtggaaagcaaaamggccttaagccccgagccaacccaaatgcattgagtgttaattaagagacatatagtaggctagcaattggaaaaccagcggagaagcaagaaagacagcagtgcatctgtgttttctgcttctacttgagggcagctgagcgtgctggagagaatcttacaatccattgtccagcgcctctatgcatttgcatttcccctcccagctgggctttgacagattctgtcaaatcttctacacaacagggggtgctgctcaggtttttaatcctaggaagcactgtacatcctccacaaaaa

SEQ ID NO: 122249 - DNA, 601 bp, Human
ctacttgagggcagctgagcgtgctggagagaatcttacaatccattgtccagcgcctctatgcatttgcatttcccctcccagctgggctttgacagattctgtcaaatcttctacacaacagggggtgctgctcaggtttttaatcctaggaagcactgtacatcctccacaaaaagaagttaataaattttggctgcaacaaacagctgtagcaggtgtttataagctaatcaacgattggaagtgctttgataaactgacccagtgtcctctcctcccagcgtggtgcctgagaaaygaaggtgtgagttctgtgctcctgggatcatccactcctgaacaactcattgaaaaccttggtgccattcaggcaagtactgcagccccttccaacatcagggaatttaatggtgcctttgaggctatctccaggcagtgtcccatctctccccctctctgtcctgggtggggcaagagtagggggaacaaaggcaacagaacactttcccagtacatggatccagggttgtcctctgcctatgaacaggcagtattcccaaagctcatttcttgggatggtttgtttctgtggaagagt

SEQ ID NO: 122250 - DNA, 601 bp, Human
tggctgcaacaaacagctgtagcaggtgtttataagctaatcaacgattggaagtgctttgataaactgacccagtgtcctctcctcccagcgtggtgcctgagaaatgaaggtgtgagttctgtgctcctgggatcatccactcctgaacaactcattgaaaaccttggtgccattcaggcaagtactgcagccccttccaacatcagggaatttaatggtgcctttgaggctatctccaggcagtgtcccatctctccccctctctgtcctgggtggggcaagagtagggggaacaaasgcaacagaacactttcccagtacatggatccagggttgtcctctgcctatgaacaggcagtattcccaaagctcatttcttgggatggtttgtttctgtggaagagtgcattgcagtgttatacgtggcaactgacttcccaggcctcgccataaaagccggcctgataacttgcttggaaatttaagtcataggacaatatacatacatcatttacttgtttgttctttccacaaatattgcccacctgctgtgtgctgagccccttcttgctgttccctgaacatcttgtattccccc

SEQ ID NO: 122251 - DNA, 601 bp, Human
ctctattttgccaaaccctaaggcttctgaggatagcacttgactggagacaaggtcaccttggccagcaggattgcaacaaaggaagaatgaggttgaaacctcagaattggtcgtcagaattgtatttcaccacagtctccacacagggtcagacttttccagtgagaaagtctgcctttgtcccttgtcttatggtgtaatgtgtacccttggcccacttctcacagtaaatgctagccttggatgagctcatcctttcccggggcttcagtcagcatgtcggtgcaaatgactcacraaccctcaactccagtcctccggcagctactaagctccacagctgcacttgcagctgctcagtcactcctaggtggatattccacaggcactttacactcaacacatcctattctctcccaacttcttattccccaaactacttctcctttggtttctaatctcaataatcaataccaatatacttctagttactcagtcttgaaaccaccatcttcccccaaaatgtctctcaggtccacttttctgctccactgccctagttaaggccctattgcccggcttggattgtaatacatat

SEQ ID NO: 122252 - DNA, 601 bp, Human
caagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaa

SEQ ID NO: 122253 - DNA, 601 bp, Human
tataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgaaactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagt

SEQ ID NO: 122254 - DNA, 601 bp, Human
agatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacayatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagcc

SEQ ID NO: 122255 - DNA, 601 bp, Human
ttgattggtaactacaaagatgtgcatttacatgtgtgagatattaaaatgatggttacatgtatacatatgtaccaaacctgcatggtcagcacatgtatcccagaacttaaagtaaaataaaaaataaaacaatttgaaaaaaaagatggttaatgtaaaataatataataaagattacgtacttcatcataggattcttataaagaagtgtagggaaaatacaaattttaagaagcaaagtttaatcatacttattaagcaagacttttcacaagaattgagtataaattcaatctcyatatttcagttaacttcaaaccttgtttcaaattatcctttccaagtttcaataatatggcaaataggacaaccagtaaacttttattgcttaagaatatcaatctaggccgggcgcggtggctcacgcctgtaattccagcactttgggaggccgaggcaggtggatcacgaggtcaggagatcgagaccatcctggctaacagggtgaaaccccgtctctactaaaaatacaaaaaaattagccgggtgtggtggcgggcgcctgtagtcccagctacttggcaggctgaggcaggag

SEQ ID NO: 122256 - DNA, 601 bp, Human
ttttcctacaaatcttcagtttattaattcaagagaaactatattaggaatattcggctgatacccctatttcaccacctcatctaagctacactgtattataccaagaatggtggcaattttttccccatctatacaggcactgccatctagtggcaagttttcaccagcaattttaaaagatagtggcccaactctggtaacaaatagtggacactgatggtttgtcaaataagcaaatgcatttatttgatacacaaattccatgccaccagtcaaactatggtctggcttttttttytaaccaacagtaaagaaaactttttgggtttttttgtttcttttttgagatggagtctcacccttgccacccaggcagtagtagcacgatctcgactcactgcaacctctgcctcctgggttcaggcagttctcctgcttcagcctcccaagtagctgagattacaggcgcccaccatcacgcctggctaattttggtatttttagtagagacggggtttcaccatgttggccaggagttcaagaaaagttttttaaaaataataaacctctaaagtgttaccctaactgtaccttacag

SEQ ID NO: 122257 - DNA, 601 bp, Human
caattttaaaagatagtggcccaactctggtaacaaatagtggacactgatggtttgtcaaataagcaaatgcatttatttgatacacaaattccatgccaccagtcaaactatggtctggcttttttttttaaccaacagtaaagaaaactttttgggtttttttgtttcttttttgagatggagtctcacccttgccacccaggcagtagtagcacgatctcgactcactgcaacctctgcctcctgggttcaggcagttctcctgcttcagcctcccaagtagctgagattacaggcrcccaccatcacgcctggctaattttggtatttttagtagagacggggtttcaccatgttggccaggagttcaagaaaagttttttaaaaataataaacctctaaagtgttaccctaactgtaccttacagtgatatgtgacttctctagtcactccacattatccagtgatggcacctagataataatgcaccaaagaaaagtaaagaattgcagacttctagaagcaatgatgaaatataattctcagttgcagaaaatgatgatctgggtcattatgcaaatgcattcctgcctgttt

SEQ ID NO: 122258 - DNA, 601 bp, Human
acagtaaagaaaactttttgggtttttttgtttcttttttgagatggagtctcacccttgccacccaggcagtagtagcacgatctcgactcactgcaacctctgcctcctgggttcaggcagttctcctgcttcagcctcccaagtagctgagattacaggcgcccaccatcacgcctggctaattttggtatttttagtagagacggggtttcaccatgttggccaggagttcaagaaaagttttttaaaaataataaacctctaaagtgttaccctaactgtaccttacagtgatatrtgacttctctagtcactccacattatccagtgatggcacctagataataatgcaccaaagaaaagtaaagaattgcagacttctagaagcaatgatgaaatataattctcagttgcagaaaatgatgatctgggtcattatgcaaatgcattcctgcctgtttttcttccaagttcttgcatggagcccaacacatccgatagcatggaagtggaagttaaactcccgatgaataatttttataaaattataaagaaaacaactaataacatgtatgaaattcacattaaatttagaagt

SEQ ID NO: 122259 - DNA, 601 bp, Human; identical to SEQ ID NO: 70577

SEQ ID NO: 122260 - DNA, 601 bp, Human
tcggtaaccgagaatcctagtttttaacgatcatctatccttacttttcctttaaattagggctccattatcttccaccccccccccctttctgagacagtcttttgctgtcactaaggctggagtgcagtggtgtcatctcggctcactgccacctccatctcctgggttcaagggatcctcatgcctcagcatcctgagtagctgggattacagacgtgtgcccccacgtccagctaactttcagtagagcaggttttcaccatattggccaggctggtctttaactcctgacctccgktgattcacccgccttggcctcccaaagtgctagaattatagacgttcagtcactatagttagctgagccttattattgtggaattatggtaatcagaccatactactgagtagaccgtactaaatttctggttttaaaatttaatacatcaacaaaatatttaccataaaggttttaaacattttcaaagttgtttcaaaatagtaatctaattatttcaaaaacggttgtccctgtaattctatgcatccatttactcgaaacataaaagatccttgggcttcactaaactgccacagg

SEQ ID NO: 122261 - DNA, 601 bp, Human
atcctagtttttaacgatcatctatccttacttttcctttaaattagggctccattatcttccaccccccccccctttctgagacagtcttttgctgtcactaaggctggagtgcagtggtgtcatctcggctcactgccacctccatctcctgggttcaagggatcctcatgcctcagcatcctgagtagctgggattacagacgtgtgcccccacgtccagctaactttcagtagagcaggttttcaccatattggccaggctggtctttaactcctgacctccgttgattcacccgcyttggcctcccaaagtgctagaattatagacgttcagtcactatagttagctgagccttattattgtggaattatggtaatcagaccatactactgagtagaccgtactaaatttctggttttaaaatttaatacatcaacaaaatatttaccataaaggttttaaacattttcaaagttgtttcaaaatagtaatctaattatttcaaaaacggttgtccctgtaattctatgcatccatttactcgaaacataaaagatccttgggcttcactaaactgccacagggtccacggcacaa

SEQ ID NO: 122262 - DNA, 601 bp, Human; identical to SEQ ID NO: 65010

SEQ ID NO: 122263 - DNA, 601 bp, Human; identical to SEQ ID NO: 65009

SEQ ID NO: 122264 - DNA, 601 bp, Human; identical to SEQ ID NO: 65008

SEQ ID NO: 122265 - DNA, 601 bp, Human; identical to SEQ ID NO: 65007

SEQ ID NO: 122266 - DNA, 601 bp, Human; identical to SEQ ID NO: 65006

SEQ ID NO: 122267 - DNA, 601 bp, Human; identical to SEQ ID NO: 65005

SEQ ID NO: 122268 - DNA, 601 bp, Human; identical to SEQ ID NO: 65004

SEQ ID NO: 122269 - DNA, 601 bp, Human
gcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtgcaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactsctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgc

SEQ ID NO: 122270 - DNA, 601 bp, Human; identical to SEQ ID NO: 48072

SEQ ID NO: 122271 - DNA, 601 bp, Human; identical to SEQ ID NO: 48071

SEQ ID NO: 122272 - DNA, 601 bp, Human; identical to SEQ ID NO: 48070

SEQ ID NO: 122273 - DNA, 601 bp, Human; identical to SEQ ID NO: 48069

SEQ ID NO: 122274 - DNA, 601 bp, Human; identical to SEQ ID NO: 48068

SEQ ID NO: 122275 - DNA, 601 bp, Human; identical to SEQ ID NO: 48067

SEQ ID NO: 122276 - DNA, 601 bp, Human; identical to SEQ ID NO: 48066

SEQ ID NO: 122277 - DNA, 601 bp, Human; identical to SEQ ID NO: 48065

SEQ ID NO: 122278 - DNA, 601 bp, Human; identical to SEQ ID NO: 48064

SEQ ID NO: 122279 - DNA, 601 bp, Human; identical to SEQ ID NO: 48063

SEQ ID NO: 122280 - DNA, 601 bp, Human; identical to SEQ ID NO: 48062

SEQ ID NO: 122281 - DNA, 601 bp, Human; identical to SEQ ID NO: 48061

SEQ ID NO: 122282 - DNA, 601 bp, Human; identical to SEQ ID NO: 48060

SEQ ID NO: 122283 - DNA, 601 bp, Human; identical to SEQ ID NO: 48059

SEQ ID NO: 122284 - DNA, 601 bp, Human; identical to SEQ ID NO: 48058

SEQ ID NO: 122285 - DNA, 601 bp, Human; identical to SEQ ID NO: 48057

SEQ ID NO: 122286 - DNA, 601 bp, Human; identical to SEQ ID NO: 48056

SEQ ID NO: 122287 - DNA, 601 bp, Human; identical to SEQ ID NO: 48055

SEQ ID NO: 122288 - DNA, 601 bp, Human; identical to SEQ ID NO: 48054

SEQ ID NO: 122289 - DNA, 601 bp, Human; identical to SEQ ID NO: 48053

SEQ ID NO: 122290 - DNA, 601 bp, Human; identical to SEQ ID NO: 48052

SEQ ID NO: 122291 - DNA, 601 bp, Human; identical to SEQ ID NO: 48051

SEQ ID NO: 122292 - DNA, 601 bp, Human; identical to SEQ ID NO: 48050

SEQ ID NO: 122293 - DNA, 601 bp, Human; identical to SEQ ID NO: 48049

SEQ ID NO: 122294 - DNA, 601 bp, Human; identical to SEQ ID NO: 48048

SEQ ID NO: 122295 - DNA, 601 bp, Human; identical to SEQ ID NO: 48047

SEQ ID NO: 122296 - DNA, 601 bp, Human; identical to SEQ ID NO: 48046

SEQ ID NO: 122297 - DNA, 601 bp, Human; identical to SEQ ID NO: 48045

SEQ ID NO: 122298 - DNA, 601 bp, Human; identical to SEQ ID NO: 48044

SEQ ID NO: 122299 - DNA, 601 bp, Human; identical to SEQ ID NO: 48043

SEQ ID NO: 122300 - DNA, 601 bp, Human; identical to SEQ ID NO: 48042

SEQ ID NO: 122301 - DNA, 601 bp, Human; identical to SEQ ID NO: 48041

SEQ ID NO: 122302 - DNA, 601 bp, Human; identical to SEQ ID NO: 48040

SEQ ID NO: 122303 - DNA, 601 bp, Human; identical to SEQ ID NO: 48039

SEQ ID NO: 122304 - DNA, 601 bp, Human; identical to SEQ ID NO: 48038

SEQ ID NO: 122305 - DNA, 601 bp, Human; identical to SEQ ID NO: 48037

SEQ ID NO: 122306 - DNA, 601 bp, Human; identical to SEQ ID NO: 48036

SEQ ID NO: 122307 - DNA, 601 bp, Human; identical to SEQ ID NO: 48035

SEQ ID NO: 122308 - DNA, 601 bp, Human; identical to SEQ ID NO: 48034

SEQ ID NO: 122309 - DNA, 601 bp, Human; identical to SEQ ID NO: 48033

SEQ ID NO: 122310 - DNA, 601 bp, Human; identical to SEQ ID NO: 48032

SEQ ID NO: 122311 - DNA, 601 bp, Human; identical to SEQ ID NO: 48031

SEQ ID NO: 122312 - DNA, 601 bp, Human; identical to SEQ ID NO: 48030

SEQ ID NO: 122313 - DNA, 601 bp, Human; identical to SEQ ID NO: 48029

SEQ ID NO: 122314 - DNA, 601 bp, Human; identical to SEQ ID NO: 48028

SEQ ID NO: 122315 - DNA, 601 bp, Human; identical to SEQ ID NO: 48027

SEQ ID NO: 122316 - DNA, 601 bp, Human
agtgtgatgcactaccctcaaggaacttacaaactcagtagaaaggaagattggataagtccaaaaataatattaagtgctttattggcacttcacatgcttaggactgtgtccacacagcacaaaatgaagcggcaggctggcaagcatccagttgctttaacaaatttggcaatgcattgaaaacatagggctacaatgtcgatcataagatttctggagaagggaactccacaacttccactggtaattggctgctagctgcttcacagactctggcaatggagaagtgaagtcattyttttccccctccatctcttttggttcctaagaactttccttctcagctcaaagtgggaattttggactgagtgatgacaaagatcccaatactaattgcttctggcttagtttcatggttggattaattttaattccttctgtttccaaacccttctgtgctccacactgcactttgcatacatctttattatagaacaattgctgtttattgcaattacctgtatccatgtctgtctcctccagggcaggagatataacatattcatctttctagctctagcttctctaccatattcac

SEQ ID NO: 122317 - DNA, 601 bp, Human
ggttcctaagaactttccttctcagctcaaagtgggaattttggactgagtgatgacaaagatcccaatactaattgcttctggcttagtttcatggttggattaattttaattccttctgtttccaaacccttctgtgctccacactgcactttgcatacatctttattatagaacaattgctgtttattgcaattacctgtatccatgtctgtctcctccagggcaggagatataacatattcatctttctagctctagcttctctaccatattcacttttgctgtgttgggtattatrctcattttgcatattgtaattactgaagagatttttaaaaaagacttgtctgtttgcccactttggtcctgctagaaggtactccatcccatgcttgggttacagtgatgaagcaagaaagtctgtctctgtctcttctttttctgagactcttccggccactaacagcctctctgtacaggcctaccaatactgtccagtcagtagtagattaaggcagctctaggttctaattagcagtgttctatcttaacctagctgcttttaaaactgtatacaaagtttagtgtactcttctgc

SEQ ID NO: 122318 - DNA, 601 bp, Human
ctgtctctgtctcttctttttctgagactcttccggccactaacagcctctctgtacaggcctaccaatactgtccagtcagtagtagattaaggcagctctaggttctaattagcagtgttctatcttaacctagctgcttttaaaactgtatacaaagtttagtgtactcttctgcatgtatgttacattttacaatcaaaagaagtgaaataatgtacatttaaaaatatgtcatctcctaaatgagaaaaatgaggcacagagatgtggcctgatggctgaatgtacagccaggatkgaagctacagtcatcagaacttttgtgttcctaatagctctctgggtttcttgaagccaggaggaggggagaacatcaggttacaattaagaatctctcggctgggtgcagtggctcacgcctgtaatcccagcactttgggaggctgaggcaggtggatcacctgaggtcaggtgtttgagaccagcctgaacaacatggtgaaaccctgtctctactaaaaatacaaaattaggtgggcgtggtggagggcgcctgtaatcccagctacttgggaggctgaggcagaaaaatcctttg

SEQ ID NO: 122319 - DNA, 601 bp, Human
gtagattaaggcagctctaggttctaattagcagtgttctatcttaacctagctgcttttaaaactgtatacaaagtttagtgtactcttctgcatgtatgttacattttacaatcaaaagaagtgaaataatgtacatttaaaaatatgtcatctcctaaatgagaaaaatgaggcacagagatgtggcctgatggctgaatgtacagccaggattgaagctacagtcatcagaacttttgtgttcctaatagctctctgggtttcttgaagccaggaggaggggagaacatcaggttayaattaagaatctctcggctgggtgcagtggctcacgcctgtaatcccagcactttgggaggctgaggcaggtggatcacctgaggtcaggtgtttgagaccagcctgaacaacatggtgaaaccctgtctctactaaaaatacaaaattaggtgggcgtggtggagggcgcctgtaatcccagctacttgggaggctgaggcagaaaaatcctttgaacccagaaggtggaggttgccgtgagccgagatcaggccattgcactccagcctgggcaacaagaacgaaactccatctcaag

SEQ ID NO: 122320 - DNA, 601 bp, Human
atttcaccattttttggttttgttttagtaaagactctggttaaagtatacatactcctcaaaaggggttatatattaacctactatattagttttccatttccatgtacaaattatctccaaacttagtggcttaaaccaacaggaagcatttgttaaacctcacaggttctgtgggtcaagaattctggagtggcttcactgggtgattctggcttaggatctttcagaaggttacagccaaatgtcagctgggctgcaatttgactgggcctaaaggattcacttccaacgtggttcrcttatggctggcaggtcagttctctccatttgagtctctctgtggggctgcttgagtatccttgcaacatggctactggcttccttcaaaacaagcaatctaaaaacccaaggtaaatgttgcaatgcctttatgacctagcctctgaacttgtatgctatcactttggaatgttctagcagtcacacaggtcagctctgatttagtgtggaagcgtctggacaaggacctgaagatctaggattgaggatcactaggggccatctgggaggctggcgaccacacccacctttagctcca

SEQ ID NO: 122321 - DNA, 601 bp, Human
tttcaccattttttggttttgttttagtaaagactctggttaaagtatacatactcctcaaaaggggttatatattaacctactatattagttttccatttccatgtacaaattatctccaaacttagtggcttaaaccaacaggaagcatttgttaaacctcacaggttctgtgggtcaagaattctggagtggcttcactgggtgattctggcttaggatctttcagaaggttacagccaaatgtcagctgggctgcaatttgactgggcctaaaggattcacttccaacgtggttcgyttatggctggcaggtcagttctctccatttgagtctctctgtggggctgcttgagtatccttgcaacatggctactggcttccttcaaaacaagcaatctaaaaacccaaggtaaatgttgcaatgcctttatgacctagcctctgaacttgtatgctatcactttggaatgttctagcagtcacacaggtcagctctgatttagtgtggaagcgtctggacaaggacctgaagatctaggattgaggatcactaggggccatctgggaggctggcgaccacacccacctttagctccaa

SEQ ID NO: 122322 - DNA, 601 bp, Human
tccttgcaacatggctactggcttccttcaaaacaagcaatctaaaaacccaaggtaaatgttgcaatgcctttatgacctagcctctgaacttgtatgctatcactttggaatgttctagcagtcacacaggtcagctctgatttagtgtggaagcgtctggacaaggacctgaagatctaggattgaggatcactaggggccatctgggaggctggcgaccacacccacctttagctccaattttaatttcaagttagctcagaaacaggagaaacatgggggtggactgaggtatggrgggagactttaaagtggccccattgggagtgatagacccaaaagcaagctttatcagcctttccttgccctaaaggcagcttgaatcaggaagaaacagcctttgaaggaagttacagacctcagaacacacccttgcctaaaaagtatagataatatgattcttcctttaaggaaattgggtacagctgtgaaactcttgacaaatttcatgataatcactgttatctgactgggcagcagttttagtggctgctgcctctaccaagttgcagtgtacaatagcaatgtggtctcctcg

SEQ ID NO: 122323 - DNA, 601 bp, Human
gagaaacatgggggtggactgaggtatggagggagactttaaagtggccccattgggagtgatagacccaaaagcaagctttatcagcctttccttgccctaaaggcagcttgaatcaggaagaaacagcctttgaaggaagttacagacctcagaacacacccttgcctaaaaagtatagataatatgattcttcctttaaggaaattgggtacagctgtgaaactcttgacaaatttcatgataatcactgttatctgactgggcagcagttttagtggctgctgcctctaccaagttrcagtgtacaatagcaatgtggtctcctcgtgacttactgtctctgtcttcagaatgtattgaacaatattaattcattggtggttgttttgaaaaacaggtttgtcattacaaatatgatataggttgggtgtgatggctcatgcctattatgtaattccagcactctgggaggctgatgcaggaggatggcttcagcccaggagttcaaaaccagcctggtcaacaaagtgagaccctgtctctacaaaatattagaaaattagccaggtgtggtggtgtgtgcctgtaatccctactc

SEQ ID NO: 122324 - DNA, 601 bp, Human
gccccattgggagtgatagacccaaaagcaagctttatcagcctttccttgccctaaaggcagcttgaatcaggaagaaacagcctttgaaggaagttacagacctcagaacacacccttgcctaaaaagtatagataatatgattcttcctttaaggaaattgggtacagctgtgaaactcttgacaaatttcatgataatcactgttatctgactgggcagcagttttagtggctgctgcctctaccaagttgcagtgtacaatagcaatgtggtctcctcgtgacttactgtctctgycttcagaatgtattgaacaatattaattcattggtggttgttttgaaaaacaggtttgtcattacaaatatgatataggttgggtgtgatggctcatgcctattatgtaattccagcactctgggaggctgatgcaggaggatggcttcagcccaggagttcaaaaccagcctggtcaacaaagtgagaccctgtctctacaaaatattagaaaattagccaggtgtggtggtgtgtgcctgtaatccctactcaggaggcagtggcaggaggatcccttgagcccaggaggctgaggct

SEQ ID NO: 122325 - DNA, 601 bp, Human
cccaggaggctgaggctgcagtgcactgtgattgcctcacagcactccagtatgggcaatagagggagaccgtgtctaaataaagaaagaaagaaaagaaaatagaataaaaacaaatatacagtatacttatttccatgttctattttgctttaaaatgtttattagtatgtttaaaagctggtgtaagatcctcatagatgcattaatcaacacgttcacttgctcatttttcttttaattttagttttcaaaaatacccaaaggctacatccattacaaggtaatggactgcaaaatmttatttaattgcagtgaacatattcactgaaattacagaaaaggaaaaatatgtaattcagtacttctatcaatttaaaagaatcaaaataacctctggtaatgagcaagagagtgattctccatgctctccctctccatctcttccttccttctctcctcactgtagctttgtggattttaagaaagcaggagaccctgggccagagcatcttttgtactcagaaggccctggagacctgtggttgaaaactcctgggagatggatgtatctaacactctcctagcttgattttgatac

SEQ ID NO: 122326 - DNA, 601 bp, Human; identical to SEQ ID NO: 59358

SEQ ID NO: 122327 - DNA, 601 bp, Human; identical to SEQ ID NO: 59357

SEQ ID NO: 122328 - DNA, 601 bp, Human; identical to SEQ ID NO: 59356

SEQ ID NO: 122329 - DNA, 601 bp, Human; identical to SEQ ID NO: 59355

SEQ ID NO: 122330 - DNA, 601 bp, Human; identical to SEQ ID NO: 59354

SEQ ID NO: 122331 - DNA, 601 bp, Human; identical to SEQ ID NO: 59353

SEQ ID NO: 122332 - DNA, 601 bp, Human; identical to SEQ ID NO: 59352

SEQ ID NO: 122333 - DNA, 601 bp, Human
acaattagctttgtccttgcccaggttttcctcaggccttgagggcggcttggggtaaagtgggcaaggggaagagataagtgttaggaggaaccaagtcgaagccattgcaagtccatgcctgggcggggtgttgcttccctatggaaagcttctgacctggagcaaatcactgagccagatcgcgctccctcatctgtaacatgcggaggaggagggtcccatctttttcacgttagtgaggagattacataagagcaggcacctcgcctgctgtatatgccttaaaaatgcgattggwtctgatttcttagttttggtgctttttcaattgctccgtggagagataagggagtcccggaagtgtctaagacattggcgctgggactttcaggagaaagaaagcagcccccctggggaaataaagtccctcagggccctgacctaacacaggtcctttggtagccccaactccccaacatccctccctccctcaccccaggatcctttcaaggcctgctgctccacaagctcagagcagcctccctagccccctggagcccgtcacatttttcaggacagtgggaagcaagtcaggttg

SEQ ID NO: 122334 - DNA, 601 bp, Human; identical to SEQ ID NO: 31371

SEQ ID NO: 122335 - DNA, 601 bp, Human; identical to SEQ ID NO: 31372

SEQ ID NO: 122336 - DNA, 601 bp, Human
cattgtatgctgtgttccctccttttgtcccagttgactttctttaaatttagtttccaagtgctctggttagcataggtgggtcaagactcctactgtgctgtcacactggtttttggatttaagagtcttaccattagtttgaaaaggcacatttgtgaaagctctgtggaaatccttgttgagcgctctcttgagtacgttcaaagtgatgtaggaaaggcttgtggaccagtaactgtcaatggctaaaaccaccgaataggagccaatgactccacaagtcagtatgttcagctgtggaagagtggaagagtttaggcatcatccatgttagaacaaaaatagtttataactctccactggcttcaatcacaggcaatcacatctgctccctcaggcatgaaaaaggaccagacccactcagagctgaacagaagttccctggaaagataaactgaaaacaaccttcaacatccatatgagttcttaaaacacagttcagcttatccaaatactatggaaaatatcttccatatgaaggaacttcaacaataaaatctaattagaggaagaatcactcttctgaagccagttgaaa

SEQ ID NO: 122337 - DNA, 601 bp, Human
cacctgttagctctacattgctgacttcatgatttcatactgcaaaataaaaaatacaagtaaaaggcattcaaagttaagccatgaacccaatgtaaacagtgagtccacttaacagatttttaccgtcaaagcatgtcctgtcatgccactgcacactgtgacatgtgatttcctcatgtatcaggaaagaggaaccaaccaactatctgctcttcccaaacccttctcctgctgctggactctaaaatgctgcacaacttaggccgacccagaacaaatatatgagaactcctctttrtaaattaagtttaaaaagcaagaataggctgactgctgtttaatactgacactggcaccaccattcagtccatctgtaaatggccccatacctcaagacctacatatccaggtcagagtggaagactgggagtccctaggctacaggactggaccttgagactccatattctctgaagccaacagcaatatgccattgaggtgaacttatagattctattctctagtttaactatattaaccttcacaaaatacatatgtggctttcttgtaaaaggctttcaagaaatctaagtattga

SEQ ID NO: 122338 - DNA, 601 bp, Human
tcccaaacccttctcctgctgctggactctaaaatgctgcacaacttaggccgacccagaacaaatatatgagaactcctctttataaattaagtttaaaaagcaagaataggctgactgctgtttaatactgacactggcaccaccattcagtccatctgtaaatggccccatacctcaagacctacatatccaggtcagagtggaagactgggagtccctaggctacaggactggaccttgagactccatattctctgaagccaacagcaatatgccattgaggtgaacttatagattmtattctctagtttaactatattaaccttcacaaaatacatatgtggctttcttgtaaaaggctttcaagaaatctaagtattgaaaatagttacgatgcatgcatgtgaagaacggaccctttcagagaataagctcattgcttcccacataaggtgaaaactagcaatctaatcagattgtagtggtcagccaaatattttttaaatgctaatgcttaaaaatatgggtaggcctcttggccgggcatggtggctcacgcctgtaatcccaacactttgggaggccgaggtgaacagat

SEQ ID NO: 122339 - DNA, 601 bp, Human
ctaatcagattgtagtggtcagccaaatattttttaaatgctaatgcttaaaaatatgggtaggcctcttggccgggcatggtggctcacgcctgtaatcccaacactttgggaggccgaggtgaacagatcacttgaggtcaggagtttgagaccagcctggccaatatggagaaaccccatctctactaaaaatataaaaatgagctgagcatggtagtgtgtgcctataatcccagctactcaggaggctgaggcaggaaaatcacttgaactcgggaggtggaggttgcagtgaacygagactgcgcgactgcactctagcctgggagacagagtgagactccgtctcaggaaaaaaataatgtgtgtgtgtgtgtgtgtgtgtgtatgtgtgtgtgtgtatacatatataggtaggccaggtgcagtggctcaagcctgtaatcccaacactttgggaggccgaggtgggaggactgcctgagcccagtttaagaccaccctaggcaacagtgagactctgtctctactaaaaataaaagcttaccaggcatggcagcacacacctgtagtcccagctacttgggaggctgatgta

SEQ ID NO: 122340 - DNA, 601 bp, Human
caggaggctgaggcaggaaaatcacttgaactcgggaggtggaggttgcagtgaactgagactgcgcgactgcactctagcctgggagacagagtgagactccgtctcaggaaaaaaataatgtgtgtgtgtgtgtgtgtgtgtgtatgtgtgtgtgtgtatacatatataggtaggccaggtgcagtggctcaagcctgtaatcccaacactttgggaggccgaggtgggaggactgcctgagcccagtttaagaccaccctaggcaacagtgagactctgtctctactaaaaataaaarcttaccaggcatggcagcacacacctgtagtcccagctacttgggaggctgatgtaagaggatggcttgagccttagagtttgaggttgcagtgagctatgatagtgtcactgcagtccagcatgggtgacagaaagagatcctgtctctaaaaaataaaaatatgggtttgcacccactagcattgaggagatgatcactctaacggtccttgagctatgagatagttcataaacaaacatatataaagggtatatgctaaaattatttttaccaataggaatagttatgtcaaaaagt

SEQ ID NO: 122341 - DNA, 601 bp, Human
tttttttttttttttttcagtagagatggggaatcactatgttgcccaggctggtctcaaacttgagctcaagcaatcctcccacttggtctcccaaagtgctgggattataggcatgagccaccatgctcagccattaggaagtattttatttagcacatgtagggtagagccttgaatctgtatttcaaaaacatccccatgtgaatctgtcatttcgccaagcctacacaacactgcttttcatcagactatccagtagtcttagaaaaaaaaagtcttcagagagacaagggacacrtgacttgtactctattatatcctgcattctctatagagttgacagcctcatgaaatggctatttttatgtctaacagtcccatcaactttattctagtattttaagaacattgtcacagaaaggaaacaaccaaatagaatacttttgagtacagatgctgtttttgtttgtttttgacaataatcaggaaatgtaagttattaaacaatggcaaagaaagttaacttataagttaaccagattttaaaaactgatagcaattgaattactttttaaaaacaccaaaaaaaccccagaac

SEQ ID NO: 122342 - DNA, 601 bp, Human; identical to SEQ ID NO: 35104

SEQ ID NO: 122343 - DNA, 601 bp, Human; identical to SEQ ID NO: 35105

SEQ ID NO: 122344 - DNA, 601 bp, Human; identical to SEQ ID NO: 36707

SEQ ID NO: 122345 - DNA, 601 bp, Human
atgtaaaatattaataagtgttctttgataaatcattgaaataacaaacccaggagcaaattcttttaattagtgacataaaatcatgttattcttggatggaacataaaatcatgttattcttttccccatgtatattttaaaggctgtttatttgacaatctcaccttttgctttttgttctggatcatctgtttttctatttgtttctgaaaattaaagacaaaacatagtaagtactatgcaagtcaccattcagtatctcaaaatataggacaatatttaaatgaattcaataagyataatcaaagaaaaatatatctgagcatacaattcaattttcctaaatcctgaattcattacacatgaagttcattagaaaagatcaagatttgggcatatttcaattacttatactaaaagtcaccaagcactgactaggcaccaggctaagtactccttgtctataagataagagagttggagtgggtgatgtacatcaactccaagtgtctctaaggtacaaagacatgtggatggggagaagccatcattaaagcttgttcaatattgttattgtctcttaaaaccagaaaactac

SEQ ID NO: 122346 - DNA, 601 bp, Human
acatagtaagtactatgcaagtcaccattcagtatctcaaaatataggacaatatttaaatgaattcaataagtataatcaaagaaaaatatatctgagcatacaattcaattttcctaaatcctgaattcattacacatgaagttcattagaaaagatcaagatttgggcatatttcaattacttatactaaaagtcaccaagcactgactaggcaccaggctaagtactccttgtctataagataagagagttggagtgggtgatgtacatcaactccaagtgtctctaaggtacaaaracatgtggatggggagaagccatcattaaagcttgttcaatattgttattgtctcttaaaaccagaaaactacttgaacaattgacatcatgtgctttaaaggaatgcagcatgtcacactgcttggaatattagtctgctactctaaggacttcacatatacacagatgatccattgggggagcttgtgctgaagcccagatgagaagccagagatgaacccaagaccccacctgtgtcagatgcactaagtaaatcacagtcagtgtctctcccacaaatagaattacctaggacagt

SEQ ID NO: 122347 - DNA, 601 bp, Human
ttttctcctttaaatattttgtcagaacaataaacaccttactaaaaagaatgggatattgatctttaaatattgtcatgcaaccactaaagcaaatcgctttggtggattcagatatactgtactcagccaggcacagtggctcatgcctgtaatcccagcagtttgggaggccgaggcgggcagatcacaaggtcaagagatcgagaccatcctggccaacatggtgaaaccctgtctctactaaaaatacaaaaattagctgggcgtggtggcacgtgcctgtagtcccagctactcrgtaggctgaggcaggagaatcgcttgaatccgggaggcagagcttatagtgagccgagatcgcaccactgcactccagtctggtgacagggcgagactctgagactccgtctcaaaaataaacaaacaaaaaacagatatactgtactcgtgttccagccactgcgctaatctgccagctgagcagttcttgctggactcaaggtacattcaaagtgaatttccacccaggcctgttcatccctctgagtgcattaccacactggcatctgttctttccctgcaccaggacatgagactg

SEQ ID NO: 122348 - DNA, 601 bp, Human
atctttaaatattgtcatgcaaccactaaagcaaatcgctttggtggattcagatatactgtactcagccaggcacagtggctcatgcctgtaatcccagcagtttgggaggccgaggcgggcagatcacaaggtcaagagatcgagaccatcctggccaacatggtgaaaccctgtctctactaaaaatacaaaaattagctgggcgtggtggcacgtgcctgtagtcccagctactcggtaggctgaggcaggagaatcgcttgaatccgggaggcagagcttatagtgagccgagatygcaccactgcactccagtctggtgacagggcgagactctgagactccgtctcaaaaataaacaaacaaaaaacagatatactgtactcgtgttccagccactgcgctaatctgccagctgagcagttcttgctggactcaaggtacattcaaagtgaatttccacccaggcctgttcatccctctgagtgcattaccacactggcatctgttctttccctgcaccaggacatgagactgctctctccctaagcacccagactgaccagtcctcacgtcacagctttccagtctccttctc

SEQ ID NO: 122349 - DNA, 601 bp, Human
aaaaacaacctgttctagaaccccaggggcttcttccttatttagttctccttttctgtccagagaatgaagactggaaatggaaaagagaactttccatatccatttctgcccttccatccactcacgatgaaattaatatcctcccattaaaaagtgatatataaggtggggcagtagttctattttcagtcttttgaggaacctcctagtggttgtactaatttacactcccactaacagtgcatgagggttcctctttctccacatgctcaccagcattcattactgctgtcttttrataaaagtcattttaactcaggtgagatatctcaaggtagttttgatttgcatttctgatgatcaaggatgttgagcaccttttcgtatacctgttttgccatttttatgtcttcttttgagaattcagatctcttgcccattttaaaaatcaggttattagatttttccctatgaagttgtctgagctccttatatattctcattattaatcccttgacagatgggtagtttgcaaatattttgatgtattctgtgggttatcactttactttgttgtttcctttgctgtacagaagct

SEQ ID NO: 122350 - DNA, 601 bp, Human
cctatgaagttgtctgagctccttatatattctcattattaatcccttgacagatgggtagtttgcaaatattttgatgtattctgtgggttatcactttactttgttgtttcctttgctgtacagaagctttgtaacttaatgtgatcccatttttccatttttgctttggttgcctgtgcttttggggtattactcaagaaatcattgcctagaccaaagtcctggacaatttccccattgttttctcttagcaatcccactgctaggtatatatccaaaagaaaagaaattagtataytgaagaaatttacgcactctcatgtttattgcactatttacaatagctaagctttggaatcaacttaagggtctgtcaacagacgaatgaagaaaatgtggtacatatataatggagtactactcagccataaaaaagaataagatcctgccatttgaaacaacatggatggaactggaggtcattatgttaggtgaaataagccaggcacagaaagataaacatcacatgttctcactaatttgtgggtgctaaaaattaaaacaattgaactcacagaggtagagggtagaaggatgg

SEQ ID NO: 122351 - DNA, 601 bp, Human
tgtgggttatcactttactttgttgtttcctttgctgtacagaagctttgtaacttaatgtgatcccatttttccatttttgctttggttgcctgtgcttttggggtattactcaagaaatcattgcctagaccaaagtcctggacaatttccccattgttttctcttagcaatcccactgctaggtatatatccaaaagaaaagaaattagtatattgaagaaatttacgcactctcatgtttattgcactatttacaatagctaagctttggaatcaacttaagggtctgtcaacagaygaatgaagaaaatgtggtacatatataatggagtactactcagccataaaaaagaataagatcctgccatttgaaacaacatggatggaactggaggtcattatgttaggtgaaataagccaggcacagaaagataaacatcacatgttctcactaatttgtgggtgctaaaaattaaaacaattgaactcacagaggtagagggtagaaggatggttaccagaggttgggaagggtagtgaggggagaggggagcaggaggtgaagatggttaatgggtacaaaaatatagttatatac

SEQ ID NO: 122352 - DNA, 601 bp, Human
gatggaactggaggtcattatgttaggtgaaataagccaggcacagaaagataaacatcacatgttctcactaatttgtgggtgctaaaaattaaaacaattgaactcacagaggtagagggtagaaggatggttaccagaggttgggaagggtagtgaggggagaggggagcaggaggtgaagatggttaatgggtacaaaaatatagttatatacaatgaataagatctagtatttgatagcaaaacagagttactatagccaacaataatttattgtacattttctatatctgtatcraaatatctcatatagtcaaatttatacatctattatatactcacaaaaattaaaaatttggggaaaaaaggtggagcaggctgtccagggaataatcaaaacttctaggtgcaggacaaaatctacaaaggatggctgcaggggctatttaattttaatcttgcttcctggcaatgtagcatgatagtaaatgcaaaataagcattatctgttagaaatacgttaactggctgaaggtattcctttgtgattttagttatcaaaaatgctataatcttctaaaatactagtaaggataaa

SEQ ID NO: 122353 - DNA, 601 bp, Human
tctaaaatactagtaaggataaaatgaactgattttattatgtaacaaattaaaaataccttatacttcaaaaataatgacaatatagagaattcttctgtattttattgcactcaacatttaatagaagacatttacattatttttagaaaatccaccgatgttgcacaatggcacatatttgtaaagacaaggctcattaattcagatatttggaattcaaaaatatttaaagttaaccacagcataatgaatcctcaacgtccagagttctacaaaaatccagcaaaacttacttttrctcattcatcagttctatgtcactccttagtttccctaaaaaaatatggctttataaaaagtagcttctataattcacaaaatgaagagttttattataatttgagtatcatctctgtatcaccgacagcacagctttagaaaattattgcttttcttattatcttattatttcaggtttcattacacatcgagtacccatgcaggactcactacattgtataataactatgatctatagtgataaaaatatagaagtatctttgattttaatcctaaaagcagggggaaaaagtcacct

SEQ ID NO: 122354 - DNA, 601 bp, Human
tggtgatgctggtgtaaacaaatctactgcactgccagctgtattaaagcaaaccacatacaattatgcacaatacataatatatgacaatgataataaaggactgttaatggttttactctcctatacttttacggttcttttagactatattcttacttgttaaaaaaaagtttactgtaaaacagcctcaggcaggtccttcaggaggtatccagaagtcattgttatcataggagatgacaactctatgcctgttattacacatgaagacctttcaatgggacaagatgtggcggtrgaagacagtgatattgatgatcctgcaggcctaagctaatatgtctgtctgtgtcttagttttttacaaaaaagtttaaaaagttaaaaaaattgaaaataaaaatgcttataaaataaggatataagaacatttttgtatggctatatgatatgtttgtgttttaaactaatttttattacaaaatcatcaaaaagtttttaaaaattaggtttacaaatttaaaaaaattacagtaaaccaaggttaattattaaagaaaaattttaataaatttactgtagcccaagtgtacagtgt

SEQ ID NO: 122355 - DNA, 601 bp, Human
cataggagatgacaactctatgcctgttattacacatgaagacctttcaatgggacaagatgtggcggtggaagacagtgatattgatgatcctgcaggcctaagctaatatgtctgtctgtgtcttagttttttacaaaaaagtttaaaaagttaaaaaaattgaaaataaaaatgcttataaaataaggatataagaacatttttgtatggctatatgatatgtttgtgttttaaactaatttttattacaaaatcatcaaaaagtttttaaaaattaggtttacaaatttaaaaaaawtacagtaaaccaaggttaattattaaagaaaaattttaataaatttactgtagcccaagtgtacagtgtttataaaatctacagtagggtacagtaatgtcctaggctttcacattcactcaccactcacttgctgattcactcagagcaaattccagtgctgtaagctctactcatgaagtgccctatacaggtatatctttttatttaattttctataccatatttttaccatactttgtctacgtttaggtatgttttcatacacaaatatataccattgcattataactgcctatg

SEQ ID NO: 122356 - DNA, 601 bp, Human
atgcacatcactgctacaaaattcatgttaaaatgtagaaaatataagtaaaggttgaacaaataaatatgacacaaaaataaaatgcagaaatgagaagaaatacacttgggaaagaggtaggattttccaaatcctgtttgatagaacattctttcccactatgagagtacgaggtttataaactcacttctggttgcaggtatagtttatgccatctctaaaatgcatttgaaagcataggctttggtggaaatgctgttaccattctttatattaactggtgacaagagggctcagstagaggaaagtaggaaaaaacagggaaaagtatgtaatgcagtgaactaaaaggaaacaccctgggacactgacaagcactgggcagcctggactgtcacaaagcactaaagatgctctcaggagagatggggaatggagaggaagaggagtaatgtcacaatttatacactattcaactttcatcccaaggcaattctgattccatattctccatcaaatagcctgtcaatcaaagaggaaaacaaaaaaactctaacttccactactaccaccatctataatggcaaaatcatatgat

SEQ ID NO: 122357 - DNA, 601 bp, Human
ttcccctaatttactcaaatggcttttggtaagatcactcacaatctctacgtggccaaatgcaactgataacttctcagtcctgaaattcctgggccactcaacaacaacatgaaacatattcacattttcccttctctacttctccactggctttcctcctcacacaatggctgttcaccttccacccaacctcacaatattagattcttagagctcagtcctgggcatgcctctttatcgtctctccacttgcttccaaaatgatcacatcagtttccatggatttaataccatctcyacgacaatggctcccaaatgtttatattcatcttaaaactcacccaactagctcaggttggcatattcaaccccccacttgatactttcacttggatatatcacataactcccagagttaaaatgtctgatctggggcgttttattttctctcctaaaccagtttcttctataaggttggtgcaaaagtaattgtgggttttgctattacttttgcaccaacctaatacattctaataatagttttcttctctataaatggccccatcatctaatagttactgaaaccaaataaaagacc

SEQ ID NO: 122358 - DNA, 601 bp, Human
gcttaagccagtttgagtttcgttttctattatctgcaactgaaagtaactttactgacacagatggagaataacagaagggtttaaacacagggctgatacaatgagagctatacttttggacagatcatcctaacagtatgtgaaagatgggtttggaggggacaagaacagaatcaagatgtctagctagcagactactgctattatctaggaagatgagaaagggctgagccagacaaggggctatacaagagctatggagaaaaaaatggatttaagaaatgtttagggagtctaytaacaggtcttgggattagctatagagacagagggagagaggactcaaaaacgagttccatgtttctggtctgggaatccaagtatatattgatacaaccggccaagagaagaggagacagggaaaacaaggttggttgctgtgagagataagctcccctcactgtccactcaggcactacaggagcccagcacagaagctgcaggatgggtggcaggtgcatagccaggtgcctcactgcccaggacaggaaactcccttagcagcctctgctatgtcctctgtcaacatatcaaaata

SEQ ID NO: 122359 - DNA, 601 bp, Human
agtcacctgacctcactccagcttcaggtcttcatttgcaaaataagtacaaagatctccacgctccctgtttctcagtgcctactacgaggagcaactgaaataatatatgtgaaataactgtaaaatgctaactaagaactgtatttaaatctaagttctattgaagcgccactgtttaatacatgcaattatttttgtttttcagaaaccatcccttcagttctccaccaccaaaaaaaaaaaaatttgttttgttttcccaggtgagtcatgacataaagacccatctttcaacccrtctctgcccatagctatgcccttctcaccagatcacccctcaggggtggtaacctgctgctactcagggtagccctccacaccctcatcaattgtttgctgttacagtagcctgtttttatcactatcattgtacttctcataatccttaattccgttatttattatctgtttggccactggaatgccagccccaatgaaaagaggactctgtgttttcttccctcttgtactcctagctcctatgcactgtatagacagcaagtaggaaatgttcgataaataactgaataaacaaaca

SEQ ID NO: 122360 - DNA, 601 bp, Human
catttgcaaaataagtacaaagatctccacgctccctgtttctcagtgcctactacgaggagcaactgaaataatatatgtgaaataactgtaaaatgctaactaagaactgtatttaaatctaagttctattgaagcgccactgtttaatacatgcaattatttttgtttttcagaaaccatcccttcagttctccaccaccaaaaaaaaaaaaatttgttttgttttcccaggtgagtcatgacataaagacccatctttcaacccgtctctgcccatagctatgcccttctcaccagmtcacccctcaggggtggtaacctgctgctactcagggtagccctccacaccctcatcaattgtttgctgttacagtagcctgtttttatcactatcattgtacttctcataatccttaattccgttatttattatctgtttggccactggaatgccagccccaatgaaaagaggactctgtgttttcttccctcttgtactcctagctcctatgcactgtatagacagcaagtaggaaatgttcgataaataactgaataaacaaacacaattctcatatggaaggtaaaaccacttcca

SEQ ID NO: 122361 - DNA, 601 bp, Human
tggtttctctgctctgattcctgaattttcacaaaggtattgttttagcatatagtgaataatacactgttcaattagatctatttgtttgaaacagtttatgttctatataacaaagaaatccaaagtagcttaccaaatcatgtcaatctcttaggttatatttactgccttttgctaacattttaaattacatttattatgatactctgccctatgaaaacatataacattcttttcgcatggtatctaattttatacttcttatgagtttgaatttaaattcctctagatttagtcytcaaattgcattccaaacatgttctttatatttttaaaaacattataatgatcagtagaaatgaggaaaatatctcaaatcccatcattacatgcaacttgtatttataaattcctattttctccttcaaattcaagattggaaagaaaatctaagtgcaatctcaagaccaaattattccccaaccttccctcggccccaaatcttcctgtgaacacatcaggtccaaattctttaacttttcataaaaattatcagtaccttaaagacacaacctaggatttttcccatggtgtcatt

SEQ ID NO: 122362 - DNA, 601 bp, Human
tattccccaaccttccctcggccccaaatcttcctgtgaacacatcaggtccaaattctttaacttttcataaaaattatcagtaccttaaagacacaacctaggatttttcccatggtgtcattcatatcccattagaaatagccactatagatgatgaacttggtagggtctcaaatcttaaatcatcatataaatatgattcatatttataaacactcctaattttcttcaattgtgattcactatctatcatgacactgtaaactccttgaaaggagggaccctatgttactcatawttgaattccaggccctaaaaccatctagaacatagaaagtcctccatatccaccaactcaattacgatgtatttcttcatcgttcttgctttacacataaagttatacccaactgacttctctctttctacataatcatctttgaggataatggaataaaaaggatatattattggttctattacttcttagccatacattcttgggcagcttatttataatgtcagaaccttatttctgtcctctgggaagcagggaaaataaaatctacttcatggagttcaacacaatagtctatgc

SEQ ID NO: 122363 - DNA, 601 bp, Human
agtaccttaaagacacaacctaggatttttcccatggtgtcattcatatcccattagaaatagccactatagatgatgaacttggtagggtctcaaatcttaaatcatcatataaatatgattcatatttataaacactcctaattttcttcaattgtgattcactatctatcatgacactgtaaactccttgaaaggagggaccctatgttactcatatttgaattccaggccctaaaaccatctagaacatagaaagtcctccatatccaccaactcaattacgatgtatttcttcatygttcttgctttacacataaagttatacccaactgacttctctctttctacataatcatctttgaggataatggaataaaaaggatatattattggttctattacttcttagccatacattcttgggcagcttatttataatgtcagaaccttatttctgtcctctgggaagcagggaaaataaaatctacttcatggagttcaacacaatagtctatgcaatgcttggacacaagaggagggaggtacaggcctaaactgaatcagatgctgctgatgccacaaatttgccagaactgtt

SEQ ID NO: 122364 - DNA, 601 bp, Human
agcgaaagtacagcaactatggatgggaacagagaaaaacagctgaagaggctttatacccttagggagctgaagggtaaatgtgttgaacacttaacccatacaccccagatagcagaagagctatctgtccgtcaccacacttatgaccttgctaattttatttaatgcatatataaagaataaatatttttattttctgaagacttttaacaaccaacttttaagttcaaactgcatctatgtcctaattaaagatgagatcagaaagtaaggtttctgcaatttgtgaacttcttaraagtgtttcttcctactcccaatctgtgactcctaactttaagaatatcaaattcctcatgcttctgtttatttcagcatcttaactgaaatttgttgtataagcagcatgtagatagaaaaattctgagcaactgtcaatcttactgagccatttaggccaaagactggagagaagaagcaacaggaaatgtggaaatcattttatcagtatccctactcagaaactggaaaccttgtcccaaagaaatcatgacataaatgattactaaaggcataaagttctgaaggtagtctataa

SEQ ID NO: 122365 - DNA, 601 bp, Human
ctttaagaatatcaaattcctcatgcttctgtttatttcagcatcttaactgaaatttgttgtataagcagcatgtagatagaaaaattctgagcaactgtcaatcttactgagccatttaggccaaagactggagagaagaagcaacaggaaatgtggaaatcattttatcagtatccctactcagaaactggaaaccttgtcccaaagaaatcatgacataaatgattactaaaggcataaagttctgaaggtagtctataagtgcttattttcaatgtgtaatgcagcaaaaataaawcatatagatgttcaaaaggattgtgtgcttgtatttttcacagaaaattatgcattatatacaattcttttgaaaaccaaaccatcccatatttttatgggaaagtgcatttcctgttctaaacaataggcatggatataagtttttggaaatacatgtactcataaagtaggagctacctgctgctaaagtaattttccaaaatatttagtattgtgcaaagtagataaactacttttcatttttatgcttttaaaaagtgtttgctaactggacacacaatggctcatgcctgcaatc

SEQ ID NO: 122366 - DNA, 601 bp, Human
ccaaagactggagagaagaagcaacaggaaatgtggaaatcattttatcagtatccctactcagaaactggaaaccttgtcccaaagaaatcatgacataaatgattactaaaggcataaagttctgaaggtagtctataagtgcttattttcaatgtgtaatgcagcaaaaataaatcatatagatgttcaaaaggattgtgtgcttgtatttttcacagaaaattatgcattatatacaattcttttgaaaaccaaaccatcccatatttttatgggaaagtgcatttcctgttctaawcaataggcatggatataagtttttggaaatacatgtactcataaagtaggagctacctgctgctaaagtaattttccaaaatatttagtattgtgcaaagtagataaactacttttcatttttatgcttttaaaaagtgtttgctaactggacacacaatggctcatgcctgcaatcccaacactttggaaagctgaggcaggagaattgcttgaggccaggagtttgagaccagcttgggcaacataaggagaccttgccactataaaaaatttaaaaattggcagggcatggtagcat

SEQ ID NO: 122367 - DNA, 601 bp, Human
catatttttatgggaaagtgcatttcctgttctaaacaataggcatggatataagtttttggaaatacatgtactcataaagtaggagctacctgctgctaaagtaattttccaaaatatttagtattgtgcaaagtagataaactacttttcatttttatgcttttaaaaagtgtttgctaactggacacacaatggctcatgcctgcaatcccaacactttggaaagctgaggcaggagaattgcttgaggccaggagtttgagaccagcttgggcaacataaggagaccttgccactrtaaaaaatttaaaaattggcagggcatggtagcatatgcctgtggttccagctacttgagaggctgaggtgagaggactgcttgagcatgggaggtcaaggctggagtgagctgtgttcaagccgctgcacttaccagccatgttgggtaggattttacaaataagttgtataaaaacacagctacactgacccacttaggaactatcaaaggctgcttttacgctgtgatggcagagttgagtagctgaacagagtctgtacgatccagaaaacctgaaatatttactctctggctatt

SEQ ID NO: 122368 - DNA, 601 bp, Human
gctaggtcacaggtttacctgaatcatactatgcattcaaatgttcctattaggcttcaagttatgcaaagatgcccactttctcttctgtgattaacttctatgatatattgaactgctctgcttcttttgtgtagaggttggacatgttacatgattccactgcaacatggttaagactgggtattgcatcccaatgtaacttgacctggcttccagcagagtatctcctgtgtataatactctaaagaaagtgaatgggcaggacttggctttgcagtgcagctcagggattgggacragtatggggtccggatgcatggctgtagattcaggatcttccataccagctgggtgactgtgggcaaattacttaactaccctgtgccacagatttccctcccataaaatgggaataatatctatttgtaacattgttatgaagattaaaacacttagaaaaatgcctggccctaagtatttaggtgtcattatcatcattattacagtaataacaacattgtcatttgtactgctactgaatccccctaccccacaaccccagcccagactgcaagaagccttccttagttactctccc

SEQ ID NO: 122369 - DNA, 601 bp, Human
tcaaatgttcctattaggcttcaagttatgcaaagatgcccactttctcttctgtgattaacttctatgatatattgaactgctctgcttcttttgtgtagaggttggacatgttacatgattccactgcaacatggttaagactgggtattgcatcccaatgtaacttgacctggcttccagcagagtatctcctgtgtataatactctaaagaaagtgaatgggcaggacttggctttgcagtgcagctcagggattgggacgagtatggggtccggatgcatggctgtagattcaggmtcttccataccagctgggtgactgtgggcaaattacttaactaccctgtgccacagatttccctcccataaaatgggaataatatctatttgtaacattgttatgaagattaaaacacttagaaaaatgcctggccctaagtatttaggtgtcattatcatcattattacagtaataacaacattgtcatttgtactgctactgaatccccctaccccacaaccccagcccagactgcaagaagccttccttagttactctccctttagcgtggcaaggcaatgctctcaggtgttagag

SEQ ID NO: 122370 - DNA, 601 bp, Human
gatttttacactagcaggatttagctttcgtatgcggttgttcagtggaagtattcctgttttctgtagcgaaaccagtctaacattgaacactatctttgagtctcatcatgaaaaatttcctaaggggtcatgagactctaggcatggccaagccctctgcagctgttatatcctccctgtgaagcaggtactggtatcctactttgaaagatgaagaacttgaaaaactgtgctaaagccacatggctaatcaatggcagatacaggacctgaatccagttgtgaatgcaccatgatgggggcagggaggttatgctcagtctgaaagatgtgattgggcggggtgggaaacacatctcagcaaaagatataccaggtgcaggggtgccaaagcagtgataggcttggcaattacaaggaaaagagaggtcagctgggctagagaaaagtcactgaaggggaaaaagaggctgggatcagacaaggcacaactggctgggccacattaagcacaggttatagaggagcaagtatggaaacagggagacccagctggatgctactgtgctactgcaacagtcatggcaagaagccacgg

SEQ ID NO: 122371 - DNA, 601 bp, Human
atgactctccacctacatattccacgtgccagccattctgaactactttcaggtcctttcctgtctctgggatatgccttctgcttaaaacactcaccaccagcactggcctggtgaaggtctacaccagcctcttctgaccccccttctgagtaagacctgaagagcttcccgtattttattaccatgacagcacttaccccattatatttaaatcacttatttatttagattggattttccttctgttaagttaaagttggggtgccgtggggaaggaaggcttgaggaaggggaagcytgcacttgctcatataggcccatgagtggctttccgagctgcaaagaagctagaaataaaggcatacaggctcctacacccctagcatccactggcaaaaaacagtttaaactatagggcattgtttgtttttaagaaacgtaattttattttcctttaggccacccttggatcacaccaaagcatcaggagaatcaggattccagaacatcctgcccactccacaatcccttcatgagatacgttttgggatcacgatctctgtttttatcaagggatgcttcaagaagcagccttata

SEQ ID NO: 122372 - DNA, 601 bp, Human
gtgaagtagaataaagtaagtttagtgctatttcaaaaacaacacctgctatctaactttgaattcaaaaactttttaaaaaacacaaacacccaattaacctttaaattttaaaacaaatgtccaagtcattttacataactaagcgttattttagtaactcaaaacaaagagcagattttaattcataccatgttctgcgtgtaccatttcatggagaagggactgaatttgttcttttgcttcatcttcgatattctggggttctaaaataattgcaaaacatagctaagtagaaaakctcaaacatcaacatggacccctaacactcaaatatgacattggtgcatacacattaaaatgaatatatttgactaagcaactctgcatgccttctctatcagcttacatttttttgttctgtgttggcaaacatggtagatatgtaaaatttgttttattctgtcaacagacttaagcattaaaatactttcaataagatttttaaagaaaactcaggctcagatttgtatttaaaaaagagccttattaaaagcaaaatgacttgtttctaattaataaaattcgcaataatgataaa

SEQ ID NO: 122373 - DNA, 601 bp, Human
ctgctgaaatcaccatccaaagagaatataatctgagttactagaagtggagggtggtgcactctgctcactctttaatggctatctttgcccaaactggtgaaagtctcagttcctaggagcagaatataatacctccacaactgagtcctcacacacttctccagaatcatctgctaccagcactggctttgaacttagtgaggactccatgccatttcaactttccataattttgcaaatactccttctctcctctggaggggattggaagatgcagaagctggagtgtaatgggttaaaaaaaatgaatgaaaaataaggtaaaaaagtaatagtggattcttctttcaaaatcgtggctgttgtagaggggagagggattagatggcagaaaaaagaaatgtgggggtcaagaggggttttattttagtacaaagtaaaatttgaggtgctaaatccaaacacacattaaattataaaactttttaaaagttactatctattctggagctatggtatgatcatagcaattctacaggaatgagagagaatacattgtcctaggattaaaaattcaacaaataacaaaactcagagc

SEQ ID NO: 122374 - DNA, 601 bp, Human
caaataacaaaactcagagcaacatattggccttaaaggaaaaaaaatcaaatattattcctcagcacacagtgaaaaaatcagccaaagtaccatttggattcagtacttaagttttcagtaaatatgtagtgtcattccttaaactttcaataggtggcataagaaaaccagagatttagagactgtattagatttactaacttattaaaatatttcacgactttcctacctatagtcataggctttggggtaactacagagatgcttgatttatgaacccatgtggacacaaaacagkctccatagatgcccacagggaggtttgggaagtcttttaaaataaacgagaccctcatgtaaaaaagactgagaaaccactagatctactctattaaatcacgtgacaaatgataacactagtagtgtagaattgtgtgtatttttactttcaaggtaatatagtacagtagtgctggaattggaatcaagaaacaacattcagttcatgacgttcctaaatgtgtggttttggacaaagaacaactgtctgccttagagctgatcttaaaaattaaaattatcctgttccaatttctac

SEQ ID NO: 122375 - DNA, 601 bp, Human
cctaataagacagcagggtatgttaacatgaaactgattttaaagtcaaggccagtctaaaatctattatattaacttagttatttgaagttatttgatattttgtatgtggaacattaaaataggtcctcaattaaatccaagtatttagaaaacagctaaattcaagagttcaaagattccgtttgctgatcctggactcctcctgacctcattaagaatctcctaccaagagtagtcactgtgcatggacagcctgcggcaggaaggtcaaggtgatgtgaagggcagtattctaatyttaagcagctctgtgcagctcatgtatgcacactaatgtggtctggaaaattttcatttcgatgtattactcttcttttttattatttttcctatgtctcttcatgtttcttttatcgacaaaaacatactcccacattcctcttcccaaatcttaaaagaaacagagacagatacacaggaccctgccacatcacttacatttcctctagttaccatttgcaacactatttccacacaaaactcaccactagtacacctgacaccaacacatacagttgtgttctatacctaagttacc

SEQ ID NO: 122376 - DNA, 601 bp, Human
atttcgatgtattactcttcttttttattatttttcctatgtctcttcatgtttcttttatcgacaaaaacatactcccacattcctcttcccaaatcttaaaagaaacagagacagatacacaggaccctgccacatcacttacatttcctctagttaccatttgcaacactatttccacacaaaactcaccactagtacacctgacaccaacacatacagttgtgttctatacctaagttacctctaactgtaagacaggctgcaaagggattatacacaggtcctaattgtagttcargttcagggaggagagggtagagatgaaggcctagtaaaagacatcacatttcaaattcaaatttagggctgccctcccttttaccatttaaataatcatttttacatccctcaactgttaatggaacaggtatggaatgattcattgccaagttctgctgaatgaatgggaaaaagcttaagaatctcaagaatcaagtaatttatctttgcactctcagcacctcagctaacacttggcacatagcaattgctcaatgaacacttgttgaagggctgaatacacccagtggtgtgacta

SEQ ID NO: 122377 - DNA, 601 bp, Human
ctcttcttttttattatttttcctatgtctcttcatgtttcttttatcgacaaaaacatactcccacattcctcttcccaaatcttaaaagaaacagagacagatacacaggaccctgccacatcacttacatttcctctagttaccatttgcaacactatttccacacaaaactcaccactagtacacctgacaccaacacatacagttgtgttctatacctaagttacctctaactgtaagacaggctgcaaagggattatacacaggtcctaattgtagttcaagttcagggaggagrgggtagagatgaaggcctagtaaaagacatcacatttcaaattcaaatttagggctgccctcccttttaccatttaaataatcatttttacatccctcaactgttaatggaacaggtatggaatgattcattgccaagttctgctgaatgaatgggaaaaagcttaagaatctcaagaatcaagtaatttatctttgcactctcagcacctcagctaacacttggcacatagcaattgctcaatgaacacttgttgaagggctgaatacacccagtggtgtgactactctgctaagtcta

SEQ ID NO: 122378 - DNA, 601 bp, Human
acatagcaattgctcaatgaacacttgttgaagggctgaatacacccagtggtgtgactactctgctaagtctaaatggctgtggagattccctgcagggccagggcttcttaggtgcactccagtagctgagtagaagagggaaggggactcacattagtacttctctactcctatgtaccagagatccgtatttctgctccagcatccaccatttcagtgtcataagtctagtttgcctgagacactcccagtttatgtctgctgtcctgagattatttcactctcaaaactatctgtstgaatgaaaaattacagggtcatccttcactgaccccactttagcaggctctcaaactgtgttccgtgtgttatacaagcaatgaaatgttttctcaccaaacgataaagatctaaactgcctgaaaaccccattcttaatgagttttgaagtttcatttgaaaagtcataatgctacgtgttcaaatactactagtataccaacattccgacatacaatgcccctgagagtcagctttctctaaccaacttgaacttatttgtctctaaaattgaaattgcaaaacataggaaaaacag

SEQ ID NO: 122379 - DNA, 601 bp, Human
atccttcactgaccccactttagcaggctctcaaactgtgttccgtgtgttatacaagcaatgaaatgttttctcaccaaacgataaagatctaaactgcctgaaaaccccattcttaatgagttttgaagtttcatttgaaaagtcataatgctacgtgttcaaatactactagtataccaacattccgacatacaatgcccctgagagtcagctttctctaaccaacttgaacttatttgtctctaaaattgaaattgcaaaacataggaaaaacaggagaaagcaaaagcacagagcraaaaatattgattattttaccctgtccaaagtggaaggtgtattataaaattgttaatacctggtcatagctatttccagatatgaaatcagtacaaaaaaaaattgtaaacttcaaagaagctgagatcatattactgtatctcctcctctagacctctataaactttttgaaacttaacaaaaacacattctagactataattgctttaacaacccatatggaagaatttgccgtacaagattttatttcagtgtttccaaaaaactttttgccacccaagctcattttagttctaaa

SEQ ID NO: 122380 - DNA, 601 bp, Human
tcaaccactcatagcaaatatgagtgacacaaatacccaagcccaggattagcttactttattcactgctgcccataatgagaaagaatcaatatatttctttccataaatatgcagtagttgtaaacttactaaattgtatgttgtatttaatcgttcaacaaatatttagcacctattaattcaaggcattattctacagtaaatgaaaacaacacacctaccttccgggggagagagaaacttaaaaaataagaaacatgaactatttagagtatattggatggggacagatagtacrgggaagacacagaacagggagcacattagggaaaagtgggggtggggactattcataatactttggcaaaaggactcactgataacatgtgaacagaccctgaaggaaatcagggatgtggctatgtaagttacacgtgtgtttcgggtagggaactgcaagttcagtcatgtgttgcttaacaacagcgatacattctgaggaatgtgtggaaatacatgttgaaatgtgccattaggaaattttaccactgtgggaacattgcagtgtgcccaggcaaacttagaaggtatagcctgc

SEQ ID NO: 122381 - DNA, 601 bp, Human
agggtcagagatgtctgagtgcagaggtgatgactgggctgggtcccgtgggagagacaaaggcagcccaccacacagagcaggagcacattcaggagcacgttctaggcagagggactagtgggctgtactgacaatcgtttcagtctcattactttctctctcagccccttgcttattttgcagcatttcactggagggattgcagccacctcaatctcttgtatcccccatgccttgcccagtcccggcatgctgtagatactcagaaatattagttgaatcaataaatgggaactayagacacagcatgttggtgttatataattatcaaaaataacccaacagctttaagcatagatcatctccctctaataggacacaagagaagtgatacataaggcaaagaagatggaaatgagaggcagacttctatgatgtatgcatacctgacttaacatggagcaataaatagatacacaaagtgaaatcaaatgaggcactaaatgagaacaaagaaaaaagaaatggatgactttctgctttgtaaggcttacagagctcttgcagaaattgattcctaggtaaaaacgatagccaa

SEQ ID NO: 122382 - DNA, 601 bp, Human
ttttgcagcatttcactggagggattgcagccacctcaatctcttgtatcccccatgccttgcccagtcccggcatgctgtagatactcagaaatattagttgaatcaataaatgggaactatagacacagcatgttggtgttatataattatcaaaaataacccaacagctttaagcatagatcatctccctctaataggacacaagagaagtgatacataaggcaaagaagatggaaatgagaggcagacttctatgatgtatgcatacctgacttaacatggagcaataaatagatasacaaagtgaaatcaaatgaggcactaaatgagaacaaagaaaaaagaaatggatgactttctgctttgtaaggcttacagagctcttgcagaaattgattcctaggtaaaaacgatagccaaggaataaacatccagcttatacaattatattcttaggcaaatggagaagaaaggataagacaccaaagactgttattgaggaatctttcagattagcccaagctaggtttttcatgaaaataaccttatgggtctgctacatatcacccatcctttagtttcctaaacacaaaaactt

SEQ ID NO: 122383 - DNA, 555 bp, Human
ctgactcccaactacctagtattgtgaattttttgtcccgttgtagctggcttatttaaaaaggtaacctttctggttttaattatacttagaaaacaatatgaagcaaacaatacagaaataacaacctactgaataaaaagtgtaaaactgagagtgcaatgcatgattttaaccctctaatcatgactgaaagcttgtttttagttgaagcttaaatattacgcagttggataaagtgtgacttcaacttcaataaaagttagttgaaacatttacaaaaagaaagaaaagagaaggkgaaaagaagagagatgggaaaaaataaatcaagttctagtctacaagtgcttttaaaggatctttaaatgttttagttgaggtgtttcaattcttgagctaacagtcaaaggaaaaatcaatgagatagccaaaacatttcaaagtactttactaaatagcaatagacaattcttatgtgcttttgatgattaggttattccaaaatattttcactcatttgtttagaatttagtatttatgtattttctgcca

SEQ ID NO: 122384 - DNA, 601 bp, Human
acaattagatatttaatatttgaggcacagaatagtacaaaccatttgtagaattaatttctcactaaaacttcacttttatattaaatgttttctaaggtgctaaattctgatctctagtgaagagattacatttgcaattccttagaaatggtaaataataatgacacaatcaaatatgaaaaatgtatgccattcaaccaaaataatggaaaaaaagtgtgatataaaatgaaagtacattctaatctgaaataattaaaacctttctatagttattctaagactataaaggtatcayaaataaaagtgttctgaaactgttcttctaaatacaattctcccctttattcatggctatggccacagttctcggagcagtgtatgtggcacatggtaagcactaagtatgtactggatgatgggagaagggtgaggttgttgtagggaggtcaggagtgagaagcatgcaggagtgaggggcagcggtgaggtgaggagtgaaggaaaggagagagtaaaagacttggggagggagactagaaaaggggagataagagggaaaaggggaaggagaacccatgaaaagcctgaggaacgg

SEQ ID NO: 122385 - DNA, 601 bp, Human
agactgttcctctagaatggatgtctactcttagtaaaatgcatgtcaggacactacaccaattgcttttttatttttaaatagatgtaataatatagtacagattaaaaaaagaagaagaaaaagctacaaacccaccaaccctctacagtaagtggggaacggaggatcagaacataagaaaactgaaagactaaataagcagaaagggattacatccagagacagagaaaaaaaggtaaaatgcagattcaaatacaaattggagattggaaaggtcacctgaagacttttgttagcrtaggtttgttatagaaactcaaaatgtcatttctattgcaaaaaatatgtccaataattttaccacttatttaaaccagttttttttaaaaaaaaaaaactcagtattttattatgcaaggagtaactcctcatccttcaggacccacaccagcatatgacattattcatatgatattaatgaatatcacatgcaaggcttagcattgaaggagaattcaaataaaaccgaagatctggttcctagtttcaaggagtccacaaactacttaatatctaactcctaagtattacagggtca

SEQ ID NO: 122386 - DNA, 601 bp, Human
gaaattaggctgggtgaatttcattgagtggggctgaagattcctttagaatttaaacctaataaactttgatatttcatagtacccaagtatgaaagcagaagacacaataaatacaaagattgaataaattttcagaaggaacattactgaatgatactcatttgttgcagaacatgctactaagtgacagcttaactgaagtccttgaatatttggaaacagaagctttaacagactatcttctgcattaacagaataaaacatatttgcccattagtgcgggcaagacaaacaagarctttaatagtcactttaatagtcatttaaactttaagagattattgtccagtgtgtatatccacatccaaaagtagctacagaatgtttgctttttaataagattagcaaattggacagtatttgctgacacaggtaaatggtgggcagagggaatggatgtcccatgctgacttgaggctgctactttcaggctgttattatgacagcctacaagagtaattcataacaatttaaatttgtcatagtcccctcagaataaatggatgaatgatacacttattgaaagtaatttgattag

SEQ ID NO: 122387 - DNA, 601 bp, Human
aaatgtgtacttgcctaataaaactttggcatcatccacatcaaaatctccatcaccatcagcatcatagattcctagttttcctataatagggcagaaatgatggatatgggaataaaaaagaaaagaaatttaataaggtattataacttagtgaagtcatgcaactcagtcataaatgttaccaattaatacaattctttgctcttttaatcctgcaaagcagtgtcaaatgaatatcttacctaaaaatagcgagcaattcagttaagagagtcaggaaatgttcagctaataaatkctatgaaataaaactgacacagcattatctttaaagattgaacaacatcctgatctaattagttcagaataatttttattatactgctaaaaatattcttggtaaagtttttagcatatatgaaataatattgatgcattcctaagtcacttgaaatttaatgtttctaaagcatgaaatttcatcacactatcaatatctgaaccaaaagaaacaaccaagcctcaaataaagaccaaatgtaaatagattaacatagaatctaagtactaaaaactaaaaaatcattaattttatatt

SEQ ID NO: 122388 - DNA, 601 bp, Human
tgctatgaaataaaactgacacagcattatctttaaagattgaacaacatcctgatctaattagttcagaataatttttattatactgctaaaaatattcttggtaaagtttttagcatatatgaaataatattgatgcattcctaagtcacttgaaatttaatgtttctaaagcatgaaatttcatcacactatcaatatctgaaccaaaagaaacaaccaagcctcaaataaagaccaaatgtaaatagattaacatagaatctaagtactaaaaactaaaaaatcattaattttataytttacaatgatgacttataacagaaatatcatgaattaacctttaaaaataaaagatcattctggaaataaagtatataaaactggaggcttcggaaattataaaggaaaacttatgattattctacttaacttaatcagcacaggcaatctatactaagaaaaaaagggcttaaaacagatatgctgagaagacaatactaccaaaacctttcctcctgatgaacagaaaatgtttttaggctttagtgctttatcataaggaacactgttattttgtttagcatttcaaaaagtcaaa

SEQ ID NO: 122389 - DNA, 601 bp, Human
aagaccaaatgtaaatagattaacatagaatctaagtactaaaaactaaaaaatcattaattttatattttacaatgatgacttataacagaaatatcatgaattaacctttaaaaataaaagatcattctggaaataaagtatataaaactggaggcttcggaaattataaaggaaaacttatgattattctacttaacttaatcagcacaggcaatctatactaagaaaaaaagggcttaaaacagatatgctgagaagacaatactaccaaaacctttcctcctgatgaacagaaaaygtttttaggctttagtgctttatcataaggaacactgttattttgtttagcatttcaaaaagtcaaatatattcaactccctaaaaaagcatcctaaaatctacatgattctaattcattattggacaatgactgtggagaaacataataatgttaatgtacagcaattttttaaacagctttctcaaatacagcattagtactaaaaaaaaattttggcaattgttatcatttctttaacacaaagtacattaaaaaattacagaagaacaggcagaaattttggctcagattagttct

SEQ ID NO: 122390 - DNA, 601 bp, Human
tatgtctataatttgacaagtaaagcagaagcacaggaagtccaatgcaaggggatatcacccatgcaacattgtacatagacacaagtgtgcattttttccagtgacaggtccacatctttcactggattactaaagaggaggaccattattcacaacagccaaaaagtggaaacaacccaaatgtccatcactgataaacagataaccaaaatgtggtgtgcccatatgatggaatattatgcagccataaaatgaagtactgaactttaaaaacattatgctaagtgcaaaaaggcakatacaaaagatcatataatgtatggttccattacatgaaatgcccagaataaacaaaagcacagacacagaaagtagattagtgtttcccaggagagggaaagaggaagagtttgggtatttaggggaagggggtaacaaaaataatctggaactagataatgctgatgggtatataaaatgatgaatatagtaaaaaaaaactgaattgtacacattcaaatatatataatattgaattttatttcagtttaaaaaaagatttttggggaagtgaaggagaatgtgactccaaaaataa

SEQ ID NO: 122391 - DNA, 601 bp, Human
gtggtgtgcccatatgatggaatattatgcagccataaaatgaagtactgaactttaaaaacattatgctaagtgcaaaaaggcagatacaaaagatcatataatgtatggttccattacatgaaatgcccagaataaacaaaagcacagacacagaaagtagattagtgtttcccaggagagggaaagaggaagagtttgggtatttaggggaagggggtaacaaaaataatctggaactagataatgctgatgggtatataaaatgatgaatatagtaaaaaaaaactgaattgtacayattcaaatatatataatattgaattttatttcagtttaaaaaaagatttttggggaagtgaaggagaatgtgactccaaaaataacaaagaatcattaatgtaaaaaatcatgaaaaacttcagtgattacagaaaaggaaaaaggtggagaaaggacactatcagaaggaccacagcaacttcctcagaacagcacacagatcacacctacacacacacaataatatctacaaacgcctatctcagcacacccatccagtacctatatgtgtgcacacgtactcatcccatcccaacag

SEQ ID NO: 122392 - DNA, 601 bp, Human
taagagggtttacaactccctaagcaaatctgaaaccagtatcttgttccaaaggtatttgggaagaacatctagtagatgtccctattttctaagatcagaataaatctaagtcttcatttcattttctggcttcatgttcaacctgtagttctgggatcagtcaaagcggatttttactggggtttaagaatactgcaagaacgatgcgattcattttttcccatgttattccatcaaaagtacatgacctccaaatcagaaaatgttcccacataccaccaaacacagaaattactayggcaagcaacagtccaaaatgaagactctccaaaacaaaagccgggggaagggcaatgtgtagttttatttatttggttgaggaaagggagacaagaagatgaaccccagcacttgaacagtcaccagctacttcactggcctactactaactgaattatagatcatttataagttttagttagcattatgttgggaatttcatatttacacataaactctacacatttaaagttttttgaaaaacacaaaaactgtcaagcaactcatcaaactgattatttttccatgctataaaatg

SEQ ID NO: 122393 - DNA, 601 bp, Human
ttaactaaccagagagtccctaaaacacagatctgatgtcttcctacctgctcacaaccctctatgacttcccattgcctttgcagcattcaaggccctgagacctcatcagccccaacactctccaccgcaggtgccttaccagctgcccaggctgcagcttccaaagcacagcccactctttcccaaggctgtacctctgtcctgctgttcctgctaccctgaatgccattcctctctttgcatacctgacaaattcctattcatccttcaagaaccaacttcttctggaagccttgcwtgacccccaagtgagtcagactcctgccctggctgacttctagggcagcactccacatgcctgcaactacctgattggcctgcattcctagaactgcccggttcagcaaagatgacagtaagtgtacaatgacttaatgaattagagaggctaaaactgcgttgtccagcatggcaaccactagccacacatggccctttacattcagaataattcaacttaaaattaatgttgttggccaggtacggtggctcacatctgtaatcccagcactttgggaggctaagtcaggcagatcac

SEQ ID NO: 122394 - DNA, 601 bp, Human
gccacacatggccctttacattcagaataattcaacttaaaattaatgttgttggccaggtacggtggctcacatctgtaatcccagcactttgggaggctaagtcaggcagatcacgaggtcaggagttcgagaccagcctggccaacatggtgaaacccccactctaataaaaatacaaaaattagctgagtgtggtggcaggcacctgaagctacttgggaggctggggcaggagaactgcttgaaactggaaggcagaggttgcagtgagctgacatcgcaccactgcactccagcygggggaaaagagcaaaactctgtctcaaataaataaataaatcattgtgttaaatgaataaaaatgcaatgagctgcactagttgcactgcaagtgctcaagagccacatatagttagtggctataatattggacaggacagacacaggacatttccatcatcacaaaaagttctattggacagtgctgacctaagagtggtgatagaacaccagcagatctaggttctagcttcagcttagttcctggttcctactttgcctctctgagactttcctcatctgtgcagcccatcccaca

SEQ ID NO: 122395 - DNA, 601 bp, Human
tctgtaatcccagcactttgggaggctaagtcaggcagatcacgaggtcaggagttcgagaccagcctggccaacatggtgaaacccccactctaataaaaatacaaaaattagctgagtgtggtggcaggcacctgaagctacttgggaggctggggcaggagaactgcttgaaactggaaggcagaggttgcagtgagctgacatcgcaccactgcactccagccgggggaaaagagcaaaactctgtctcaaataaataaataaatcattgtgttaaatgaataaaaatgcaatgagytgcactagttgcactgcaagtgctcaagagccacatatagttagtggctataatattggacaggacagacacaggacatttccatcatcacaaaaagttctattggacagtgctgacctaagagtggtgatagaacaccagcagatctaggttctagcttcagcttagttcctggttcctactttgcctctctgagactttcctcatctgtgcagcccatcccacatgctgtgcaaggccaagcatagacagtacctgacaaggacattccactgattccatcatcccactgctttggat

SEQ ID NO: 122396 - DNA, 601 bp, Human
ggctaagtcaggcagatcacgaggtcaggagttcgagaccagcctggccaacatggtgaaacccccactctaataaaaatacaaaaattagctgagtgtggtggcaggcacctgaagctacttgggaggctggggcaggagaactgcttgaaactggaaggcagaggttgcagtgagctgacatcgcaccactgcactccagccgggggaaaagagcaaaactctgtctcaaataaataaataaatcattgtgttaaatgaataaaaatgcaatgagctgcactagttgcactgcaagtgytcaagagccacatatagttagtggctataatattggacaggacagacacaggacatttccatcatcacaaaaagttctattggacagtgctgacctaagagtggtgatagaacaccagcagatctaggttctagcttcagcttagttcctggttcctactttgcctctctgagactttcctcatctgtgcagcccatcccacatgctgtgcaaggccaagcatagacagtacctgacaaggacattccactgattccatcatcccactgctttggatcagacacacgtggacttggggaa

SEQ ID NO: 122397 - DNA, 601 bp, Human
caaaaattagctgagtgtggtggcaggcacctgaagctacttgggaggctggggcaggagaactgcttgaaactggaaggcagaggttgcagtgagctgacatcgcaccactgcactccagccgggggaaaagagcaaaactctgtctcaaataaataaataaatcattgtgttaaatgaataaaaatgcaatgagctgcactagttgcactgcaagtgctcaagagccacatatagttagtggctataatattggacaggacagacacaggacatttccatcatcacaaaaagttctatwggacagtgctgacctaagagtggtgatagaacaccagcagatctaggttctagcttcagcttagttcctggttcctactttgcctctctgagactttcctcatctgtgcagcccatcccacatgctgtgcaaggccaagcatagacagtacctgacaaggacattccactgattccatcatcccactgctttggatcagacacacgtggacttggggaagcagatgggcaggcggcacctggctgcctagaggtgagggacccaccctcaggctccagcagctcagaataacccagggtc

SEQ ID NO: 122398 - DNA, 601 bp, Human
aggagtggagagtcagaaacgcgctatcagcactgcccgtcctccccacttcctctcttcgaacggatcacatcctgttattgtgtggaaagaaaaggccgggagctggggagggaggcagagctcggaccaagcaagtggggagaggtaggaagagaaaggaggagccagaggaacaggacagtgggcagcagggagctccaccagctccgccctgagccaggtggcctgggcaggagtaggggacccaggagggaggatgagcatccatggggcggcctgcatcccccattgagagatrctggggcccaggacagaaaatggcactccctcctggaggctttccccaagcctcttcctcaggctccttcaatttagctaatgttcaccctggtctctactgccagagcaggatctcccgtggctaccaggcctctctcacacagcacttgcctccagggtggaagggctctgtatccattcccttcaccccacttccacccagcctgtgaacccctgcagacagggccagggcagtcccttgctggctcccctgcactgctcagcaggaattcctgttgctgtgaatgattaagtttcc

SEQ ID NO: 122399 - DNA, 601 bp, Human
tgtatccattcccttcaccccacttccacccagcctgtgaacccctgcagacagggccagggcagtcccttgctggctcccctgcactgctcagcaggaattcctgttgctgtgaatgattaagtttcccacatcttcctcttctttctgtcttctgccattcccaagcataccccctatccaaatcccatttccacgaataataacggctgttttctataaaacataagcacttcacatccattattttgaaatcccatgacagctctgcaagatgggtgttaatatcttcatttaaccratgaagaaactgaacctcagagaggtaaagtgatttacccaaagtcacacagctggaacttaaacccagtggtctgactccaaagatcagcctctttctgttggcccagttgcccttcccattcactgccttctgtgccctggcctctctcttcttgaactgataccaaattgactgccctgactgtccactgggcttgtcctcaagtcgggcccactgcttgaggcaagctgtccagcgcccacactgattgctcatagtcctagcagattgctggggcaggctgagctgctgtgtccc

SEQ ID NO: 122400 - DNA, 601 bp, Human
gctctaaggacaccaactacctgttgactattttgtcttcctttcctgagaggtagtgagcactggctctggactcagatctgactccaatcctaggtaaccttagtcaagctgcttcccctctaggcctcatttcctcctccccacaatggagaggatgacttgggtgacccagacttactccctaccttactctgactcacagttgcagagcctctgttgctggacaccatgcccaacaccatggcctgtgtccccatgggctggtcagtggtactttactcgttcgcaagggcagtgsggccagagggggaacactggcttctagggaacagttagttgttttgcacatagggaaggaggtagcgggcaggcatgaggaggctgggctgccatgagcagaccaaatcaacagcctcccaatcttcctatctccccacctcaccccacccagctccagtatgataaccaggcaactgcggcccagcccaagaaagcccacacttgtcctccctctgcccacagcaacaaaagcagtgcaagggcagagctgtacatctgcccctgactagctcaggaccatggctacagcagaaggcac

SEQ ID NO: 122401 - DNA, 601 bp, Human
actccctaccttactctgactcacagttgcagagcctctgttgctggacaccatgcccaacaccatggcctgtgtccccatgggctggtcagtggtactttactcgttcgcaagggcagtggggccagagggggaacactggcttctagggaacagttagttgttttgcacatagggaaggaggtagcgggcaggcatgaggaggctgggctgccatgagcagaccaaatcaacagcctcccaatcttcctatctccccacctcaccccacccagctccagtatgataaccaggcaactgyggcccagcccaagaaagcccacacttgtcctccctctgcccacagcaacaaaagcagtgcaagggcagagctgtacatctgcccctgactagctcaggaccatggctacagcagaaggcactggagctgcatctctgtaacaatgattctgcctcccacccatctccactctttcattccatgccggcctcaaaactgagattctacacaggggaaccttctcattcggcaaatgctgaaaggaacctgtgccaggtctatcatagggtgctggaggcgaagagatagatcgcacgtgat

SEQ ID NO: 122402 - DNA, 601 bp, Human
cgcaagggcagtggggccagagggggaacactggcttctagggaacagttagttgttttgcacatagggaaggaggtagcgggcaggcatgaggaggctgggctgccatgagcagaccaaatcaacagcctcccaatcttcctatctccccacctcaccccacccagctccagtatgataaccaggcaactgcggcccagcccaagaaagcccacacttgtcctccctctgcccacagcaacaaaagcagtgcaagggcagagctgtacatctgcccctgactagctcaggaccatggctwcagcagaaggcactggagctgcatctctgtaacaatgattctgcctcccacccatctccactctttcattccatgccggcctcaaaactgagattctacacaggggaaccttctcattcggcaaatgctgaaaggaacctgtgccaggtctatcatagggtgctggaggcgaagagatagatcgcacgtgatattgcctcaaggagctcatgttttagtgggaaagcagacaaggaaaggaaggcccgtggggggcaccaaggaggcagttgaccccatagagtagtcaggacagtttgc

SEQ ID NO: 122403 - DNA, 601 bp, Human
atcaacagcctcccaatcttcctatctccccacctcaccccacccagctccagtatgataaccaggcaactgcggcccagcccaagaaagcccacacttgtcctccctctgcccacagcaacaaaagcagtgcaagggcagagctgtacatctgcccctgactagctcaggaccatggctacagcagaaggcactggagctgcatctctgtaacaatgattctgcctcccacccatctccactctttcattccatgccggcctcaaaactgagattctacacaggggaaccttctcattcrgcaaatgctgaaaggaacctgtgccaggtctatcatagggtgctggaggcgaagagatagatcgcacgtgatattgcctcaaggagctcatgttttagtgggaaagcagacaaggaaaggaaggcccgtggggggcaccaaggaggcagttgaccccatagagtagtcaggacagtttgctggatgttgaggacaagttaaccaaatgaaaggagggcagaaagagaggatgggtagattgtcctgggaaaaagaaacaaaaggtgcaaaaactggaaggtcattaaaaaaaataaaata

SEQ ID NO: 122404 - DNA, 601 bp, Human
ggcaactgcggcccagcccaagaaagcccacacttgtcctccctctgcccacagcaacaaaagcagtgcaagggcagagctgtacatctgcccctgactagctcaggaccatggctacagcagaaggcactggagctgcatctctgtaacaatgattctgcctcccacccatctccactctttcattccatgccggcctcaaaactgagattctacacaggggaaccttctcattcggcaaatgctgaaaggaacctgtgccaggtctatcatagggtgctggaggcgaagagatagatcrcacgtgatattgcctcaaggagctcatgttttagtgggaaagcagacaaggaaaggaaggcccgtggggggcaccaaggaggcagttgaccccatagagtagtcaggacagtttgctggatgttgaggacaagttaaccaaatgaaaggagggcagaaagagaggatgggtagattgtcctgggaaaaagaaacaaaaggtgcaaaaactggaaggtcattaaaaaaaataaaataatgtgatctggaatagaaaggatggtacaatcggagcaaagagaataaaaaagtggtgagggtt

SEQ ID NO: 122405 - DNA, 601 bp, Human
acagggcagagcatggtccccaaggactaccctgcctctgccctcctatctgtggttggaagcaccctgaggacaagagcagccaagtcagagcctagcaagatgaacaaggctcaccccaaaaaagccagagttatctgtgaggtccttgaactcacctcttggcacaacttttttcttaatactaatcactttgtaacttactacagaatcaacatatttattacagttgtgtgtgtctgtgtgtttaccgtctcccctgctagaagttaagctccaccagaacaagaacagggatctytgttttattcagtgtgggatccccggtacgtagaacaataccaggcccatactagatgctcaataaatatttgttaaatgaaacagggtgccagttccacatgctgtagtcctaactactcaagggactgagacaaaaaccttctggtttttgcaccttttgtttctttttcaccttgatggcccttgaactcctgagctcagttcaagatcagcctgggcaaaggctagaagaagcaagatcccatatcttgaaaaaatatataaataaatgaaagaaagaaaggaaggcatgatactt

SEQ ID NO: 122406 - DNA, 601 bp, Human
gcctgccacagagcctccactctcgacttccattaccttcagacttcatctctgagtccccaatccttaagagccaggcataagagctgcagccgccgctgcagccgttgagtcatcagggaacctggggccctcctatggtatggccttaatctgtcctgaacctaggatacatacaactgtcccagccatggaagctcaccccaacacaaagaggggatgtctgctgaggcttcctgagatacaagcatgggtgcatgaagccaaggggacaggccccctctatgaggcctgtggagaraaagaatggaaaccctggggaggaaggctgtctcctccccaccaggcctgccttcagggttgagggtggaatcccacttcctaagactacagctgagtcttggaggctccccatgtcaggagaaacaggttcttgccatgacttttctttcaatatcccgtctcaggcctaggggtgcaatgcaagcacagagtcctaaggcccctttgtaaaacttttatttagaaatcttcccgatacatcctcacatatatatacacatcatcaccacatgggttttttttgctaaagagtcacaca

SEQ ID NO: 122407 - DNA, 601 bp, Human; identical to SEQ ID NO: 26649

SEQ ID NO: 122408 - DNA, 601 bp, Human; identical to SEQ ID NO: 75702

SEQ ID NO: 122409 - DNA, 601 bp, Human
gtctcactttgtcgcccaggctggagtgcagtggtacaatctaggctcactgaggcctcgacctcctgggctcaagccaccctcccacctcaaccctcgcaagtagctggcattacaggcaatgccaccatgcccagctaatttttatatttttagtagagacggggtttcaccatgttggccaggctggttttgaactcctgtgctcaagtgatccgctggcctgggcatcccaaagtgctgggattacaggcgtgagccaccacgcccagcctctctataattttatattagtgaggtkgtttgctgaatgtctttattcttcactcaaatgaggtcatatggctgggccctaacccagggcaggactttgtctccttcattactgactgtattcccagagcaaggcccggcacactgtggcccctcaataaatgtcaaatatcggtgaatggggaagaagcggaggaaagacggcttcaccgggaaattcagagcaactacacggcctgcttcctgagagcccaacgggtcagaggggacgctctgggggtcagaaggcaaatgccccaggctcaacagaggcagagtgggagcaggc

SEQ ID NO: 122410 - DNA, 601 bp, Human
gacaggtctttgctcatctgacttcagtgatgggaatatgcccatactcgcttattctaggtagcagagtaccttatgtttccttgaaacatttcatttcttctttattattattattttttttgagatggagtttttcactcttgtcgcccaggctggagtgcccgtggtggtgagaggtgaagccagctggacttcctgggtggagtggtgactaggagaacttttctgtagctaactagaggtttgtaaaatgcaccaatcagtgctctgtaaaaacacaccaatcggtgctccgtakctagctggagatttgtaaaatggaccaatcagcaccctgtaaaatggaccaatcagtgctctgtaaaatgggccaatcagcaggacatgggtggagacaaataaaggaataaaagctgcctccccgaccagcccatccccaccccaacaagccagcagcagaaacccgcttaggttccgttccacgctgtgggagctttgttcttttgctctccacaataaatcttgctgttgctcactctttgggtctgcaccacctttaatagctgtaacactcaccacagaggtttacggcttcatt

SEQ ID NO: 122411 - DNA, 601 bp, Human
ggaaaactctgtctcaaaaaaaaaaaaaaaaaaaaaaaaagtggaaactcacgcatgctcagaccttgactgcctaccaaccactccagtggtcggggtctggccccaagagaccatgaatgtcttaccaattcattcattggaaccatgcacccctgactccctgttctcgccttgacactgaagccaaatgccacttgtcttatgctggcctcctttcacatgagtacatcacagttgcagcccctgctccagatgcatgacgaaatgtaactgaaggggacagtcccaaggtccctctaccacgactatcgggattcttgggaagtctccccatcttaccaagttagtttccccaattaaaaagatattggccgggcgtggtggctcacgcctgtaatcccagcactttaagaggctgaggcaggcggatcacaaggtcaagagattgagaccatcctgcccaacatggtgacaccctgtctctactaaaaatacaaaaattagctggcgtggtggtgcgtgcctgtagtcccagctacgtgggaggctgaaggaggagaatcgcttgaacccgggaggcggaggttgcagtgagtag

SEQ ID NO: 122412 - DNA, 601 bp, Human
acggggtttcactgtgttagccaggatggtctcgatctcctgacctcgtgatctgcccgccttggcctcccaaagtgctgggattacaggcgtgagccactgcacccagccatttttttttttttttttttgaaacagggtctcgctctgttacccaggctggagtacagtggtgcgatcatggctcactgcagcctcaacctcttgggctcaagcaatcctcccgcttcagcctcccaagtggcttggactacaggtgtgtgccatcacacctggctaattttttaaattttttgtagaracaggtctgtgttgcccaggctggtctcaaactcctgggctcaagtaatcctcctgcttcagcctcccaaagtgctgggattataggcataatccgagctaccatactcagcatgatctcaacatgatctcatttttattaacaaaaattacttattttttgtgtttataaggaaaaatccggccaggtgcggtggctcacgcctgtaatccctgcactttgggaggccgaggctggcggatcacgaggtcaggagatccagaccatcctggctaacatggtgaaaccccgtctccacta

SEQ ID NO: 122413 - DNA, 601 bp, Human
caaggtgcaaggcaagtccagctccgatctctcctgaagggaaatattatcaaacattagtctgacattccctgaggtgcaggcacaacctggtgtttaatttccagcctggtggctttttcctcatcagggaccgagctgctcaggtgagcatagtatgtgagcattagggaagctgtgtgctgaccgagaaagtcagtgcggaggtgcctctgccagccagatgaacaggaatgtggcaaaaagtaggtgttgagcaagctacagaaggatgaagaggttttcaaagaatacaaaacaytggccgggcgaggtggctcatgtctgtaatcccagcactttgggaggccaaggtgggtgatcaacttgaggccaggagtttgagaccagcctggctaacatggtgaaaccctgtctctactaaaaatacaaaaaattagtcgaatgtggtggcacatgcctgaagctgaggcaagggagttgcttgagcctgggaggtggaggctgcagtgagcagactgtgccactgcattccagactgggtgacagagcaagactctgtctcaaaacaaaaacaaaaacaaaacaaaatccaacaaaa

SEQ ID NO: 122414 - DNA, 601 bp, Human
ttttcctcatcagggaccgagctgctcaggtgagcatagtatgtgagcattagggaagctgtgtgctgaccgagaaagtcagtgcggaggtgcctctgccagccagatgaacaggaatgtggcaaaaagtaggtgttgagcaagctacagaaggatgaagaggttttcaaagaatacaaaacattggccgggcgaggtggctcatgtctgtaatcccagcactttgggaggccaaggtgggtgatcaacttgaggccaggagtttgagaccagcctggctaacatggtgaaaccctgtctytactaaaaatacaaaaaattagtcgaatgtggtggcacatgcctgaagctgaggcaagggagttgcttgagcctgggaggtggaggctgcagtgagcagactgtgccactgcattccagactgggtgacagagcaagactctgtctcaaaacaaaaacaaaaacaaaacaaaatccaacaaaacacttaattaagatacagctttattggccaggcacggtggctcatgcctgtaatcccagcactttgggaggccaaggcaggtcaatcacctgaggttgggagttcgagaccagactg

SEQ ID NO: 122415 - DNA, 601 bp, Human
gattctctacccttgccctccactacaccaatttccccaagtgtgaaatgcagaactcactaagaaggcactccatggacactttatattagtagttatatgtgtgtgtgtgtgtatttttggagacagggtctcactctgccacctatgctggagtgcagtggcatgatcacagctcactgcagcctggacctcctgggctcaagcaatctttccacctttgcttctggagtagctgggaccacaggtgtgtgccaccatgcctgattttattttttgttgagatggggtctcactctgytgcccagcctggtctcaattgatcctcccactttggcctcccaaagtgttgggattacaggcggagccaccgagccctgctaatgtgtattttataatgtaatgattacagcatcaaacttgtaatttcacaaatatcagtgggtcagaatgaaaaaagtacatttcaagttgatttacaaaattaggtggtaatggggctgtgcatggtggctcatgcctgtaatcccagcactttgggaggccaaggcaggcagactgcttgagtccagaagttcaagactagcctgggcaacatggc

SEQ ID NO: 122416 - DNA, 601 bp, Human
aagttctgatttttaaacatttttaatgaataaaaatggggacgtgaacaaaggaacacccaaatgcagaacttggtagacaaaatctaaaacccccaagctgccacttgtttttgagaacaagtggacagcaaaagggatccccagtctgggagacgcttggctaaatcaagtctgaggcttctttactgcctaatttcagagagaacattctttattgcagggacaacattcacaaacttatttgtgttaagaatccttatttcatagaacatatcatggtctagtactcaatgcaacyctcactgagaaatgctacccaagacccactccacatagagggacatgtaggagaaggctgaggcctggtccatccagcactattgagtagtccacagagccttagaagcatgccattcaggggccttgtactgaggtcagagtgagggaagtagaagcttaagaactttgggccagagctttaaaggtctggagggaggaagactgccggggctctgggatttggtgctggccagcagagtcctagggagcagggactctgcgcactagggaagagatgtgcactggcaggtctggacca

SEQ ID NO: 122417 - DNA, 601 bp, Human; identical to SEQ ID NO: 75702

SEQ ID NO: 122418 - DNA, 601 bp, Human; identical to SEQ ID NO: 122409

SEQ ID NO: 122419 - DNA, 601 bp, Human; identical to SEQ ID NO: 122410

SEQ ID NO: 122420 - DNA, 601 bp, Human; identical to SEQ ID NO: 122411

SEQ ID NO: 122421 - DNA, 601 bp, Human; identical to SEQ ID NO: 122412

SEQ ID NO: 122422 - DNA, 601 bp, Human; identical to SEQ ID NO: 122413

SEQ ID NO: 122423 - DNA, 601 bp, Human; identical to SEQ ID NO: 122414

SEQ ID NO: 122424 - DNA, 601 bp, Human; identical to SEQ ID NO: 122415

SEQ ID NO: 122425 - DNA, 601 bp, Human; identical to SEQ ID NO: 122416

SEQ ID NO: 122426 - DNA, 601 bp, Human
ggctcacgcctgtaatcccggcactttgggaggctgaggtgggtggatcgcttgaagtcaggagttcgagaccagcctggtcaacatggtgaaaccccgtctctaccaaaaatacaaaaattagctgggtgtggtggcacatgcctgtaatcccagctactcaggaggctgaggcatgagaatcacttgaaggttctctgcaggaggcagaggttgcggtgagccaagatcatgtcactgcactccagcctgggctacagagtgagacccggtctcaaaaaaaaaaaaaaaaaaaaaaaaagcatgcatgctcacctctaaatttctaaattttcagggtggaatttcctcattatggcacacagttcagggtcagaggtccgtctttctacttgcctgctatcaagagcaggaaacaggacaggcacagccctaaggcagagcatgcttatcaaagtttctcctagagcctcagggtgattcatcctgcagaggaccgctcttgtgtcctcaagggttccttttggaaaagggcaggatctcgtgtcccctttgagcctctccttcccttcaagagtgataggtttcctccaatctgtcc

SEQ ID NO: 122427 - DNA, 601 bp, Human
acctagaaccagtatctgtgctcaaaatgaaagtgagttttccacaataagcttgcagtttcttctgagttttttgttttctctctttttttttttttcaagaagcctaaatacaagacatggaaccaatttgttcatggaaaaacataaactgctttcactgcctgctataactaacttgtgacttcttccaacactgtgagaagcaagtgtatagaaaaaaaaaagagccatgcaatgaaagcttttcattctttttttatgaggatttaaaacacacacacacacacacacacacacctacacacagatgttgggtttatacaaataatcaaccaaaacatcttccaaccatgtaattttcttctcaagcatataatatgatttttctttttcctggaaactcagtgtcaggatatatgatggtgactattttttaaaaaataattggataattctggggtcagaatgaaaaaaaatatataaatcctatttcaaagtctaataccgaattcatttttaggaagtggatggacatcatctaacactggttgaagtaagctgtctcttcatttgagttcatgttctatcaatttttcca

SEQ ID NO: 122428 - DNA, 601 bp, Human
catgcctataatctcaacactttgaaaggctgaggcagaaggatcggctgagcccaggaatttgagaccagcctgagcaatatagtgagaccttgtctcttcaaaaaattagccagccactggccaaaaagttaaaaaacaaaaaattaaaaatgtatctcagttactgggaggctaagatgaaaggattacttgagcccaggaggcagaggttgcagtgagctgggatcgtgctattgcactctagcctgggttacggagtgagatcctgtctcaaaaacataaaaaataaatgtataaytaagcatcacttaaatttaaactgtgattattcatgacaagtcactttctagtacttgaactgaaactttcggtattcactgttaagaaggcattactcttagcaacaactgtttgtcccaccagactatgaacaatgcttcagggaataataataattattattatataataggaggaggaaaatgaggaagaagaaggaatatcttgagagaggaaacttctctcttactatgaaatctattcttttcatcttttaaatagtcattctcctatttacctatacttggtgatggtaact

SEQ ID NO: 122429 - DNA, 601 bp, Human
agaatccactgttacacacacataggacctccatggtgacatcactgccgtttacttattggctgggaagtgaatgtgaccctggaatcagaagatcttgatttaaatctcaatcctgtcactcctagatacatgactctggccaatcatttttcctctcaagccttgatgttgctcatctgtgaaatgggagtaatactacctacttcacgtggtacttgtgattaaatgacattagataagtgaaaatcccggcagactgccctgtacataaaagtcctccataaatatttataaatgyaggcgtggtggctcatgcctataatctcaacactttgaaaggctgaggcagaaggatcggctgagcccaggaatttgagaccagcctgagcaatatagtgagaccttgtctcttcaaaaaattagccagccactggccaaaaagttaaaaaacaaaaaattaaaaatgtatctcagttactgggaggctaagatgaaaggattacttgagcccaggaggcagaggttgcagtgagctgggatcgtgctattgcactctagcctgggttacggagtgagatcctgtctcaaaaacataaaa

SEQ ID NO: 122430 - DNA, 601 bp, Human
caaccctaattggacagttttgttcttaaaattctactgcatgagctttcaagctgagttccagaatccactgttacacacacataggacctccatggtgacatcactgccgtttacttattggctgggaagtgaatgtgaccctggaatcagaagatcttgatttaaatctcaatcctgtcactcctagatacatgactctggccaatcatttttcctctcaagccttgatgttgctcatctgtgaaatgggagtaatactacctacttcacgtggtacttgtgattaaatgacattagrtaagtgaaaatcccggcagactgccctgtacataaaagtcctccataaatatttataaatgtaggcgtggtggctcatgcctataatctcaacactttgaaaggctgaggcagaaggatcggctgagcccaggaatttgagaccagcctgagcaatatagtgagaccttgtctcttcaaaaaattagccagccactggccaaaaagttaaaaaacaaaaaattaaaaatgtatctcagttactgggaggctaagatgaaaggattacttgagcccaggaggcagaggttgcagtgagctg

SEQ ID NO: 122431 - DNA, 601 bp, Human
ctactgaaaagatttatctgggagtaataaaaaagtgagagtttgagaaacttatgcaagaccatatcaaaaagccctagaagttaagaaattttggcttaacattgacccaaactttcttccaaaaagctaggttaagaaaacatggcaatattatacctcaatacaactgtttaaagaaaaagaacgaaagaaagaaaacaagagtaatggtcattttccaggttttgcgaactagaatcctttccaattcagcaccaaaccggcctttggaagttgtgcacatttaaaaataaaaacytggtgttttcaggagttgggtacagatttatttgtacaataaacatttttagcaaaaagcaggcagatgcttgaattctagcctctaaatccaatgtaggggcactaaaaactccaaccctaattggacagttttgttcttaaaattctactgcatgagctttcaagctgagttccagaatccactgttacacacacataggacctccatggtgacatcactgccgtttacttattggctgggaagtgaatgtgaccctggaatcagaagatcttgatttaaatctcaatcctgtcactc

SEQ ID NO: 122432 - DNA, 601 bp, Human
agaatcgtttgaacccaggaggtggaggttgcagtgactgcactccagcctgggtgacagagtgagactctgtcttaaaaaaaaaaaaaaaaagaaagaaagaaaagaaagaaaaaaaactgcatcagcaagtacgagtttttaaaatgcaaaaatttcccaaatttctactgaaaagatttatctgggagtaataaaaaagtgagagtttgagaaacttatgcaagaccatatcaaaaagccctagaagttaagaaattttggcttaacattgacccaaactttcttccaaaaagctagsttaagaaaacatggcaatattatacctcaatacaactgtttaaagaaaaagaacgaaagaaagaaaacaagagtaatggtcattttccaggttttgcgaactagaatcctttccaattcagcaccaaaccggcctttggaagttgtgcacatttaaaaataaaaacctggtgttttcaggagttgggtacagatttatttgtacaataaacatttttagcaaaaagcaggcagatgcttgaattctagcctctaaatccaatgtaggggcactaaaaactccaaccctaattggacagtt

SEQ ID NO: 122433 - DNA, 601 bp, Human
gcgcatctgtaattccagctactggggaggctgaggccagagaatcgtttgaacccaggaggtggaggttgcagtgactgcactccagcctgggtgacagagtgagactctgtcttaaaaaaaaaaaaaaaaagaaagaaagaaaagaaagaaaaaaaactgcatcagcaagtacgagtttttaaaatgcaaaaatttcccaaatttctactgaaaagatttatctgggagtaataaaaaagtgagagtttgagaaacttatgcaagaccatatcaaaaagccctagaagttaagaaattytggcttaacattgacccaaactttcttccaaaaagctaggttaagaaaacatggcaatattatacctcaatacaactgtttaaagaaaaagaacgaaagaaagaaaacaagagtaatggtcattttccaggttttgcgaactagaatcctttccaattcagcaccaaaccggcctttggaagttgtgcacatttaaaaataaaaacctggtgttttcaggagttgggtacagatttatttgtacaataaacatttttagcaaaaagcaggcagatgcttgaattctagcctctaaatcca

SEQ ID NO: 122434 - DNA, 601 bp, Human
taaaaatacaaaaattagccagacgtggtggtgcgcatctgtaattccagctactggggaggctgaggccagagaatcgtttgaacccaggaggtggaggttgcagtgactgcactccagcctgggtgacagagtgagactctgtcttaaaaaaaaaaaaaaaaagaaagaaagaaaagaaagaaaaaaaactgcatcagcaagtacgagtttttaaaatgcaaaaatttcccaaatttctactgaaaagatttatctgggagtaataaaaaagtgagagtttgagaaacttatgcaagaycatatcaaaaagccctagaagttaagaaattttggcttaacattgacccaaactttcttccaaaaagctaggttaagaaaacatggcaatattatacctcaatacaactgtttaaagaaaaagaacgaaagaaagaaaacaagagtaatggtcattttccaggttttgcgaactagaatcctttccaattcagcaccaaaccggcctttggaagttgtgcacatttaaaaataaaaacctggtgttttcaggagttgggtacagatttatttgtacaataaacatttttagcaaaaagca

SEQ ID NO: 122435 - DNA, 601 bp, Human
taatctcagcactttgggaggccgaggcaggcggatgacctttggtcaggagttcgagaccagcttggccaacatagcagaaccctgtctctgctaaaaatacaaaaattagccagacgtggtggtgcgcatctgtaattccagctactggggaggctgaggccagagaatcgtttgaacccaggaggtggaggttgcagtgactgcactccagcctgggtgacagagtgagactctgtcttaaaaaaaaaaaaaaaaagaaagaaagaaaagaaagaaaaaaaactgcatcagcaagtaygagtttttaaaatgcaaaaatttcccaaatttctactgaaaagatttatctgggagtaataaaaaagtgagagtttgagaaacttatgcaagaccatatcaaaaagccctagaagttaagaaattttggcttaacattgacccaaactttcttccaaaaagctaggttaagaaaacatggcaatattatacctcaatacaactgtttaaagaaaaagaacgaaagaaagaaaacaagagtaatggtcattttccaggttttgcgaactagaatcctttccaattcagcaccaaaccggcc

SEQ ID NO: 122436 - DNA, 601 bp, Human
taaccttaaaaataaatcaggccgggtgctggtggctcacgcttataatctcagcactttgggaggccgaggcaggcggatgacctttggtcaggagttcgagaccagcttggccaacatagcagaaccctgtctctgctaaaaatacaaaaattagccagacgtggtggtgcgcatctgtaattccagctactggggaggctgaggccagagaatcgtttgaacccaggaggtggaggttgcagtgactgcactccagcctgggtgacagagtgagactctgtcttaaaaaaaaaaaaaraaagaaagaaagaaaagaaagaaaaaaaactgcatcagcaagtacgagtttttaaaatgcaaaaatttcccaaatttctactgaaaagatttatctgggagtaataaaaaagtgagagtttgagaaacttatgcaagaccatatcaaaaagccctagaagttaagaaattttggcttaacattgacccaaactttcttccaaaaagctaggttaagaaaacatggcaatattatacctcaatacaactgtttaaagaaaaagaacgaaagaaagaaaacaagagtaatggtcattttcca

SEQ ID NO: 122437 - DNA, 601 bp, Human
aagcaaaaactgacagaactgcacaaggaaacagacaaatttacaaagccacatatttcaatactgctggggatccctgctttatactaataagcagtccatatccatgttgacttgtggcaaagttttattttgacatcttactggtatcatcgtaactagtgctattttgtctggcttgcaggctaaccaggagttagagaagaaggcattttcaggaaagctaaccttaaaaataaatcaggccgggtgctggtggctcacgcttataatctcagcactttgggaggccgaggcaggyggatgacctttggtcaggagttcgagaccagcttggccaacatagcagaaccctgtctctgctaaaaatacaaaaattagccagacgtggtggtgcgcatctgtaattccagctactggggaggctgaggccagagaatcgtttgaacccaggaggtggaggttgcagtgactgcactccagcctgggtgacagagtgagactctgtcttaaaaaaaaaaaaaaaaagaaagaaagaaaagaaagaaaaaaaactgcatcagcaagtacgagtttttaaaatgcaaaaatttcccaaatt

SEQ ID NO: 122438 - DNA, 601 bp, Human
agtatcctattgtaatgttcttatatgatatgtgaagtgatataatatcacttaaaggtagactatgataacttaaagatgtatactctaaatagtttgttggtttgttttttgagacacagtcttgctctgtgcccaggctggagtgtagtggtgtgatctcgtctcactgcaacctctgcctcctggattcaggtgattctcatgcctcggcctcctgagtagctgggactacaggcatgtgccaccacaacccactaatttttgtatttttagaagagatggggtttttgccatgttrgccaggttggtctcaaactcctggcctcaagcaatccacccgcctcagcctcccaaagtgctaagattacaagtgtgagcccctatgcccagattatactgtaaatcttaaagcaaccacaaaataacaaaacaaagacatatagctaattagccaacaaaggagacaaatggaatcattacaaaaacaaacaaacaaacaaacaaaaaaacacctcaatccaaaagaaggcagagaaaccagggaaaagggaataaagaatagacaagatacatagaacacatacagtaagatgacaga

SEQ ID NO: 122439 - DNA, 601 bp, Human
ttatttaagcttttaaaagagaagtgacttctcaaacaataataacttatatggagttaatcacatatgtaaaagtaaactgtacaacaatacaaaggccaagatggaagtatcctattgtaatgttcttatatgatatgtgaagtgatataatatcacttaaaggtagactatgataacttaaagatgtatactctaaatagtttgttggtttgttttttgagacacagtcttgctctgtgcccaggctggagtgtagtggtgtgatctcgtctcactgcaacctctgcctcctggattyaggtgattctcatgcctcggcctcctgagtagctgggactacaggcatgtgccaccacaacccactaatttttgtatttttagaagagatggggtttttgccatgttggccaggttggtctcaaactcctggcctcaagcaatccacccgcctcagcctcccaaagtgctaagattacaagtgtgagcccctatgcccagattatactgtaaatcttaaagcaaccacaaaataacaaaacaaagacatatagctaattagccaacaaaggagacaaatggaatcattacaaaaacaaac

SEQ ID NO: 122440 - DNA, 601 bp, Human
ttactacctgggtaaatacataagagctttctccttattatttaagcttttaaaagagaagtgacttctcaaacaataataacttatatggagttaatcacatatgtaaaagtaaactgtacaacaatacaaaggccaagatggaagtatcctattgtaatgttcttatatgatatgtgaagtgatataatatcacttaaaggtagactatgataacttaaagatgtatactctaaatagtttgttggtttgttttttgagacacagtcttgctctgtgcccaggctggagtgtagtggtrtgatctcgtctcactgcaacctctgcctcctggattcaggtgattctcatgcctcggcctcctgagtagctgggactacaggcatgtgccaccacaacccactaatttttgtatttttagaagagatggggtttttgccatgttggccaggttggtctcaaactcctggcctcaagcaatccacccgcctcagcctcccaaagtgctaagattacaagtgtgagcccctatgcccagattatactgtaaatcttaaagcaaccacaaaataacaaaacaaagacatatagctaattagcc

SEQ ID NO: 122441 - DNA, 601 bp, Human
gaaatagttactacctgggtaaatacataagagctttctccttattatttaagcttttaaaagagaagtgacttctcaaacaataataacttatatggagttaatcacatatgtaaaagtaaactgtacaacaatacaaaggccaagatggaagtatcctattgtaatgttcttatatgatatgtgaagtgatataatatcacttaaaggtagactatgataacttaaagatgtatactctaaatagtttgttggtttgttttttgagacacagtcttgctctgtgcccaggctggagtgyagtggtgtgatctcgtctcactgcaacctctgcctcctggattcaggtgattctcatgcctcggcctcctgagtagctgggactacaggcatgtgccaccacaacccactaatttttgtatttttagaagagatggggtttttgccatgttggccaggttggtctcaaactcctggcctcaagcaatccacccgcctcagcctcccaaagtgctaagattacaagtgtgagcccctatgcccagattatactgtaaatcttaaagcaaccacaaaataacaaaacaaagacatatagcta

SEQ ID NO: 122442 - DNA, 601 bp, Human
caatctataattctatacccagcaaaaatagcttccaaaaataaaactgtagctccaattatacaactagttagcacatggtacttataaaaataaaggcaaaataaggatttatcagacatataaaaatggaatgaattcatcaccagaagtcctacataacaaaaaatgctaaagtaaattattttaagtagaaaaaataatcaggtagaaatatggatatacacaaaggaataaagaacagtggaaatagttactacctgggtaaatacataagagctttctccttattatttaagcwtttaaaagagaagtgacttctcaaacaataataacttatatggagttaatcacatatgtaaaagtaaactgtacaacaatacaaaggccaagatggaagtatcctattgtaatgttcttatatgatatgtgaagtgatataatatcacttaaaggtagactatgataacttaaagatgtatactctaaatagtttgttggtttgttttttgagacacagtcttgctctgtgcccaggctggagtgtagtggtgtgatctcgtctcactgcaacctctgcctcctggattcaggtgattct

SEQ ID NO: 122443 - DNA, 601 bp, Human
aaattgtcaatctataattctatacccagcaaaaatagcttccaaaaataaaactgtagctccaattatacaactagttagcacatggtacttataaaaataaaggcaaaataaggatttatcagacatataaaaatggaatgaattcatcaccagaagtcctacataacaaaaaatgctaaagtaaattattttaagtagaaaaaataatcaggtagaaatatggatatacacaaaggaataaagaacagtggaaatagttactacctgggtaaatacataagagctttctccttattayttaagcttttaaaagagaagtgacttctcaaacaataataacttatatggagttaatcacatatgtaaaagtaaactgtacaacaatacaaaggccaagatggaagtatcctattgtaatgttcttatatgatatgtgaagtgatataatatcacttaaaggtagactatgataacttaaagatgtatactctaaatagtttgttggtttgttttttgagacacagtcttgctctgtgcccaggctggagtgtagtggtgtgatctcgtctcactgcaacctctgcctcctggattcagg

SEQ ID NO: 122444 - DNA, 601 bp, Human
ggcaggaagactgagcccaagagtttgaggctacagtgggctatgactgcaccactgcactctgccctggatgacacagtgagacttcactttttaaaaaataaaaatactaaatgcaattagaaaaaaaggacatatcacataaacaaaagaaggtaagaatgatagcagattttatgtcaaaagcaaggcaagtgtaaaatagtgaagcaaaatctttcataaactaagaagaaaaaattgtcaatctataattctatacccagcaaaaatagcttccaaaaataaaactgtagctccrattatacaactagttagcacatggtacttataaaaataaaggcaaaataaggatttatcagacatataaaaatggaatgaattcatcaccagaagtcctacataacaaaaaatgctaaagtaaattattttaagtagaaaaaataatcaggtagaaatatggatatacacaaaggaataaagaacagtggaaatagttactacctgggtaaatacataagagctttctccttattatttaagcttttaaaagagaagtgacttctcaaacaataataacttatatggagttaatcacata

SEQ ID NO: 122445 - DNA, 601 bp, Human
aaacaaaacatcttaaaagcagctgggcgtggtggcatgtgcctgtagtcccagttgctcgggaggctgaggcaggaagactgagcccaagagtttgaggctacagtgggctatgactgcaccactgcactctgccctggatgacacagtgagacttcactttttaaaaaataaaaatactaaatgcaattagaaaaaaaggacatatcacataaacaaaagaaggtaagaatgatagcagattttatgtcaaaagcaaggcaagtgtaaaatagtgaagcaaaatctttcataaactaaraagaaaaaattgtcaatctataattctatacccagcaaaaatagcttccaaaaataaaactgtagctccaattatacaactagttagcacatggtacttataaaaataaaggcaaaataaggatttatcagacatataaaaatggaatgaattcatcaccagaagtcctacataacaaaaaatgctaaagtaaattattttaagtagaaaaaataatcaggtagaaatatggatatacacaaaggaataaagaacagtggaaatagttactacctgggtaaatacataagagctttctcc

SEQ ID NO: 122446 - DNA, 601 bp, Human
atgaaaaacagaaaagaaagtttaaaaaaaatgaacaaagcatgagtgagctgtggagacaactttaagcagcctaaacacatgtaattggattccacatggggggcacagagggatagaaaatgatatttaaagaaataatggctgaaaaaatatgccaaacctaataaaaatataaacccaaagatccaaggagctcatttaattccaagcacaagaaatataaactaacgtatatcaaagcacattgcaaattgcttaaaaccaggaacaaacaaaacatcttaaaagcagctgggcrtggtggcatgtgcctgtagtcccagttgctcgggaggctgaggcaggaagactgagcccaagagtttgaggctacagtgggctatgactgcaccactgcactctgccctggatgacacagtgagacttcactttttaaaaaataaaaatactaaatgcaattagaaaaaaaggacatatcacataaacaaaagaaggtaagaatgatagcagattttatgtcaaaagcaaggcaagtgtaaaatagtgaagcaaaatctttcataaactaagaagaaaaaattgtcaatctataattcta

SEQ ID NO: 122447 - DNA, 601 bp, Human
atgaatatataaaaacacaaatcaaatttctagaaataatatctacaatgtgcgagatgaacagtagactggataggattaatagcaggtagacatttcagaagaaaagactattgaacttgaagacatagcaatagaaatatccaaaatgaaaaacagaaaagaaagtttaaaaaaaatgaacaaagcatgagtgagctgtggagacaactttaagcagcctaaacacatgtaattggattccacatggggggcacagagggatagaaaatgatatttaaagaaataatggctgaaaaawtatgccaaacctaataaaaatataaacccaaagatccaaggagctcatttaattccaagcacaagaaatataaactaacgtatatcaaagcacattgcaaattgcttaaaaccaggaacaaacaaaacatcttaaaagcagctgggcgtggtggcatgtgcctgtagtcccagttgctcgggaggctgaggcaggaagactgagcccaagagtttgaggctacagtgggctatgactgcaccactgcactctgccctggatgacacagtgagacttcactttttaaaaaataaaaatact

SEQ ID NO: 122448 - DNA, 601 bp, Human
aaaactcataattcacaagcactgggtactcagaaagatgttgcttaacccatttatgctggaggttgcaaattttttgtgtgtgagaaatcagaccttggtgatgaccttaagcaataggatataaataactcccacaagcttagtgttccaattatggaacactcggtataaacgggttaagaaataattatccctgtctaattagcactgctcctacctaataaatcttgaaagtaagacaaaagaatcaactgtctccaagtaatttatctacatcccaaaacaaagctcaacaatrtttccatccccccagaagataacattgcaatgtctggcatcctgtcaaaaattaccaggcatgcaaaaaggcaggaaaatacaacccacaacgaggagcaatgtcaatcaactgaaactgaccaagagttaagaaaggtattagaattagcagacaaggacaaatattcaagattttaggcagagatatgaatatataaaaacacaaatcaaatttctagaaataatatctacaatgtgcgagatgaacagtagactggataggattaatagcaggtagacatttcagaagaaaagacta

SEQ ID NO: 122449 - DNA, 601 bp, Human
agatgtagctttgaaactgatattttttgtttcaaaaagtcaaattaattattctaaaaaagatgaaccagttttgtcaagttgaatgcgaatatcgtggagaatgattttttgatgctgagttcagttgctggagaacttgtatatttggggtttggttaacaaatatactttttcaactataaattttataaaagctaaatatagaccaagtatttcagataaaaatgtagtatctgatagctataacatacatatcaaattttaagacttactataaaatttaagaaaaaatgtctcwttaatatttttacattgattacatgttgaaataacattttgggtagactgagttaaagaaaatatataattaaattaatttcacctgtttcgtggccaggcgcagtggctcacacctgtaatcccagcactttgggaggccgaggcgggtggatcatgaggtcaggagatggagaccatcctggctaacatggtgaaatcccgtttctactaaaaatacaaaaattagccaggcgtggtggcacatcgctgtagatccagctgctcgggaggctgaggcaggagaatcgcttgaacccag

SEQ ID NO: 122450 - DNA, 601 bp, Human
aatcaatgatatctcaagggccactagtgttgggtgggaaggcttgggaagcaatgtcatcatctaattcctaccttgtatagacagaaaaatgaggtttagagagtgggaagttacttggctgaggctactcacctagacggtgtcagaactgggactggaacccaggcagcttagggttgttgctgccatttcagagggccattccttcatttagatggccccataacaaaccagtgcaaagctatcctgagtcatctccatcccgagggattttccggaaggcactttgaaattacakaacgacatagatgaaccaatacttaaacctcaaaaaaggcgaagactatgggttcagattttattattttatttagaaacaacatgaggtgaggtgaactgattggacacattcaccacgagtctttcctaatttctaatacaaggtggagcaatagaaaaaaatagaaaataaggagaacaaagtctttttctcaacttttttaggattctagactatactattcagtgttactaaagcacactttgtattttatgaatcatcagtgatgagtaagtacagattaagctctatctgaac

SEQ ID NO: 122451 - DNA, 601 bp, Human
atagacaattcataaatgaatgagtgtagctgtgttccaataaaactttatttacacaacaggtggcaagagggatttggcctgcaggctgctatttgccgaccactgatctattccagcatttcccaaactatgtactacaggatactccaatatacttgaagcttttcctccaaaagagggagagtttccagttcaaagagtttagaaaatgctaggtttaaaaatgttaagcagatttctttacttcaaggcttcttgcagtctctaatgtgcttatgagcttttggaagccaaatayggaatagaattcagcacacagcatttctccaatttccatggatatactggagaagcacccaatcaatgatatctcaagggccactagtgttgggtgggaaggcttgggaagcaatgtcatcatctaattcctaccttgtatagacagaaaaatgaggtttagagagtgggaagttacttggctgaggctactcacctagacggtgtcagaactgggactggaacccaggcagcttagggttgttgctgccatttcagagggccattccttcatttagatggccccataacaaaccagtgc

SEQ ID NO: 122452 - DNA, 601 bp, Human
tcatgaatcactttgaaaataatcctgtgtgtaggagtcagcaaattttttttttctgtaaataaccagatggtaaatatatttttggcagtatgggccatacaggtctctgtcacaactctgcaacttggctattctggggcaaatagacaattcataaatgaatgagtgtagctgtgttccaataaaactttatttacacaacaggtggcaagagggatttggcctgcaggctgctatttgccgaccactgatctattccagcatttcccaaactatgtactacaggatactccaatayacttgaagcttttcctccaaaagagggagagtttccagttcaaagagtttagaaaatgctaggtttaaaaatgttaagcagatttctttacttcaaggcttcttgcagtctctaatgtgcttatgagcttttggaagccaaatatggaatagaattcagcacacagcatttctccaatttccatggatatactggagaagcacccaatcaatgatatctcaagggccactagtgttgggtgggaaggcttgggaagcaatgtcatcatctaattcctaccttgtatagacagaaaaatga

SEQ ID NO: 122453 - DNA, 601 bp, Human
caactattagtaataaccactaaaataattttaacaggaaccattaaaaatgtgttgcttctggaacaaagctattgcttttcatttacagcattcctccacgatctgattttttcagccatgttcatgaatcactttgaaaataatcctgtgtgtaggagtcagcaaattttttttttctgtaaataaccagatggtaaatatatttttggcagtatgggccatacaggtctctgtcacaactctgcaacttggctattctggggcaaatagacaattcataaatgaatgagtgtagctktgttccaataaaactttatttacacaacaggtggcaagagggatttggcctgcaggctgctatttgccgaccactgatctattccagcatttcccaaactatgtactacaggatactccaatatacttgaagcttttcctccaaaagagggagagtttccagttcaaagagtttagaaaatgctaggtttaaaaatgttaagcagatttctttacttcaaggcttcttgcagtctctaatgtgcttatgagcttttggaagccaaatatggaatagaattcagcacacagcatttctcca

SEQ ID NO: 122454 - DNA, 601 bp, Human
catggtgaaaccccgtctctactaaaaatacaaaagaattagctgggtgtggtggcgggcacctataatcccagctactcaggaagctgaggtaggagaattgcttgaatctgggaggcagttgcagtgagccaaggtggcaccactgcactccagcctaagcgacagagtgacagtccatctcaaaaaagaaaaaagaaaaaaaaaaactgcagtggtaatcaagagaggaattcatgtactgataaaactaagaagttgtacatgcctctgtgtgtgtgtgtgtgtgtgtgtgtgtgtgcatgtgaacgtggtctatcaaacagaggcaacccaaagcacatacatcagaaacggctgagtgaggagttatacaactattagtaataaccactaaaataattttaacaggaaccattaaaaatgtgttgcttctggaacaaagctattgcttttcatttacagcattcctccacgatctgattttttcagccatgttcatgaatcactttgaaaataatcctgtgtgtaggagtcagcaaattttttttttctgtaaataaccagatggtaaatatatttttggcagtatgggccatac

SEQ ID NO: 122455 - DNA, 601 bp, Human
aggagttcgagaccagcctggccaacatggtgaaaccccgtctctactaaaaatacaaaagaattagctgggtgtggtggcgggcacctataatcccagctactcaggaagctgaggtaggagaattgcttgaatctgggaggcagttgcagtgagccaaggtggcaccactgcactccagcctaagcgacagagtgacagtccatctcaaaaaagaaaaaagaaaaaaaaaaactgcagtggtaatcaagagaggaattcatgtactgataaaactaagaagttgtacatgcctctgtgtgtgtgtgtgtgtgtgtgtgtgtgtgcatgtgaacgtggtctatcaaacagaggcaacccaaagcacatacatcagaaacggctgagtgaggagttatacaactattagtaataaccactaaaataattttaacaggaaccattaaaaatgtgttgcttctggaacaaagctattgcttttcatttacagcattcctccacgatctgattttttcagccatgttcatgaatcactttgaaaataatcctgtgtgtaggagtcagcaaattttttttttctgtaaataaccagatggtaaat

SEQ ID NO: 122456 - DNA, 601 bp, Human
agatggacaacaggaaaagagaggaatgcggaaggttagtggtactagtcccctcatcttataaaatttggcacctaataggtaggaaataaatgcaacaagatatagaggtttatgaacattaaaactgcaatggtagggctgggcacggtggctcaggcctgtaatcccagcactttgggaggctgaggcaggtggatcacttgagatcaggagttcgagaccagcctggccaacatggtgaaaccccgtctctactaaaaatacaaaagaattagctgggtgtggtggcgggcacctrtaatcccagctactcaggaagctgaggtaggagaattgcttgaatctgggaggcagttgcagtgagccaaggtggcaccactgcactccagcctaagcgacagagtgacagtccatctcaaaaaagaaaaaagaaaaaaaaaaactgcagtggtaatcaagagaggaattcatgtactgataaaactaagaagttgtacatgcctctgtgtgtgtgtgtgtgtgtgtgtgtgtgtgcatgtgaacgtggtctatcaaacagaggcaacccaaagcacatacatcagaaacggctgagtga

SEQ ID NO: 122457 - DNA, 601 bp, Human
gccaagtgtggtggtgcaccctgtaatcccaactactcaggaggctgaggcacaaaaatcacttgaactcgggaggtagaggttgcagtgagccgagatcacgccattacactccagcctgggtgacacaaagtgagactctgtctcaaggaaaaaaaaaaaaagtgccatgatttagagcaactggtaaaaatgagcagaatgaactcaattggaaaagatattagagcagctgggcacggtggcacatgcctgtaattccagcactttgggaggtcaaggcgggtggattacagtacakgtactaaaattggaatgatatactaaaattggaagatcagcatggcccctgcgcaaggatgacatgcaaattcatgacgtgttcaatattttttatatattttaataaaaatataaaaatttaaaaaattttaaagaaaaagatattaagaactatctattttgagtgatgctgcagttgtgatattagaattatagagagggaagtataatcacagcaagcactgcttggctcttctacagacagtatttacattaacactgctcattggcttgtgctgcggtttggatattcgaccct

SEQ ID NO: 122458 - DNA, 601 bp, Human
taaaaatgcaaaaattagccaagtgtggtggtgcaccctgtaatcccaactactcaggaggctgaggcacaaaaatcacttgaactcgggaggtagaggttgcagtgagccgagatcacgccattacactccagcctgggtgacacaaagtgagactctgtctcaaggaaaaaaaaaaaaagtgccatgatttagagcaactggtaaaaatgagcagaatgaactcaattggaaaagatattagagcagctgggcacggtggcacatgcctgtaattccagcactttgggaggtcaaggcrggtggattacagtacaggtactaaaattggaatgatatactaaaattggaagatcagcatggcccctgcgcaaggatgacatgcaaattcatgacgtgttcaatattttttatatattttaataaaaatataaaaatttaaaaaattttaaagaaaaagatattaagaactatctattttgagtgatgctgcagttgtgatattagaattatagagagggaagtataatcacagcaagcactgcttggctcttctacagacagtatttacattaacactgctcattggcttgtgctgcgg

SEQ ID NO: 122459 - DNA, 601 bp, Human
tacgtctcaataaataaataaacctcaagggaaaacaaatgccaccaacaaaaagcaggagagacatggttcaaatgcaccatgactggacaggcgacactactcacgcctgtaatcccagcactttgggaggccaaggcgggcagatcacctgaggtcaggggttccagaccagcctggccaacatggtgaaactccgtttatactaaaaatgcaaaaattagccaagtgtggtggtgcaccctgtaatcccaactactcaggaggctgaggcacaaaaatcacttgaactcgggaggtrgaggttgcagtgagccgagatcacgccattacactccagcctgggtgacacaaagtgagactctgtctcaaggaaaaaaaaaaaaagtgccatgatttagagcaactggtaaaaatgagcagaatgaactcaattggaaaagatattagagcagctgggcacggtggcacatgcctgtaattccagcactttgggaggtcaaggcgggtggattacagtacaggtactaaaattggaatgatatactaaaattggaagatcagcatggcccctgcgcaaggatgacatgcaaattcatga

SEQ ID NO: 122460 - DNA, 601 bp, Human
tggtgagatcgtgccactgcactccagcctgggtgacagagcaagactacgtctcaataaataaataaacctcaagggaaaacaaatgccaccaacaaaaagcaggagagacatggttcaaatgcaccatgactggacaggcgacactactcacgcctgtaatcccagcactttgggaggccaaggcgggcagatcacctgaggtcaggggttccagaccagcctggccaacatggtgaaactccgtttatactaaaaatgcaaaaattagccaagtgtggtggtgcaccctgtaatcccwactactcaggaggctgaggcacaaaaatcacttgaactcgggaggtagaggttgcagtgagccgagatcacgccattacactccagcctgggtgacacaaagtgagactctgtctcaaggaaaaaaaaaaaaagtgccatgatttagagcaactggtaaaaatgagcagaatgaactcaattggaaaagatattagagcagctgggcacggtggcacatgcctgtaattccagcactttgggaggtcaaggcgggtggattacagtacaggtactaaaattggaatgatatactaaaatt

SEQ ID NO: 122461 - DNA, 601 bp, Human
ctctactaaaaatacaaaaattagctgggcatggtgacgcacgcctgtggtcccagctactgtggagactgaggcaggagaaccacttgaacctgggaggtggaaattgtactgtggtgagatcgtgccactgcactccagcctgggtgacagagcaagactacgtctcaataaataaataaacctcaagggaaaacaaatgccaccaacaaaaagcaggagagacatggttcaaatgcaccatgactggacaggcgacactactcacgcctgtaatcccagcactttgggaggccaaggygggcagatcacctgaggtcaggggttccagaccagcctggccaacatggtgaaactccgtttatactaaaaatgcaaaaattagccaagtgtggtggtgcaccctgtaatcccaactactcaggaggctgaggcacaaaaatcacttgaactcgggaggtagaggttgcagtgagccgagatcacgccattacactccagcctgggtgacacaaagtgagactctgtctcaaggaaaaaaaaaaaaagtgccatgatttagagcaactggtaaaaatgagcagaatgaactcaattggaa

SEQ ID NO: 122462 - DNA, 601 bp, Human
agtcaggagttcgagacaagcctggacaacatgatgaaaccctgtctctactaaaaatacaaaaattagctgggcatggtgacgcacgcctgtggtcccagctactgtggagactgaggcaggagaaccacttgaacctgggaggtggaaattgtactgtggtgagatcgtgccactgcactccagcctgggtgacagagcaagactacgtctcaataaataaataaacctcaagggaaaacaaatgccaccaacaaaaagcaggagagacatggttcaaatgcaccatgactggacaggygacactactcacgcctgtaatcccagcactttgggaggccaaggcgggcagatcacctgaggtcaggggttccagaccagcctggccaacatggtgaaactccgtttatactaaaaatgcaaaaattagccaagtgtggtggtgcaccctgtaatcccaactactcaggaggctgaggcacaaaaatcacttgaactcgggaggtagaggttgcagtgagccgagatcacgccattacactccagcctgggtgacacaaagtgagactctgtctcaaggaaaaaaaaaaaaagtgccatg

SEQ ID NO: 122463 - DNA, 601 bp, Human
agggcagatcacctgaagtcaggagttcgagacaagcctggacaacatgatgaaaccctgtctctactaaaaatacaaaaattagctgggcatggtgacgcacgcctgtggtcccagctactgtggagactgaggcaggagaaccacttgaacctgggaggtggaaattgtactgtggtgagatcgtgccactgcactccagcctgggtgacagagcaagactacgtctcaataaataaataaacctcaagggaaaacaaatgccaccaacaaaaagcaggagagacatggttcaaatgcrccatgactggacaggcgacactactcacgcctgtaatcccagcactttgggaggccaaggcgggcagatcacctgaggtcaggggttccagaccagcctggccaacatggtgaaactccgtttatactaaaaatgcaaaaattagccaagtgtggtggtgcaccctgtaatcccaactactcaggaggctgaggcacaaaaatcacttgaactcgggaggtagaggttgcagtgagccgagatcacgccattacactccagcctgggtgacacaaagtgagactctgtctcaaggaaaaa

SEQ ID NO: 122464 - DNA, 601 bp, Human
tgcgttaaaaactagaggatttgagggaaatagtcaaggaggcacaattcttccctcaacaaggcacacacaccaaaaaaacaaaccaataaaaaaattcaagggggccagaatggcgactcatgcctgtaatcccagcactttgggaggctgaggagggcagatcacctgaagtcaggagttcgagacaagcctggacaacatgatgaaaccctgtctctactaaaaatacaaaaattagctgggcatggtgacgcacgcctgtggtcccagctactgtggagactgaggcaggagaacyacttgaacctgggaggtggaaattgtactgtggtgagatcgtgccactgcactccagcctgggtgacagagcaagactacgtctcaataaataaataaacctcaagggaaaacaaatgccaccaacaaaaagcaggagagacatggttcaaatgcaccatgactggacaggcgacactactcacgcctgtaatcccagcactttgggaggccaaggcgggcagatcacctgaggtcaggggttccagaccagcctggccaacatggtgaaactccgtttatactaaaaatgcaaaaatta

SEQ ID NO: 122465 - DNA, 601 bp, Human
ggatttcagagcatttcaaatgtttgaattagggatgcttaacctgtacaagaaaactccccagagctaaggtgacaagcttagacttcaagatgtttgctgtttatccatgtgttacctctcagctgcagatacccttctttgccttcctttgaattacgggagctggacgtggtcaatgtctctcctttgccagctgacatcaggttaagctttgctggttgagggtgctggagaagtcgtgcaggaggaagcgacttttctcctatggggtatgctctcaccagcttgtgcctgcagyagctagcagcctgtggaatacccaggggcgtcaccccagtgagtttcggcagcaccctgcaggtggttcccggtaagtctggcagacaccccagcaggcagcatcctcacaaggttcagtagagcaaacctgtgagcaggtatccagtgagtacccccagcacccagccggctcccagcaaggcttgcaggcacccagtgggtgggtggtttctagcagttttttaaacaccagagcaggcggtatcccacatgggctagcatgcagctcctccccagactgtgctgcctcaatgggcca

SEQ ID NO: 122466 - DNA, 601 bp, Human
aaactctgacaccctaagtgctccaatgagcataacctttgagtgtcgtgtcatgttggcactcaaaaagtttcggatttcagagcatttcaaatgtttgaattagggatgcttaacctgtacaagaaaactccccagagctaaggtgacaagcttagacttcaagatgtttgctgtttatccatgtgttacctctcagctgcagatacccttctttgccttcctttgaattacgggagctggacgtggtcaatgtctctcctttgccagctgacatcaggttaagctttgctggttgagrgtgctggagaagtcgtgcaggaggaagcgacttttctcctatggggtatgctctcaccagcttgtgcctgcagtagctagcagcctgtggaatacccaggggcgtcaccccagtgagtttcggcagcaccctgcaggtggttcccggtaagtctggcagacaccccagcaggcagcatcctcacaaggttcagtagagcaaacctgtgagcaggtatccagtgagtacccccagcacccagccggctcccagcaaggcttgcaggcacccagtgggtgggtggtttctagcagtttttta

SEQ ID NO: 122467 - DNA, 601 bp, Human
tggctaaggcaggaaaattgcttgaacctgggaggcagaggttgcagtgagccgagattgcgccactacactccagcctgggcaactccgtctcaaaaaatttaagaaaagaaaaagaaaacaaaagattttgacatttctggaagatgaatataaccataaaacatgcaaatataaaagaaaaacaatgcagaatgctataaaaagtatacagtgtgcatgccttgctgggaagcctgctgggtgtgggtggagctcactggagctcactggagatctgttcacaggtttgctctactgmgaaaaacacaagaaaaagcaaagaaaacaaaacagccaatagaacaaaaacaaactcaacaacaacaaaaaaatcaaacaaaaaacctgccgaaagaattttaaaagatgattacacaatgaaaagttcaatagaacagtacaaagataatgttagggaagtctcccagaacacaaagcaaaagaataaaaacacaaaaaattgaagaaaagattaaaaagccagagaaggaaccgaagaagcctaacatttgaccaatcagagttctaaaaaccacagaaaaatatggggcagggggaa

SEQ ID NO: 122468 - DNA, 601 bp, Human
catgcgcggtggctcacgcctgtaatcccagcactttgggaggccgaggcaggtggatcacgaggtcaggagatggagaccatcctggctaacacggtgaaaccccgtctccactaaaaaatagaaaaaattagccaggcatggtggagggcgcctgtagtcccagctactcgggaggctgaggcaggagaatggcgtgaacctgggaggcggagcttgcagtgagccgatattgtgccactgcactccagcctgggagacagagtgagactccatctcaaaaaaaaaaaaaaaaaaaaaatgtacaaatttacatcagcgaagagaaaataatcagtcatcagaaaacaaaagattttggccacgtgcgttagctcacgcctgtaatcccagcactttgggaggccgaggtgggcggatcacctgaggtcaggagttcaagaccagcctggccaacatggtgaaaccctgtctttactaaaaatacaaaaattagccaggcgtggtggcgggcgcctgtaatcccagctacttgggtggctaaggcaggaaaattgcttgaacctgggaggcagaggttgcagtgagccgagattgcgcc

SEQ ID NO: 122469 - DNA, 601 bp, Human
cctgtagattgacgggcatttgggttggttccatgtctttgctattgtaaatagtgctgcaataaacatgtgtgtgcatgtgtctttatagtagaatgatttatattccttggggtatatactcagtaatgggattgctgggtcaaatggtatttctggttctagatccttgaggaatcaccatactgtcttccacagtggttgaagtaatttacattcccaccaacagtgtaaaagcattcctatttctccacatcctctccagcatctgttgtttcttgactttttaataatcaccatkctgactggtgtgagatggtatctcattgtggttttaatttgcatgtcagatcagtaatgtcaagctttttttcatatgtttgttggctgcatacatgtcttcttttgagaagtgtctgttcatatcctttgcccacattttgatgggtatttttttttccttgtaaatttgtttaagttccttgcagattttggatattagacctctgtcagatgggtagattgcaaaaagtttctcccattctgtgggttgcctgttcactctgatgatagtttcttttgctgtgcagaagctctttag

SEQ ID NO: 122470 - DNA, 601 bp, Human
ttgtccaggctatcactgatgggcatttaggctgattccatgactttgctattgtaaatagtgctgcaatgaacatatgtgtgcatgtttctttataatagaataattgatttatattcctttgggtatatactgagctacttttaataaatcgacttggctgggcatagcagctcatgcctgtagattgacgggcatttgggttggttccatgtctttgctattgtaaatagtgctgcaataaacatgtgtgtgcatgtgtctttatagtagaatgatttatattccttggggtatataytcagtaatgggattgctgggtcaaatggtatttctggttctagatccttgaggaatcaccatactgtcttccacagtggttgaagtaatttacattcccaccaacagtgtaaaagcattcctatttctccacatcctctccagcatctgttgtttcttgactttttaataatcaccatgctgactggtgtgagatggtatctcattgtggttttaatttgcatgtcagatcagtaatgtcaagctttttttcatatgtttgttggctgcatacatgtcttcttttgagaagtgtctgttc

SEQ ID NO: 122471 - DNA, 601 bp, Human
catcagggtccatacagaaaggaggcggagggagaatatagactgttcttcccacttcaaatcttttttttttttaagttcgggatacaagtgcagaatgtgcaggtttattagataggtaaacgtgtgccatggtggtttgctgtgcctatcaacccatcatctaggttttaagccctgtatgcattagctatttgtcctaatgctttccctccccttgacccgcaacccccgaaaggccccagtgtgtcatgttcccctccctatgtccatgtgttctccttgttcaactcctacttaygagtgagaacatgtggtgtttggttttctgttcctgcataagtttgctgaggacgatggcttctggcttcatccatgtccctgcaaaggacatgatctcattcctttttatgcctgcatagtattccatggtgtatatgtgccacattttctttgtccaggctatcactgatgggcatttaggctgattccatgactttgctattgtaaatagtgctgcaatgaacatatgtgtgcatgtttctttataatagaataattgatttatattcctttgggtatatactgagctacttttaat

SEQ ID NO: 122472 - DNA, 601 bp, Human
ttgaactgttcattaatatcctagttcactggtacttcctgctccagtgggctgggcgcctcagcctaccatgctcaaaatcgtaaccactcctccctcagccacgtctgtgctttctcataagttttccaagttgtagagctcacgccactccctaaacttgcagtgtcgtgtgtgtgtgtatgtgtgttcaccgaggaactgagcatgcaccaaactgtgccacaaaatatgttgtcttacaaataattttgaaatgtttataccatgtctctctcactagcagaaatgactttctcaygctttctctctctctctctttttttctgtagagataggctctcactacattgcccaggctggtctggaactcctggcctcaagtgattctcccacttcagcctcccaaagtgctggcctcttcttttttaatcctccaaagcatctaacatgggttctcatgtagagtaggtctcaataatttcttcaccaaattctgcttaaaatttaatttctcagtttattgatcatttgatcatttccccccgcaaattgttcccttcattcacaaccacgatcatcatttattggtgaaactgaa

SEQ ID NO: 122473 - DNA, 601 bp, Human
gatgcacgccagcagcccctgtggcgggggctccgacaaagggcctggcctggggccagcagactcgtggaaccagcaggcaggcatcagaaggatccagacaccaacgtccagggggattctcaggattgccttcaggtagccgtgccctgcaatgtggggtgtttctcatcccaaatgggattcctcagtggccctgacaaacagttggggaaagttaatagtaaaggccaagtctctcctccaaagtccctgtcaggtgggctcttgtttttttgggggaaggagcccagggtctagwtcagtcgcccaggctggggtgcactggtgtgatcacagctcacttcagcctcaaactcctgggctcaagtgatcctccaaccccagcctcctgagtagctaggaccacagccacatgacaccaccccagctaattttttaattttttgtagagatggggtctctccctatgttggccaggctgatctcgaattccgggcatcaaataattctcccgcctcggcctctcaaagtgctaggattacaggcatgagccactgtgcctagcctcaggtgggttcttgaactgttcattaatatc

SEQ ID NO: 122474 - DNA, 601 bp, Human
atgttctgctcattcatggcaagtgaagcagagaaggggaggggaatagaacacaggccttctgtcagctggttctccagatgcacgccagcagcccctgtggcgggggctccgacaaagggcctggcctggggccagcagactcgtggaaccagcaggcaggcatcagaaggatccagacaccaacgtccagggggattctcaggattgccttcaggtagccgtgccctgcaatgtggggtgtttctcatcccaaatgggattcctcagtggccctgacaaacagttggggaaagttaayagtaaaggccaagtctctcctccaaagtccctgtcaggtgggctcttgtttttttgggggaaggagcccagggtctagatcagtcgcccaggctggggtgcactggtgtgatcacagctcacttcagcctcaaactcctgggctcaagtgatcctccaaccccagcctcctgagtagctaggaccacagccacatgacaccaccccagctaattttttaattttttgtagagatggggtctctccctatgttggccaggctgatctcgaattccgggcatcaaataattctcccgcctcg

SEQ ID NO: 122475 - DNA, 601 bp, Human
cctttgacttcagactttaggagaaaaagggtagaatcgtactgatctcactacctggcccagattctaaggcaacttcacaggctgcctcacaaatattcgttaaatgaatgagtcttatttcctttcactttgctgtaaaaaaaaagaacgcatcttggatcttaggctctcgtccaagacagttcaaaaatgtgaaggggccccatgtaagcgagggtgcaatgtgaaaggatctaggcatttatttttaatagagaaaaaagagagagcttagtttctgtaaaagcaaaaacaaaaytctaaccttgaaacagatgcaggattattcctccattttcataatttttctctgctgtttttaaagtttctctgggttcattatttaacgttccctcttaacactggatttgagggtaacctggatcaccgtgagggtgaaacgccagatgctgagcatttctgcgcttccccttccccagaccagccccccactgctccagagatgtcaggcctttctccttctccaccacctggtgccagaaaccctgctcttgacaatcgcatcttccaccccaaatgcatcactcttttccactca

SEQ ID NO: 122476 - DNA, 601 bp, Human
tcagcccatcatagataccttcatttattttgaagttgcctcctttgacttcagactttaggagaaaaagggtagaatcgtactgatctcactacctggcccagattctaaggcaacttcacaggctgcctcacaaatattcgttaaatgaatgagtcttatttcctttcactttgctgtaaaaaaaaagaacgcatcttggatcttaggctctcgtccaagacagttcaaaaatgtgaaggggccccatgtaagcgagggtgcaatgtgaaaggatctaggcatttatttttaatagagraaaaagagagagcttagtttctgtaaaagcaaaaacaaaattctaaccttgaaacagatgcaggattattcctccattttcataatttttctctgctgtttttaaagtttctctgggttcattatttaacgttccctcttaacactggatttgagggtaacctggatcaccgtgagggtgaaacgccagatgctgagcatttctgcgcttccccttccccagaccagccccccactgctccagagatgtcaggcctttctccttctccaccacctggtgccagaaaccctgctcttgaca

SEQ ID NO: 122477 - DNA, 601 bp, Human
tttgacctttgatgactttgaattatctgtggacaatctgctcacccagatagttcctgtccccacgcagctgttctctgagctgtccctggtgcaaactctcaacactcagcccatcatagataccttcatttattttgaagttgcctcctttgacttcagactttaggagaaaaagggtagaatcgtactgatctcactacctggcccagattctaaggcaacttcacaggctgcctcacaaatattcgttaaatgaatgagtcttatttcctttcactttgctgtaaaaaaaaagaaygcatcttggatcttaggctctcgtccaagacagttcaaaaatgtgaaggggccccatgtaagcgagggtgcaatgtgaaaggatctaggcatttatttttaatagagaaaaaagagagagcttagtttctgtaaaagcaaaaacaaaattctaaccttgaaacagatgcaggattattcctccattttcataatttttctctgctgtttttaaagtttctctgggttcattatttaacgttccctcttaacactggatttgagggtaacctggatcaccgtgagggtgaaacgccagatg

SEQ ID NO: 122478 - DNA, 601 bp, Human
ggaggccgaggcagatggatcacctgaggtcaggagttcgagaccagcctggccaaaacggtgaaaccccatttctactaaaataaacaaaaattagccgggcgtggtggcgggtgcctgtaatcccaggtactcgggaggctgaggcaggagaatcacttgaacccgggaggtggagattgcagtgagctgaggtcacaccactgcactccagcctgggtaatagagcgagactccatctccaaaaaaaaaaaaaaaaaaaaaaaagtaaagagctttaaaagtgtgtcacaatgaactstcccatactataacttcataaaggacagaggaggtgctacattttgaataaatgttccatcaaaataagaaaaaaatattcaaagaaaaaaaaatccacattcaacagtgcaaccagagtcttcttacagcatttatatgtctcactggatctaagacaaaaaccatccacactgacctccccgctgggttctgcgtgagattaacaactgcatggacccacagagcagccacgggctctgtgtttctgagctcactcagctactccctggatactgagcaaagctgcagccagtatcag

SEQ ID NO: 122479 - DNA, 601 bp, Human
aagatatggtggcatgttaaaaagtaaagagctataggctgggcgcggtggctcacgcctgtaatcccagcactttgggaggccgaggcagatggatcacctgaggtcaggagttcgagaccagcctggccaaaacggtgaaaccccatttctactaaaataaacaaaaattagccgggcgtggtggcgggtgcctgtaatcccaggtactcgggaggctgaggcaggagaatcacttgaacccgggaggtggagattgcagtgagctgaggtcacaccactgcactccagcctgggtaayagagcgagactccatctccaaaaaaaaaaaaaaaaaaaaaaaagtaaagagctttaaaagtgtgtcacaatgaactgtcccatactataacttcataaaggacagaggaggtgctacattttgaataaatgttccatcaaaataagaaaaaaatattcaaagaaaaaaaaatccacattcaacagtgcaaccagagtcttcttacagcatttatatgtctcactggatctaagacaaaaaccatccacactgacctccccgctgggttctgcgtgagattaacaactgcatggacccaca

SEQ ID NO: 122480 - DNA, 601 bp, Human
actttgtttacatatgatggaatgcacgtaaaataaagatcatcctaagtcacgttcttcacagagcaagccctttgatgaacatttccctgcaaacactccaacctaccagcagattcagaggacaccctctcaccaagaagatacatttacaaaatctttccacccactacagcctgaaaatgtcacacaggaaaaattttgggcacactgctcggtgactcccctcccatagcttataacacagagaagaaattcttactatttcctttttttttttttttttttggagatggagatrtgctctgtcgcccagcctggagtgcagtagtgcgatctcagctcactgcaagctccgcctcccgggttcacaccattctcctgcctcagcctcctgagtagctgggactacaggcgcccgccaccacacccgactagttttttgtatttttagtagagacggggtttcaccactgtgttagccaggatggtctcaatctcctgacctcatgatccgcctgcctcggcctcccaaagtgctgggattacaggcgtgagtcactgcgcctggccactatttccattctttatgtgagccagg

SEQ ID NO: 122481 - DNA, 601 bp, Human
tttatttatttatttatttttgagacagagtctccctctttagcccaggctggagtgcagtggcacaatctctactcatggcaacctccatctcctgggttcaagcaattcttttgcctcagcctcccgagtaactggattacaggcgcgcaccaccttgcccggctaatgtttgtatttttagtagagacagggtttcaccatgttggccaggctggtcttgaactactggcctcagggaatccaccctcctcggccttccaaagtactaaatttatagtcatgagccactgcaccccgycagtttaacttttttttaattggcttagttgccaagagaggaagttggggaggatcctgaggagtgtatgttttgtccttggagagagagctcattgtcttcaagcaaaagagggagcacactagcccttattagagaagagaggggcacttctgtagccttagaaggttctggaaacctgaggattgaagatttttcaggtgcatcaacccagatggtttcatcccatgtgtcagggttccattttttcccaatcagggtcctgacaacagcacagtagacctgcctagcttgggtcct

SEQ ID NO: 122482 - DNA, 601 bp, Human; identical to SEQ ID NO: 68047

SEQ ID NO: 122483 - DNA, 601 bp, Human; identical to SEQ ID NO: 24926

SEQ ID NO: 122484 - DNA, 601 bp, Human; identical to SEQ ID NO: 24927

SEQ ID NO: 122485 - DNA, 601 bp, Human; identical to SEQ ID NO: 24928

SEQ ID NO: 122486 - DNA, 601 bp, Human; identical to SEQ ID NO: 24929

SEQ ID NO: 122487 - DNA, 601 bp, Human; identical to SEQ ID NO: 24930

SEQ ID NO: 122488 - DNA, 601 bp, Human; identical to SEQ ID NO: 24931

SEQ ID NO: 122489 - DNA, 601 bp, Human; identical to SEQ ID NO: 24932

SEQ ID NO: 122490 - DNA, 601 bp, Human; identical to SEQ ID NO: 121887

SEQ ID NO: 122491 - DNA, 601 bp, Human; identical to SEQ ID NO: 54765

SEQ ID NO: 122492 - DNA, 601 bp, Human; identical to SEQ ID NO: 54764

SEQ ID NO: 122493 - DNA, 601 bp, Human; identical to SEQ ID NO: 54763

SEQ ID NO: 122494 - DNA, 601 bp, Human; identical to SEQ ID NO: 54762

SEQ ID NO: 122495 - DNA, 601 bp, Human; identical to SEQ ID NO: 54761

SEQ ID NO: 122496 - DNA, 601 bp, Human; identical to SEQ ID NO: 54760

SEQ ID NO: 122497 - DNA, 601 bp, Human; identical to SEQ ID NO: 54759

SEQ ID NO: 122498 - DNA, 601 bp, Human; identical to SEQ ID NO: 54758

SEQ ID NO: 122499 - DNA, 601 bp, Human; identical to SEQ ID NO: 54757

SEQ ID NO: 122500 - DNA, 601 bp, Human; identical to SEQ ID NO: 54756

SEQ ID NO: 122501 - DNA, 601 bp, Human; identical to SEQ ID NO: 54755

SEQ ID NO: 122502 - DNA, 601 bp, Human; identical to SEQ ID NO: 54754

SEQ ID NO: 122503 - DNA, 601 bp, Human; identical to SEQ ID NO: 54753

SEQ ID NO: 122504 - DNA, 601 bp, Human; identical to SEQ ID NO: 54752

SEQ ID NO: 122505 - DNA, 601 bp, Human; identical to SEQ ID NO: 54751

SEQ ID NO: 122506 - DNA, 601 bp, Human; identical to SEQ ID NO: 54750

SEQ ID NO: 122507 - DNA, 601 bp, Human; identical to SEQ ID NO: 54749

SEQ ID NO: 122508 - DNA, 601 bp, Human; identical to SEQ ID NO: 54748

SEQ ID NO: 122509 - DNA, 601 bp, Human; identical to SEQ ID NO: 54747

SEQ ID NO: 122510 - DNA, 601 bp, Human; identical to SEQ ID NO: 54746

SEQ ID NO: 122511 - DNA, 601 bp, Human; identical to SEQ ID NO: 54745

SEQ ID NO: 122512 - DNA, 601 bp, Human; identical to SEQ ID NO: 54744

SEQ ID NO: 122513 - DNA, 601 bp, Human; identical to SEQ ID NO: 54743

SEQ ID NO: 122514 - DNA, 601 bp, Human; identical to SEQ ID NO: 54742

SEQ ID NO: 122515 - DNA, 601 bp, Human; identical to SEQ ID NO: 54741

SEQ ID NO: 122516 - DNA, 601 bp, Human; identical to SEQ ID NO: 54740

SEQ ID NO: 122517 - DNA, 601 bp, Human; identical to SEQ ID NO: 54739

SEQ ID NO: 122518 - DNA, 601 bp, Human; identical to SEQ ID NO: 54738

SEQ ID NO: 122519 - DNA, 601 bp, Human; identical to SEQ ID NO: 54737

SEQ ID NO: 122520 - DNA, 601 bp, Human; identical to SEQ ID NO: 54736

SEQ ID NO: 122521 - DNA, 601 bp, Human; identical to SEQ ID NO: 54735

SEQ ID NO: 122522 - DNA, 601 bp, Human; identical to SEQ ID NO: 54734

SEQ ID NO: 122523 - DNA, 601 bp, Human; identical to SEQ ID NO: 54733

SEQ ID NO: 122524 - DNA, 601 bp, Human; identical to SEQ ID NO: 54732

SEQ ID NO: 122525 - DNA, 601 bp, Human; identical to SEQ ID NO: 54731

SEQ ID NO: 122526 - DNA, 601 bp, Human; identical to SEQ ID NO: 54730

SEQ ID NO: 122527 - DNA, 601 bp, Human; identical to SEQ ID NO: 54729

SEQ ID NO: 122528 - DNA, 601 bp, Human; identical to SEQ ID NO: 54728

SEQ ID NO: 122529 - DNA, 601 bp, Human; identical to SEQ ID NO: 54727

SEQ ID NO: 122530 - DNA, 601 bp, Human; identical to SEQ ID NO: 54726

SEQ ID NO: 122531 - DNA, 601 bp, Human; identical to SEQ ID NO: 54725

SEQ ID NO: 122532 - DNA, 601 bp, Human; identical to SEQ ID NO: 54724

SEQ ID NO: 122533 - DNA, 601 bp, Human; identical to SEQ ID NO: 54723

SEQ ID NO: 122534 - DNA, 601 bp, Human; identical to SEQ ID NO: 54722

SEQ ID NO: 122535 - DNA, 601 bp, Human; identical to SEQ ID NO: 54721

SEQ ID NO: 122536 - DNA, 601 bp, Human; identical to SEQ ID NO: 54720

SEQ ID NO: 122537 - DNA, 601 bp, Human; identical to SEQ ID NO: 54719

SEQ ID NO: 122538 - DNA, 601 bp, Human; identical to SEQ ID NO: 54718

SEQ ID NO: 122539 - DNA, 601 bp, Human; identical to SEQ ID NO: 54717

SEQ ID NO: 122540 - DNA, 601 bp, Human; identical to SEQ ID NO: 54716

SEQ ID NO: 122541 - DNA, 601 bp, Human; identical to SEQ ID NO: 54715

SEQ ID NO: 122542 - DNA, 601 bp, Human; identical to SEQ ID NO: 54714

SEQ ID NO: 122543 - DNA, 601 bp, Human; identical to SEQ ID NO: 54713

SEQ ID NO: 122544 - DNA, 601 bp, Human; identical to SEQ ID NO: 54712

SEQ ID NO: 122545 - DNA, 601 bp, Human; identical to SEQ ID NO: 54711

SEQ ID NO: 122546 - DNA, 601 bp, Human; identical to SEQ ID NO: 54710

SEQ ID NO: 122547 - DNA, 601 bp, Human; identical to SEQ ID NO: 54709

SEQ ID NO: 122548 - DNA, 601 bp, Human; identical to SEQ ID NO: 54708

SEQ ID NO: 122549 - DNA, 601 bp, Human; identical to SEQ ID NO: 54707

SEQ ID NO: 122550 - DNA, 601 bp, Human; identical to SEQ ID NO: 54706

SEQ ID NO: 122551 - DNA, 601 bp, Human; identical to SEQ ID NO: 54705

SEQ ID NO: 122552 - DNA, 601 bp, Human; identical to SEQ ID NO: 54704

SEQ ID NO: 122553 - DNA, 601 bp, Human; identical to SEQ ID NO: 54703

SEQ ID NO: 122554 - DNA, 601 bp, Human; identical to SEQ ID NO: 54702

SEQ ID NO: 122555 - DNA, 601 bp, Human; identical to SEQ ID NO: 54701

SEQ ID NO: 122556 - DNA, 601 bp, Human; identical to SEQ ID NO: 54700

SEQ ID NO: 122557 - DNA, 601 bp, Human; identical to SEQ ID NO: 54699

SEQ ID NO: 122558 - DNA, 601 bp, Human; identical to SEQ ID NO: 54698

SEQ ID NO: 122559 - DNA, 601 bp, Human; identical to SEQ ID NO: 54697

SEQ ID NO: 122560 - DNA, 601 bp, Human
taatgagaatctgaagtgttttcaaagaccatgtgtaaatctagctatgaaatatagaccagctgggtggttctgccactaaaactacaagctttgggccgggcgtggtggctcatgcttgtaatcccagcaccttgggaggccgaggtgggaggattgcctgagcccaggatttggagaccagcctgagcaacatgccaagaccccatctctaattaaaacaaataaacgaaactacaagctttgacaactctaaagatttccaaatccagttatggaccaaaggtgaggcagtacgaarggtgaggaggagggtgttctgccgcagcgttatggtatagccagcataaatttaaaggaaggtagcttggtaatgttaccttttactacagccatggtcgcactctcctgtaaaggcgtcttaaaagagtcaaacccaaagaccttcttcagcgtactccggactcgccgctcagggtcaaaaggaaaggtggtatggtggctgctcatcttagccaagaacagtggccaaaggttaaggcaaaggtagtaaaaggttgccacgagaaccctctgttttgcattaaaaatacagattatt

SEQ ID NO: 122561 - DNA, 601 bp, Human
attccagcgctttgagaggctgaggcgggcagatcacctgaggtcaggagttcgagatcagactgaccaatatggtgaaaccctgtctctactaaaaatacaaaattagccaggcatggtggcgcatgcctgtaatcccagctactcgggggactgaggcaggagaactgcttgaacccgggaggcggaggttgcggtgagccgagaacacgccattgcactcaagcccgggcaacaagagcgaaactccatctcaaaaaaaaaaaaaaaaaaaagaaagaaagaaattaatgtatgtaargcacttagcacgaagcctgggacctggtgaacattcaccaagttattactgtagttccctctctaccttccttcatggtggatggctcttacccacacagccacacttcctcaattctgattctatcagcccatctgcaggccttaaatagtcagaacacctgtagagcagatgttaataaggtcccagacagtttctcatctttttttctgtttcacatactgtgcccttaccaaaataagcaggacaccagggattccccatatcaacttagctatctatccatctgcaacttctgtc

SEQ ID NO: 122562 - DNA, 601 bp, Human
gtgaaattaacgtatgtaagccgggcgcggtggctcacacctgtaattccagcgctttgagaggctgaggcgggcagatcacctgaggtcaggagttcgagatcagactgaccaatatggtgaaaccctgtctctactaaaaatacaaaattagccaggcatggtggcgcatgcctgtaatcccagctactcgggggactgaggcaggagaactgcttgaacccgggaggcggaggttgcggtgagccgagaacacgccattgcactcaagcccgggcaacaagagcgaaactccatctcaaaaaaaaaaaaaaaaaaaagaaagaaagaaattaatgtatgtaaggcacttagcacgaagcctgggacctggtgaacattcaccaagttattactgtagttccctctctaccttccttcatggtggatggctcttacccacacagccacacttcctcaattctgattctatcagcccatctgcaggccttaaatagtcagaacacctgtagagcagatgttaataaggtcccagacagtttctcatctttttttctgtttcacatactgtgcccttaccaaaataagcaggacaccaggg

SEQ ID NO: 122563 - DNA, 601 bp, Human
cctcccgggttcaagcgattctcctgcctcagcctcctgagtagctgggactacaggtgggcgccaccatgcccagctaatttttgtatttttagtagagacggggtttcaccatgttagccaggatggtctcaatctgttgacctcatgatccgcctgcctcggcctcccaaagtgctaggattacaggcataagccactgtgcccggccttgttttttatttttcaagacagggtcttgctctgttgcacacgctagagtacagtggcacaatcacagctcattgcagcctcaaccccyggcctcaagcaatccttccacctcggcttcccaagtatccaggactacaggcacatgccactatacctggctaatttttaattttatagagatggagtcttgctatgttgcccaggctggtctcgaactcctgggctcaagcaatcctcccatctggtcctcccaaagtgctggaattataggtgtgaaccactacacctggcagcatacccagggttcgaactctgattctgaagtcggtgttctttcaaatgtaacgcactataaaatttcgtccctaactcagggtcactgtgaggt

SEQ ID NO: 122564 - DNA, 601 bp, Human
aggcaggaggattacttgagcccaggagtcatgagaccagtctgggcaccatagtgaaaccccatctctgccaaaaactgaaaaaaaaattagctgggcgtggtggcacacacctgtggtcccagctactcaaggtgggaagattatttatggccaggagttagaggctgctgtgaaccatgactatgctactgcactttagcctgggtgacagtgagagaccttgtctcttaaaaaaaaaaaaaaaaaaaaaggtgggcacagtggctcatgcttgtaaccccaacactttgggaggccraggcaggcggatcacgaggtcatgagatcgagaccatcctggccaacatggtgaaaccctgtttctactaaaaatacaagaattagctgggcatggtggcatgcacctgtaatcccagttactcaggaggctgaggcagaagaatcgcttgaacccgggaggcggaggttgcagtgagccgagttcatgccattgcactccagcctgagcgacggagtgagactctgtctcaaaaaaaagaaaaaagaaaaaaagctagtattaagataatttaaatatttaaatatttagaaagaaaaa

SEQ ID NO: 122565 - DNA, 601 bp, Human
acacaaaagacaatattaaggccgggagcagtagctcacacctgtaatctcagtagtttgggagtttgaggcaggaggattacttgagcccaggagtcatgagaccagtctgggcaccatagtgaaaccccatctctgccaaaaactgaaaaaaaaattagctgggcgtggtggcacacacctgtggtcccagctactcaaggtgggaagattatttatggccaggagttagaggctgctgtgaaccatgactatgctactgcactttagcctgggtgacagtgagagaccttgtctcttaaaaaaaaaaaaaaaaaaaaaggtgggcacagtggctcatgcttgtaaccccaacactttgggaggccgaggcaggcggatcacgaggtcatgagatcgagaccatcctggccaacatggtgaaaccctgtttctactaaaaatacaagaattagctgggcatggtggcatgcacctgtaatcccagttactcaggaggctgaggcagaagaatcgcttgaacccgggaggcggaggttgcagtgagccgagttcatgccattgcactccagcctgagcgacggagtgagactctgtctca

SEQ ID NO: 122566 - DNA, 601 bp, Human
ttattttgagacagggtctcactttgtcgcccaggctggagtgcgtcctccactccatggtatgatctcagcttaccgcaacctcaacctcctaggttcaagtgattctcccacctcagccttcccagtagctgggactacaggtgtgtgccaccatgcttggctaatttttgtattttttttgttagagacgggcttcactatgttgggccggatggtcctgaactcctaacctcaggtgatctgcctgccttggcctcccaaagtgctgggattacaggcaagagccactgctcctggmcccagagcttgttttctcttggtgagattttagttttcttcatctaaatcagtggttgtcaaccctggccatatattcaaagcaactggggagctttttttggtttattttgagaccgactttcactcttgttgcccaggctggaatgcaatggcgcgatctcggctcaccacaacctccacctcgtgggttcaagtcattctcctgcttcagcctcttccaagtagctgggattacaggcatgcgccaccacacctggctaattttgcatttttttagtagagacggggtttctccatg

SEQ ID NO: 122567 - DNA, 601 bp, Human
agacggggtttcaccatgttggccggctggtctcgaactactggcctcaagtgatccgctcgccttggcctcccaaagtgctgggattacaagcatgagcccctgcgcctggcctttttttttttgagacagagtctcgctctatcacccaggctggagtgcagtggtgcaatctgggctcactgcaagctccgccttccgggttcatgccattctcctgcctcagcctcccgagtagctgggactacaggcgcccgccacgacgcccagctaatatttttgtatttttaatagagatggrgtttcaccatgttagccaggatggtcttgatctcctgacctcgtgatctgcccacctcgtcctcccaaagtgctgggattacaggcgtgagccaccgcacctggcctttttaatttttatttttattttgagacagggtctcactttgtcgcccaggctggagtgcgtcctccactccatggtatgatctcagcttaccgcaacctcaacctcctaggttcaagtgattctcccacctcagccttcccagtagctgggactacaggtgtgtgccaccatgcttggctaatttttgtattt

SEQ ID NO: 122568 - DNA, 601 bp, Human
ccttgacctcctggactcaagtgatcctcccacctcagcctcttgcgtagctggaactacaggtgcataccactacacccagctaatttttaaatattttgtagagataaagtcttgttacattgcccaaactactcaaactcctggcctcaagagatcctcccatgtcattctcccgaagtgttgggattacaagcatgagccacctcacccagcctaacatttttaaacatgtcatttgataaatttttctgggaactttcttttcatattatttgcttttcatatcctttgttcaagygattttcctacttcagcctcccgagtaactgggattacaggagcccgccaccacgcgcggctaatttttgtatttttagtagagacggggtttcaccatgttggccggctggtctcgaactactggcctcaagtgatccgctcgccttggcctcccaaagtgctgggattacaagcatgagcccctgcgcctggcctttttttttttgagacagagtctcgctctatcacccaggctggagtgcagtggtgcaatctgggctcactgcaagctccgccttccgggttcatgccattctcc

SEQ ID NO: 122569 - DNA, 601 bp, Human
gagttcacagctaaaccgaagtgattgcatttttatatttcctgtgatcacatttcctttcttgtgtaactgtgtttcccctgaaatagctttgtttttctccatttacttagatttcagtatgttattaattcacccctaactgtcctaacataatgaacaattcatttcgataggagccagagatgccagcttccactttgatgtttagaaccttccttcctggagtcttctgccccctagtgcaatctggaccagttttccctaggcctgggacacagctgtctttccggactactcyccaatattgtcctgtgccaagacttactcctgggtaagtttccatctttgctttctaggtttactgcctctctacaatggagaacatcctttaatagcttctgagacatgacataccaggggaaagtttttgaaacctttgttatctgaagatgtcttttttttccttcaagtttccacatacagcattgaatttttatttgtttatttatttatttttttggagacagagtcttgctctgtcacccagtctggagtgcagtggcatgatcataactcactgcagccttgaattcctagg

SEQ ID NO: 122570 - DNA, 601 bp, Human
ggagactgaggtgggcggatcacctggggtcaagagttcgagaccggccttgccaacatgttgaaactccatctctactaaaaatacaaaaattagccaggcatggtggtgcatgtctgtgatcccaggtactcaggaggctgaggcaggagaatcacttgaacccgggaggcagaggctgcagtgagctgagatcgtggcactgcactccagcctgggcaacagagcaagactccatctcaaataaaataataaaataaaataaaataatgcttgacctgccgactcagaaacccatgtrgggtgggggtgggcagctgccagctacaccaggagagcaagattcccaagcccttcagttggcacccaaggggccagtgtgcaccacttggatcacacaaccagaaaacaggaggaccccaaaggtttcctgagtctctacttaccagggaggctgtgtgcggccctgccagctcatgcctgagcacagcatcccagatggggcagagcagggtacggctgggcaggggaggtgggctctggaaggtgctaatggtagcagacagggtgttgcctcctgcctgcaggtagggagcaccct

SEQ ID NO: 122571 - DNA, 601 bp, Human; identical to SEQ ID NO: 50914

SEQ ID NO: 122572 - DNA, 601 bp, Human; identical to SEQ ID NO: 50913

SEQ ID NO: 122573 - DNA, 601 bp, Human; identical to SEQ ID NO: 50912

SEQ ID NO: 122574 - DNA, 601 bp, Human; identical to SEQ ID NO: 50911

SEQ ID NO: 122575 - DNA, 601 bp, Human; identical to SEQ ID NO: 50910

SEQ ID NO: 122576 - DNA, 601 bp, Human
actgaaatcaaaaccacaatgagctgggtgcggtggctcacgcctgtaatccctgcactttgggaggccaagacgggcagattacttgtggtcaggagttcgagaccagcctggccaacacagcgaaaccccatctctactaaaaatacaaaaattagccaggcatggtcgtgggcacctgtaatcctagctactcaggagactgaggcaggagaatcacttgaacccgggaggcagaggttacagtgaaccgagatcacgccactgcagcctgggagatagagtgagattcagtctcggrgggaaaaaaaaaagccacagtgagataccactttacacccactaaaatgtctttaaccaaaaataaataaataaataacgaatggcagggatgtgaagaaactggaatcattatacattgctgatggaaatgtaaaatggtgcagccacttggaaaatttgtcaaatagtttgcagtttctcaaaatgttcaccacagttaccatatgatccagcaattctactcctaggtatataaccaagagaaatgaagtcataagtccacataaaaacttgcacaagaatgttcatagcagcatta

SEQ ID NO: 122577 - DNA, 601 bp, Human
tcattttggaaactgaaatcaaaaccacaatgagctgggtgcggtggctcacgcctgtaatccctgcactttgggaggccaagacgggcagattacttgtggtcaggagttcgagaccagcctggccaacacagcgaaaccccatctctactaaaaatacaaaaattagccaggcatggtcgtgggcacctgtaatcctagctactcaggagactgaggcaggagaatcacttgaacccgggaggcagaggttacagtgaaccgagatcacgccactgcagcctgggagatagagtgagaytcagtctcggggggaaaaaaaaaagccacagtgagataccactttacacccactaaaatgtctttaaccaaaaataaataaataaataacgaatggcagggatgtgaagaaactggaatcattatacattgctgatggaaatgtaaaatggtgcagccacttggaaaatttgtcaaatagtttgcagtttctcaaaatgttcaccacagttaccatatgatccagcaattctactcctaggtatataaccaagagaaatgaagtcataagtccacataaaaacttgcacaagaatgttca

SEQ ID NO: 122578 - DNA, 601 bp, Human
ttcaataaaaaggtaaactaccaattgcttacatgcctcagtgattttaataacccctcatatctttttagtactctgtagttttcaaggtactttcatccatgagctcatgaggtcttataaaaatcctatgatccaaagatacacgaatgggcaataagcacatgaaaagatgctcaacatcattagtcattttggaaactgaaatcaaaaccacaatgagctgggtgcggtggctcacgcctgtaatccctgcactttgggaggccaagacgggcagattacttgtggtcaggagttygagaccagcctggccaacacagcgaaaccccatctctactaaaaatacaaaaattagccaggcatggtcgtgggcacctgtaatcctagctactcaggagactgaggcaggagaatcacttgaacccgggaggcagaggttacagtgaaccgagatcacgccactgcagcctgggagatagagtgagattcagtctcggggggaaaaaaaaaagccacagtgagataccactttacacccactaaaatgtctttaaccaaaaataaataaataaataacgaatggcagggatgtgaagaa

SEQ ID NO: 122579 - DNA, 601 bp, Human
ctgggggaagtggcagcagtggggaagtggtacgaaatgatgaggctacctaatttctagttcaataaaaaggtaaactaccaattgcttacatgcctcagtgattttaataacccctcatatctttttagtactctgtagttttcaaggtactttcatccatgagctcatgaggtcttataaaaatcctatgatccaaagatacacgaatgggcaataagcacatgaaaagatgctcaacatcattagtcattttggaaactgaaatcaaaaccacaatgagctgggtgcggtggctcaygcctgtaatccctgcactttgggaggccaagacgggcagattacttgtggtcaggagttcgagaccagcctggccaacacagcgaaaccccatctctactaaaaatacaaaaattagccaggcatggtcgtgggcacctgtaatcctagctactcaggagactgaggcaggagaatcacttgaacccgggaggcagaggttacagtgaaccgagatcacgccactgcagcctgggagatagagtgagattcagtctcggggggaaaaaaaaaagccacagtgagataccactttacaccc

SEQ ID NO: 122580 - DNA, 601 bp, Human
atgaaggccactcacaagtggatatatggggagaaaaatgaagctgacagtttaccttccaccctccaagaagttacagatgttgtcatcccgcttgaggactagatggaaagtctctcgaacaatctgctgttgaatttcttctggctatgaaacaaaaagataagtgaatcagtgggcaagcctgaaaaactacatcccatccatggggatggacaagggaagaagtgtttctaagctgggaacatctaaacatttagtacttgtttctagaaatgataaaaatgatgagaaaaaatargagtgaatctatgaaagatgggtgacaatgctctgatacaggaattaagatagggtatatttacctaaatatctaagtcactaaccattactgtcctataggtaagctgatatttaaacaagaaaaggaacattgataaactctcatacaaagtcagagaataactggaaggcctgatcctgaaatattttgtcttcccctggaaaacatctatgacaaagatataataaatctcaacaggtctaacattttaagaaggtcaagatgtgggccaggcacagtggctcacgcctgaaattc

SEQ ID NO: 122581 - DNA, 601 bp, Human
gtacaggcatatgccaccaggcccagctaattttttgtatttttagtagagacatggttttaccatgctgaccacgttggtctcaaattcctggcctcaagtgatccacccaccttggcctcccaaagtgctgggattacaggtgtgagccactgcaccccgccttgagctctttctattatgctgattatcaatgtccaatctgactcaggttttaagaaagtatttaaaaattatctccgagatgcatctgttttagatgggttcatctttatttatatttttatgtataagtgaataygacgtatgaaatttttaattatcctacaaaactatatattcaaaatttcaatttatttgttccaagatatatttagcttttaaacttttatcttaagaaaacaaattttgttctaagcatttatttatgtatttatttttattattattttttttttgagacggagtctcgccctgtcacccaggctggagtgcagtggtgcgatctcggctcactgcaacctctgcctcccgggttcaagcaagtctcctgccccagcctcccgagtagctgggattactggcacgtgccactacgccc

SEQ ID NO: 122582 - DNA, 601 bp, Human
ggctcactgcaacctccgcctcctgggttcatgcgattctcccacctcaacctcccaagtagctgggagtacaggcatatgccaccaggcccagctaattttttgtatttttagtagagacatggttttaccatgctgaccacgttggtctcaaattcctggcctcaagtgatccacccaccttggcctcccaaagtgctgggattacaggtgtgagccactgcaccccgccttgagctctttctattatgctgattatcaatgtccaatctgactcaggttttaagaaagtatttaaaarttatctccgagatgcatctgttttagatgggttcatctttatttatatttttatgtataagtgaatacgacgtatgaaatttttaattatcctacaaaactatatattcaaaatttcaatttatttgttccaagatatatttagcttttaaacttttatcttaagaaaacaaattttgttctaagcatttatttatgtatttatttttattattattttttttttgagacggagtctcgccctgtcacccaggctggagtgcagtggtgcgatctcggctcactgcaacctctgcctccc

SEQ ID NO: 122583 - DNA, 601 bp, Human
attaggccaactatttattaatttttattgtcttttcaaagatcagatgggtccagtggttcacacctgtaatcccagcaatttgggaggccaaagtgggaagactgcctgagctgagatgttcgagaccagcctggacaacatggtgagacttcatctctaaaaaattcaaaaaattagccagatgtggtgacgcatgcctgtaggccccattactcaggagactgaggtaggaggatgggttgagcctgggagatggaggctgcagtgagctgtgatcacactactgcactacagtttragagcaagaccttgtctcaaaaaaaaaaaaaaaaaaaaaatcaaactttttagttcctattatttttacattttacttatctgatcttaccaaatccaatgtacaatgtacactaaatatttaataagtgtctattaaattataaagttagaggccgggcgcagtggttcacacctgtaatcccagcactttgggaggccgaggcgggcggatcacaaggtcaggatatcgagaccatcttggccaacatggtgaaaccctgtcgctactaaaactacaaaaattagctgggcatgtgcc

SEQ ID NO: 122584 - DNA, 601 bp, Human
ccagctaatttttctatttttagtagagacgaagtttcaccatgttggtcaggctggtctcaaactcctggtctcaagtgatccaccctccttggcctcccaaagtgctaggattacaggcatgtgccactgccccaggccagagcagttatttttgtagtcggctatttcaaatatattggtagtataactatgtatatatcatccctttaaaacaatgttttctatttctgacttctatcttctttatatcaattaggccaactatttattaatttttattgtcttttcaaagatcagmtgggtccagtggttcacacctgtaatcccagcaatttgggaggccaaagtgggaagactgcctgagctgagatgttcgagaccagcctggacaacatggtgagacttcatctctaaaaaattcaaaaaattagccagatgtggtgacgcatgcctgtaggccccattactcaggagactgaggtaggaggatgggttgagcctgggagatggaggctgcagtgagctgtgatcacactactgcactacagtttgagagcaagaccttgtctcaaaaaaaaaaaaaaaaaaaaaatcaaac

SEQ ID NO: 122585 - DNA, 601 bp, Human
ctcgctctattgcccaggctggagtgtaatggtgtgatctcagctcactgcaacctctgcctcccaggttcaggtgattctcatgccttggctacccaaacagccaagcagctgggattacaggcatgtgccaccatgcccagctaatttttctatttttagtagagacgaagtttcaccatgttggtcaggctggtctcaaactcctggtctcaagtgatccaccctccttggcctcccaaagtgctaggattacaggcatgtgccactgccccaggccagagcagttatttttgtagtyggctatttcaaatatattggtagtataactatgtatatatcatccctttaaaacaatgttttctatttctgacttctatcttctttatatcaattaggccaactatttattaatttttattgtcttttcaaagatcagatgggtccagtggttcacacctgtaatcccagcaatttgggaggccaaagtgggaagactgcctgagctgagatgttcgagaccagcctggacaacatggtgagacttcatctctaaaaaattcaaaaaattagccagatgtggtgacgcatgcctgtaggc

SEQ ID NO: 122586 - DNA, 601 bp, Human
tagtaggattccttgttctaagttttaaaaaataacttaatgtaacatccaggttttaatgtacttcaactttaaaaaattctactgtgaccccattagggagtcagttctttttttaacatctattatttcatcctaatattatttcagtgcctttatgttgacctcatttgggcagttttttgttcttgtttttttttttgagatagagtctcgctctattgcccaggctggagtgtaatggtgtgatctcagctcactgcaacctctgcctcccaggttcaggtgattctcatgcctyggctacccaaacagccaagcagctgggattacaggcatgtgccaccatgcccagctaatttttctatttttagtagagacgaagtttcaccatgttggtcaggctggtctcaaactcctggtctcaagtgatccaccctccttggcctcccaaagtgctaggattacaggcatgtgccactgccccaggccagagcagttatttttgtagtcggctatttcaaatatattggtagtataactatgtatatatcatccctttaaaacaatgttttctatttctgacttctatcttctttat

SEQ ID NO: 122587 - DNA, 601 bp, Human
tttctagctgttttctcagaaataggaaatttaattttgttggctttatctcatattctgtcattttgctcatatcatttccttacttataattctttaaaaatattttctatgtccataatccggccaccttacattgataacttacctctctttctttctttactatgtcacttcttcatttgtttttgtatcactcactacaaatgtttgttaaaattagagtaaacaataaaagatactccttttttttttttgagacagaatctcgctctgtcactcaagctggagtgtagtggcrtgaatatggctcactgaaacctcaaccccttgggctcaagcagtcctcctgctttagccacatgagtagctgggaccacaggggcacaccacctgattttttatagagactaggtctcactatgttgcccaggctggtcttgaactcctgagctcaagtgatcctcctgcctcaggctcccaaagggttgggactataggtatgagccactgcacctggacgaaacacccaacaagagcattcataaatgcctacagatttcacccttgagataacattggctctggttcttggctcttg

SEQ ID NO: 122588 - DNA, 601 bp, Human
aggctggtctcaaagtctcctgacctcaagtgatctgcccgcctcggcctcccaaaggactgggattaccggcgtgacccactgtgcttggccaaaagctactaatttccatatgttaaacttgtatttagtcaccttacagaactctattattagttccaattgtttccaactgatttggattttctagataatcaattcatctgtaactattatacattctgaaaactagtaaagcaaatctcccatcactgtcctttttccctagaaatatacttctgcatttcttggccactccttytccctgataaattttgcctttactgagttctataaactctcctgacggaattatacttggttttccatttgatgtattgctcaccacctttgggactactgtcatctttgcttgactcttcccaacaacgggagagtttgtagctccatttgttccaactattcctttgttttttctttaagattttataattttattggaatcaatgtcaagtattccataccaagttaattcccaagcactaactatcctttattattactgtaaatgagacttctttaattatgaattttctagctg

SEQ ID NO: 122589 - DNA, 601 bp, Human
gaaaaaaaatgctgccaattataattgttaagatgtcacccactacaacacacatccagattttagagttattgaagtgtgataaaatgcgcaccttagaatatacaaaatatgacattataagccaggatctagatttcactggacaagtggttcaattatattatagaaggctgacatggaaaacaaaattataaacccacacgtggaaaaaggaagcatgattaataaaaattcaaatgtgtgaggtacctctacctgggtagaaatttaaaatgacacatttcagtactggagttamaaggaaacaaacttatatagtactagaggcattataaattaacatactcttcattttttttttttttgagatggagtctcactgttgtcgcccaggctggagcgcaatggcacgatctcagcttactgcaacctccacctcccgggttcaagcaattctcctgcctcaaccccccaagtagctgggattacaggtgcataccaccacgcccggctaactttttggatttttagtagagacagggtttcaccatgttagccaggctggtcttgaactcctgacctcaggtgatccgcccgc

SEQ ID NO: 122590 - DNA, 601 bp, Human
gtggcacaatctcggctctttgcaacctccacctcctgggttcaagtgattttcctgcctcagcctcctcagtagctgggactacaggcacccgtcaccacgcctggctaatttttttgcatttttagtggagatacagtttcaccatgttggccaggctggtcttgaactcctaacctcaaagttaggttgcagtgagctgagatcacgccaccgcactctgggcgacaagagtgagactccaaattatataacaaacttacatagtactggaggcattataaattaacatactcttcattttttttttttttttgagatggagtctcactcttgttgcccagtgtgcagtggcatgatctcagattttagagttattagaatgtgataaaatgtgcaccttaggatatataaaatatgatattataagccaggatctagacttcactggagtctgggtgacgaagtgagactctgtctccaaaaaataaaaaataaataaaagaaactttaatgtaagattcaaaagaagaaatgaataaacaagagggaaatgctaactgttaattcacttctaattataattataatccaacaggga

SEQ ID NO: 122591 - DNA, 601 bp, Human
cctcccaaagtattggtattacaggcgtgagccattgcacccagtgtgaaaatattcttaatattcaaaagtcagtgaggttatgggtaaacagatacattcttattacattccattagtacaagtatcaaaggcaaagcctttgtttggaggcaattcagcagtatctatccatttaaaaaacacatgcccttattaaagcagcaattccaattgagaaatctgtactatgggaattaacatatgtgcatatagatgcacgtggaaggatgtcattgcagcatcctttacaatagcaagwaattgggaaaaacatagatgcccacaagtagcatgatgaatcaaagatgatgatacatccatattatggaaaatcacacaccgtcaaaaaaaactgcatgtggaaaaagctccagaacttaaatgatgaaaaagaaagttttagaactatatatagagtatgattacttttaatttttattaatttttattttttggggtctcactttgtcacccagcctggagtgcagtggcacaatctcggctctttgcaacctccacctcctgggttcaagtgattttcctgcctcagcctcctcag

SEQ ID NO: 122592 - DNA, 601 bp, Human
gaggaacgggattgggtttcacatcttcaacgtgagaaatggatgcagtttgaaaaagatcatacttttaaggtttgggaacttatagccttcttgttctgatgtcaggtccttgttcccaaagagctagtgttccagtttgtagggtgttgcactggcttttcttcctctctctttttttaagctgtggtaaaatacacgtaacataaaatttaccatcatagccattttttaagtgtacaattcagtagcattcgataacgttcataatgtgcaaccatcaccaccatccatgttcatmtctctattttataaacctgaaacatggccgggcgcggtggctcatgcctgtaatcccagcactttgggagggcgaggcaggtggatcacttgaggccaggagtttaagaccagcctgagcaacatggtgaaaacccccagctactcaggtggctgaggcacaagaattgcttgaacctgagaggtggaggtcacggtgaaccaagatcatgccactgtactccagtctgggcaacagagtgagactctgtctcaaaataaaaaaaattaaaaaaaagaaaaacaccaaaaaactgaaatg

SEQ ID NO: 122593 - DNA, 601 bp, Human
tgatgaagaaagttagaagactttgaagcaataggaagtactgtatttagaaatttagatgctcagtatgaaaaggcaagatcacagacccacacataaagaggaacgggattgggtttcacatcttcaacgtgagaaatggatgcagtttgaaaaagatcatacttttaaggtttgggaacttatagccttcttgttctgatgtcaggtccttgttcccaaagagctagtgttccagtttgtagggtgttgcactggcttttcttcctctctctttttttaagctgtggtaaaatacacrtaacataaaatttaccatcatagccattttttaagtgtacaattcagtagcattcgataacgttcataatgtgcaaccatcaccaccatccatgttcatatctctattttataaacctgaaacatggccgggcgcggtggctcatgcctgtaatcccagcactttgggagggcgaggcaggtggatcacttgaggccaggagtttaagaccagcctgagcaacatggtgaaaacccccagctactcaggtggctgaggcacaagaattgcttgaacctgagaggtggaggtcacggtgaa

SEQ ID NO: 122594 - DNA, 601 bp, Human
gaggttacagtgagctgtgattgtgccactgcactccagcctgggcaacagagtgacatgctgtctcaataaataaatacattcatctgaaaatgatgaggacagacacaaacacaaagaaagccatcaagaagcagaagtcactcaagatacaggtctcgtgaaaggcatcatcgtagtagagggaaaagaagtagtctcaatccagaagcagagagaagaacgatcatgatctagaagcaggaaaagaaaaccatgggctggacatggtgcttcacacctgtaatcccagcactttggraggccaagtcaggcagatcacctgagattcaggagtttgagaccaacctggccaacatggcaaaaccctgtctctactaaaaatgcaaaaattagccaggcgtggtgatgcatgtctgaggtcccagctacttgggaggctgaggcaggagaatcacttgaacccaggaggtggaggtttcagtgagctgaggtcacaccactgcactccagcctggccaacagagtgagacgccgtctccaaaaaggaaagaaaaaaaaaagaaagaaagaaaaccatggatcagatcttgctcctgtt

SEQ ID NO: 122595 - DNA, 601 bp, Human
tgcaattttaaaaataagagtcgtattttaagttggtggggaaaagacaagctaactgataatgttggaacagttatcctttgggggaaaaataaagttacatatttcaatgcagacataaaaatatctaacagatattaatgagctaaatgtaaaaaaataaattaaaaaagcaacggcagatcccctgggtgccatccaggcccccggaaggagctattcagtctgtggcaaagctttgaggtggctggtactgctaaaagcggcacgtggaggtgccccctagcggcctgagctctgwtctgcggcagccagagcacatgcgaggagagccagaccacagtttgcagcagcaccatcccaaaaggctgttttcattaaagatgtttcatgaaactaagactgggttctcaagatagggtagttatccaggacaagatggactagccccagaaaaagacatccccagatagtgggtggaaaaagaactgtcagatgcatctgtttttcttactcaaaatattattcaagatcacaatcaaggtcaagagaaagaaaacaagaaagaaaacgaaggacgaaaacacaaagcgcatgctga

SEQ ID NO: 122596 - DNA, 601 bp, Human
cccaggaattcaaggttgcagtgaattatcattgcaccactgcattccagcctgagtgacataccaagaccttgtctctaaataaattttaaaaataaaataaaagtataattctaagatgggaatatagatcagtggggcagaatataaattactgaaacatacatgtttataaaatgcaattttaaaaataagagtcgtattttaagttggtggggaaaagacaagctaactgataatgttggaacagttatcctttgggggaaaaataaagttacatatttcaatgcagacataaaawtatctaacagatattaatgagctaaatgtaaaaaaataaattaaaaaagcaacggcagatcccctgggtgccatccaggcccccggaaggagctattcagtctgtggcaaagctttgaggtggctggtactgctaaaagcggcacgtggaggtgccccctagcggcctgagctctgttctgcggcagccagagcacatgcgaggagagccagaccacagtttgcagcagcaccatcccaaaaggctgttttcattaaagatgtttcatgaaactaagactgggttctcaagatagggtag

SEQ ID NO: 122597 - DNA, 601 bp, Human
tgttaactaaaatagtataatactaaggctgggtgaggtggctcatgcctataatcccaacactttgggcagccaagacaggaagatccctcgagcccaggagtttgagaccagcctgggcaacatagcaaaacatcgtctccacaaaaaaataaaaataaaaaaattagccaggcatagtggcacacacctgtagtcccagctacttggaaggctgaggtgggaggattgcttgagcccaggaattcaaggttgcagtgaattatcattgcaccactgcattccagcctgagtgacatascaagaccttgtctctaaataaattttaaaaataaaataaaagtataattctaagatgggaatatagatcagtggggcagaatataaattactgaaacatacatgtttataaaatgcaattttaaaaataagagtcgtattttaagttggtggggaaaagacaagctaactgataatgttggaacagttatcctttgggggaaaaataaagttacatatttcaatgcagacataaaaatatctaacagatattaatgagctaaatgtaaaaaaataaattaaaaaagcaacggcagatccc

SEQ ID NO: 122598 - DNA, 601 bp, Human
agaattccctcctttccacattcctaatcaatctttttggagctgcttatattcaagtattggacctctgtctgtcttcttttttttttttttttgagacagactctcgctctgttgtccacgctgaagtgcagtgccacgatcttggctcactgcagcctctgcctcctgggttcaagcaattctcctgcctcagcctcctgagtagctgggattacaggcatgcaccaccacgcctggctaatttttgtatttttagtagagacgaggtttcaccatgttggccaggctgatatccaaytcctgaccttaagtgatccccctgtcttggcctaccaaagtgctggggttacagacgtgagccactgtgcccggcctctgtcttattttctcatcttttctctcccattttccatctctgcccattctgagacaattgattaacttgattttctaatacttcagttgaagtgggtttttgtttgtttccatttcctctcattttttatttctaagagaccattttgttcattttgtgtgagcaacaaggctgtgagtgtttttgtttagcacccatttagcaataagacataaatgggtc

SEQ ID NO: 122599 - DNA, 601 bp, Human
taacagatatatacatgtatgccaaaaaccacatacaataatttcatattagtgccattcataaatctttacatttttaacagtgccagaatatttcactataaggacacatagttaaatgggtctatttctcaatcactatgctgggtacttggtaagcccttataatcctgcagttcaagtccttcagttctgggaaattttatcgaattattttgttgagaattccctcctttccacattcctaatcaatctttttggagctgcttatattcaagtattggacctctgtctgtcttcttttttttttttttttgagacagactctcgctctgttgtccacgctgaagtgcagtgccacgatcttggctcactgcagcctctgcctcctgggttcaagcaattctcctgcctcagcctcctgagtagctgggattacaggcatgcaccaccacgcctggctaatttttgtatttttagtagagacgaggtttcaccatgttggccaggctgatatccaattcctgaccttaagtgatccccctgtcttggcctaccaaagtgctggggttacagacgtgagccactgtgcccggcctct

SEQ ID NO: 122600 - DNA, 601 bp, Human
ggtggaggttgccataagcagagatcgcaccactgcactccagcctgagtgacagagtgagagtctctcaaaaaaaaaaaagaaaaaagaaaaaaaattacataaaagaataacaaattaaaaaaaccaactacttacaatactatgtcctcaatgaatacatgtacaaaaaatttttcattattacagggttaacatagctgtgttttaatttcagccaaaattaacttcaaaacatcttccctttttaatttttttggtcagttatttagcctacaaaataccttcctatgaataaatktaattgacgtgtttacaacttaaaatttttttttaaaagccctgagcttacttctctatagaaccttttaacttttaataaaacataacagaaaagtgtacaaatgacaagggcacagtttaatgaattttcagaatgaacacaccatgtaactacaacctaggtatctatctataactgtttaatttctctcagacaatgacctcatttaaacaatctcattgtcagcagtgtcatgaattgttcggcactgcatgaaaatgggtcttacttgaggccagcaagtgacagagaccaggc

SEQ ID NO: 122601 - DNA, 601 bp, Human
tatctaacaaagtggcagatactatggtctacagtccagaggccttgagcctcagacttcttttgccagtgctgcagccctgctggtgcttttgtgcttccttctagaggcctgtttcttccttctagaggcctcacctatgacccaggaattgcactgttaagagaaatagatgtttcaagaaaatgtacaaaaatgtacaatagcatccattttcaagaatattcatgacaacatatttcataaaagctccaaactcaaaacaatctaattccatcagtcatagaatggataaattcayataatgaaatcctatgcagcaatgaaattaaacttcctaaggccacatgtaacaaaatgggtgattcttacaaataacacggagcaaagaaggtaaaacacaaaacaacaaatgttgactttcaaagtcaccttggaggctgggcgcggtggctcactcacgcctgtaattccagcactttgggagactgaggtgggtggatcacctgaggtcaggagttggagaccagcctgacagatatgatgaaaccctgtctctactaaaaatacaaaaattagccgggcatggtggcaggcacct

SEQ ID NO: 122602 - DNA, 601 bp, Human
acacttcattagctaaagcaagtcacatggctacacctaacttcaggaaggcatattagtataattttaccatgtttctcgaaggggaaagaactgtaaatatttagttaacagttctaatgattaccacactgagaatataaacctttggtgagcatacagagcactgggaacactcacccccgattggtagaagtataaatggatacaatcactctggcattatctaacaaagtggcagatactatggtctacagtccagaggccttgagcctcagacttcttttgccagtgctgcagscctgctggtgcttttgtgcttccttctagaggcctgtttcttccttctagaggcctcacctatgacccaggaattgcactgttaagagaaatagatgtttcaagaaaatgtacaaaaatgtacaatagcatccattttcaagaatattcatgacaacatatttcataaaagctccaaactcaaaacaatctaattccatcagtcatagaatggataaattcatataatgaaatcctatgcagcaatgaaattaaacttcctaaggccacatgtaacaaaatgggtgattcttacaaataa

SEQ ID NO: 122603 - DNA, 601 bp, Human
aaacaagaaaagatgctcatcttcataagaaatgcaattggaatgacaatgaaatgccagtacatacctactagctggataaaaattaagttctatatccatcagtcaggacaggcttggttaagtcacagtaacaattttaacatttcatggcttaaagtaacaagtttatttctctcatactatgcacacatccactgtgcgtccactggggagcactgctctacctcatcctcagttagggacccaggccctggaaggctgtgtgtccatgcttccacaaatggaatatatatatatattccattattatatatattagcactggctcctaagttttgcctagaagtgacacatggcacttccactcacacttcattagctaaagcaagtcacatggctacacctaacttcaggaaggcatattagtataattttaccatgtttctcgaaggggaaagaactgtaaatatttagttaacagttctaatgattaccacactgagaatataaacctttggtgagcatacagagcactgggaacactcacccccgattggtagaagtataaatggatacaatcactctggcattatctaac

SEQ ID NO: 122604 - DNA, 601 bp, Human
agaagctatacttgaattagcaactgctctctatgagggcaaagataagcttgaaatcctatgaaaaggaagccacctattggaagcctcagacattctaaagctgaatagggtaggattctgattccttgcatcacttgttttcaaaaatctcaggagatatgaacagttatttcctaatactgcatgaacaacaaaaatacatagtttcataaactgtaaaaaaaatttgcagtggcagcaaaatactttatggaacttatctgaagataagacatatgaggaagaacaacatttttayggccttttatttccttctaaaagccacatccaataaaatggctggaactggaattactttactgctttagcaggcatccttacagatgtttacaaaacagtattagaatgatgatgcaaaaaaatcatgattacctcaggaactggaaaaaaagcttttgataaattttaacatccttttatgattaaaaatccttagtaggaagagaaaggaagaaacatccttaacctgacaatctttaccaaaaaaacctatagcaaatactctacttcatggtgacaggatgaaagcttccctttg

SEQ ID NO: 122605 - DNA, 601 bp, Human
acaaaaacaacttaggaggttaaacaagaaatcacaagattaggaataaacaacttggcagagccaaggaattcagtcatagctggtctttacacaggcctactactccggccacatctgcttaaggtgatggggcatctatccatgactatctaatgaagatcttaaagacctaggaactgatgagagtttctgacctcaaggtgaagagattctttagttaaaaagaacagagttcaaggtgatgttcctattgtcttaggacaaggcttttgcctatcttagtaaaaagatcattttytattatcaacagaagaagctatacttgaattagcaactgctctctatgagggcaaagataagcttgaaatcctatgaaaaggaagccacctattggaagcctcagacattctaaagctgaatagggtaggattctgattccttgcatcacttgttttcaaaaatctcaggagatatgaacagttatttcctaatactgcatgaacaacaaaaatacatagtttcataaactgtaaaaaaaatttgcagtggcagcaaaatactttatggaacttatctgaagataagacatatgaggaag

SEQ ID NO: 122606 - DNA, 601 bp, Human
attacaggctcgagccaccgcgcccagcccttctttctttttttttctaaacaaattacagggattttagaaatttaagaaatcattattgctgatctttttttttttttttttctgagatggagtctcgctctgtcacccaggctggagtgcagtggcgcgatctcggctcactgcaagctccgcctccagggttcatgccattctcctgcctcagcctccagagtagctaggactacaggcacctgccaccatgcccagctaattttttgtattttttagtagagacagggtttcaccrtgttagccaggttggtctcgatctcctgacctcgtgatctgtccgccttggccctcccaaagtgctgggattacaggcatgagccatcatgaccagccgatctctgtctttatgttaccctgagggaataagattttggcctctgaaaaaaatattctacagccaacactaagaattgaagataacatacagaaagtacagtagtccccccttacctgcctagaatatgtcctaagacccccagtggatgcgttattttttcctatacacacatacctaggataaagtctaatttgtaaa

SEQ ID NO: 122607 - DNA, 601 bp, Human
cctgcctcacgtctcccgtgtagctgggattaaaggtgcacgccaccacgcctgggtaatttttgtatttttagtagagacggagtttcaccacgttggccaggctggtctcgaactcctgacctcaggtgagccacccgccttgacctcccaaagtgctaagattacaggctcgagccaccgcgcccagcccttctttctttttttttctaaacaaattacagggattttagaaatttaagaaatcattattgctgatctttttttttttttttttctgagatggagtctcgctctgtcrcccaggctggagtgcagtggcgcgatctcggctcactgcaagctccgcctccagggttcatgccattctcctgcctcagcctccagagtagctaggactacaggcacctgccaccatgcccagctaattttttgtattttttagtagagacagggtttcaccgtgttagccaggttggtctcgatctcctgacctcgtgatctgtccgccttggccctcccaaagtgctgggattacaggcatgagccatcatgaccagccgatctctgtctttatgttaccctgagggaataagatttt

SEQ ID NO: 122608 - DNA, 601 bp, Human
cttgcttcctttctctttctttctttccttctttctttctttttccctccttccttcctttttttcttttctttctttccttttttcttttctttttcttccttccttcctttccttccttcctttttccttcctttccttccttccttctttccttcctttccttccttccttccttccttccttttctttctttcttttttttttttgagatggagtcctgctctgtcgcccaggctggtgtgcagtggcgcgacctcggctcactgcaacctacacttcccaggttcaagcaattctyctgcctcacgtctcccgtgtagctgggattaaaggtgcacgccaccacgcctgggtaatttttgtatttttagtagagacggagtttcaccacgttggccaggctggtctcgaactcctgacctcaggtgagccacccgccttgacctcccaaagtgctaagattacaggctcgagccaccgcgcccagcccttctttctttttttttctaaacaaattacagggattttagaaatttaagaaatcattattgctgatctttttttttttttttttctgagatggagtctcgctctgtca

SEQ ID NO: 122609 - DNA, 601 bp, Human
agcttcatcaaaagtaaaaactgggctggggctgggcacggtggaggagagacagggtttcaacatgttggtcaggctggtcttgaactcctgacctcaagtgatccatccacctcggcctcccaaagtgctgggattacaggtgtgagccaccgtgcctagtttatgagcttcttacaggtagaaaatttgagttttatatctttgtatctctatatttagcgcagtgtctttttcctaatgaatgcttaataaatgattgttgtttggtaatcagagaaaagacaaaaacactctcagwcatcagtacttcatcaaggtcagagagccaaggtaaagacaaatgatttgcagaaagcctctaaggagggaggcactcgcctcccacatataaaaaccatttattctgttaagaaattttattttaagtcatcttaaattcatttgggaagtatagaagatataaatgcccaataatcagagaaactgaaaagctgccatgtgggatacctttcctaagattcaaccatgttttcttcttattagagcactcctctatttttctgttactaaaatttctagcttcccttctacaaagtga

SEQ ID NO: 122610 - DNA, 601 bp, Human
aagcttcatcaaaagtaaaaactgggctggggctgggcacggtggaggagagacagggtttcaacatgttggtcaggctggtcttgaactcctgacctcaagtgatccatccacctcggcctcccaaagtgctgggattacaggtgtgagccaccgtgcctagtttatgagcttcttacaggtagaaaatttgagttttatatctttgtatctctatatttagcgcagtgtctttttcctaatgaatgcttaataaatgattgttgtttggtaatcagagaaaagacaaaaacactctcatacatcagtacttcatcaaggtcagagagccaaggtaaagacaaatgatttgcagaaagcctctaaggagggaggcactcgcctcccacatataaaaaccatttattctgttaagaaattttattttaagtcatcttaaattcatttgggaagtatagaagatataaatgcccaataatcagagaaactgaaaagctgccatgtgggatacctttcctaagattcaaccatgttttcttcttattagagcactcctctatttttctgttactaaaatttctagcttcccttctacaaagtg

SEQ ID NO: 122611 - DNA, 601 bp, Human
agactagcctggccaagatggtgcaaccccgtctctactaaaaaaatacaaaaaattagccaggcatggtggtgcgcacctgtaatcccagctactcggaaggctgaggcaggagaattgcttgaatccaggaggcagagattgcagtgagccaagatcacaccactgcactccagcctggatgacagagtgagactccatctcaaaaaaaaaaaaaaaaaaaatattcgctgggcgtggtggtgcgcacctgtagtcccagctactcaggaggctgaggcatgagaattgcttaaacccrggaggcagaggttacagtgagccaagatcatgccactgcactccagcctgggcaacagagtaagactctgtcttaaaaaaaaaaaaaaagaaaagaaaagaaaagaaaaagaaacccacaaaattgggacacatatctatttcacatcaactaatcaactctgactgtcctgtattgtttggataaccaacaaagtattacatactgacactattccaaaggcgtttacaatctactagaaacagttagaattaaaaacttgagagcatgagcaagaagacaaacagtttggagaactac

SEQ ID NO: 122612 - DNA, 601 bp, Human
tatcacttaccagctgtgtgaccttagagaaactgaggcttcctaccaataaacctcagtttcttcatctgtaaaatggggagaaccagagttcttagctgccaggcttattctaaagattaaaaaagatgatgtaggaaataaatgagacactgtatataaagcacttagctatctattacgtgcctagttcttagtaagtactcggatgttggttaatttggtagttataatcaaagtcatcttgaccaacctctttcccagtgcaggattctgttctttggctcctgcaacagtatasatccttcactctggtgacagatccttcgcctccatgaagagagctcactactgtttccaagctgctcagtgggctgttgagcagcaacaactgtcagagagtttttaactgtactgagctacaacaagcatcaaataatttccacccccgatcctacctgtgtcttctggagcaacacagagtaagtccctgccctctaccctgggattctatcactctgcctaaggcaaccacataggcaggcagataagtgaagcacaatttggccataaaacaaaaaaagaaaaaaagtccaaatgc

SEQ ID NO: 122613 - DNA, 601 bp, Human
cttccttttttaaaaaaaccagttcctattatgagtcagggttctccgtgaaatcattttttttttttttaatgttctagcaggactttttctttctaacccagtgtttcatcctcctttggctactacctgtttgcactgctgatcccaaatgccaagcacagtgctaagtacagaaaaagatccagaccttgtccttttgaatttcatccttccttggttgcttatctgctaagaaaacatgacacaaacacatttccccacatttaggatgtcaaagcaggcgggaatactacaggcrgcattgcagagtgtagagggagcgggtccataatcagagtccaggatctgaatgtggctctatcacttaccagctgtgtgaccttagagaaactgaggcttcctaccaataaacctcagtttcttcatctgtaaaatggggagaaccagagttcttagctgccaggcttattctaaagattaaaaaagatgatgtaggaaataaatgagacactgtatataaagcacttagctatctattacgtgcctagttcttagtaagtactcggatgttggttaatttggtagttataatcaaagt

SEQ ID NO: 122614 - DNA, 601 bp, Human
cccacctcagcctccagagtagctgggaccacagacctgcatcaccacacccagctaatttttgtattttttgtagagacagggtttcaccatgttacccaggctgatctcaaactcctgggctcaagcaatccttctgtttcaacctcccagagtgctgggattacagcacctggccgatttttcactaaaagaacataatctctaacaatgtctattttcaaatatgcttaacatcacagattgttaagagctggaagaaggaaatgaagataagatgtggaccctgtccttaaagagyttagaatcaagtaagaaagattaaacatgtacagaattaactataataaaaggaagtctgtgataaataccatgacccaagtacaaagtactatgttatttcagagaagggtggccttaaaactaactggcaattggaggaaaaggcatccaggcagagggaatggcaaattacctagcaactcattcattattcttcatgctctactaattcatcttctttttttttttttgagacagagtcttgctctgtcccccaggctggagtgcagtggtgcgatctcagctcactgcaacctcc

SEQ ID NO: 122615 - DNA, 601 bp, Human
gttttaagcattagaatcactctaagcactctacgatacacatgagcacaggcacatgagagcagaggcaaagaagagcagattcaaatcttccatgtcacactcattccagacatatactaattaagtagaattgagggcatattcgtactgtatttagaatttttcatttcctttttgtttttggacaaatggatagagttgaacaagttgaatgtttcagtgagcccactgtacctaccacataaaaggcagtgtgttaggttcaaggcattcactgatttttttcttttttttttttgagacagggtcttgctctgtcactatcactcaagctgcagagcagaggcgtgatcatggctcactgcagccatggcctcccaggctcaagtgatcccacctcagcctccagagtagctgggaccacagacctgcatcaccacacccagctaatttttgtattttttgtagagacagggtttcaccatgttacccaggctgatctcaaactcctgggctcaagcaatccttctgtttcaacctcccagagtgctgggattacagcacctggccgatttttcactaaaagaacataatctct

SEQ ID NO: 122616 - DNA, 601 bp, Human
agacattcaatccctagccattgatttctttctctctttcactcacaggatcatacattgtttcagtgggcaatgaatgaatccagtggagccttgtcttacacatcagatgaaacggctggctggtttaggggccacagagattgaaaatttgttttaagcattagaatcactctaagcactctacgatacacatgagcacaggcacatgagagcagaggcaaagaagagcagattcaaatcttccatgtcacactcattccagacatatactaattaagtagaattgagggcatattcstactgtatttagaatttttcatttcctttttgtttttggacaaatggatagagttgaacaagttgaatgtttcagtgagcccactgtacctaccacataaaaggcagtgtgttaggttcaaggcattcactgatttttttcttttttttttttgagacagggtcttgctctgtcactatcactcaagctgcagagcagaggcgtgatcatggctcactgcagccatggcctcccaggctcaagtgatcccacctcagcctccagagtagctgggaccacagacctgcatcaccacaccca

SEQ ID NO: 122617 - DNA, 601 bp, Human
ttagatggagtctcactctgtcgctcaggctggagtgcagtggcacgatctaggcttactgcaacctccacctcccaggtccaagtgattctcttgcctcagattcctgggtagctggaactacaggcgcccaccaccacgcccggctaattttttgtatttttagtagagacgggggtttcactatgttagccaggatggtctcgatctcctgacctagtgatctgcccaccttggcctcccaaagtgctgggattacaggcatgagccactgcgcccagcctatgaattgtactttttwaaaaaaaaattatactttaagttctggggtacatgtgcagaacatgcaggtttttacatagctatacacgtgccatggtggtttgttgcacccatcaactggtcatctacattaggtatttctcctaatgctacccttctcctagccccctacccccgagaggtgctgttgtgtgatggtcccctccctgtgcccatgtgttctcattgttcaactgccatttatgagtgaaaacatgtcgtgtttggttttctgttcttgtgttagtttgctgagaatggtggtttccagctttatcca

SEQ ID NO: 122618 - DNA, 601 bp, Human
ggaacacattaacaagtaccaggcatacttgacttcattgaaaagttgacttctagctagggagacaaaacaatatgcatgaaagagacattaaatcaccattaaatcattttaacagaaaactttaaaagcgtattacacactcccatgacttctaaaaaagaatattctaaatgtaattgggctttttttggggggagtgctttttttgcagctcattgttaatatctaagtaatgaattgtatttttttttctttagatggagtctcactctgtcgctcaggctggagtgcagtggcrcgatctaggcttactgcaacctccacctcccaggtccaagtgattctcttgcctcagattcctgggtagctggaactacaggcgcccaccaccacgcccggctaattttttgtatttttagtagagacgggggtttcactatgttagccaggatggtctcgatctcctgacctagtgatctgcccaccttggcctcccaaagtgctgggattacaggcatgagccactgcgcccagcctatgaattgtacttttttaaaaaaaaattatactttaagttctggggtacatgtgcagaaca

SEQ ID NO: 122619 - DNA, 601 bp, Human
ggctgatagctttttctactccttcgtggcatagctggtttcattaattcctaggaaagggcttcagaaaataagtagggaagagattgttgagagatgggaaatgcatcattttcttgtctatacttgggggcatggtggctattaatgagccaaagggtaacgacgctctgaggtgactcagcactgacgggaagagaaaatcatctgagagtcatcttggcccagagtcagactctagttcccatattatacattttagaaagaaatgaaaagaggaagaagatatctttatgagtastattgaggacctggtacatatgcctttttctctcttactcgtactttcattccaaagtccaatgttttatcggtgttttaagacaagcaaaggactgactatcctcattcccttgcatctcttttacctaaaaatgaacatatggtaattagactcaatgactgttggctggatgtctatgtaggtgtaactacagtgaacaacatggaacacattaacaagtaccaggcatacttgacttcattgaaaagttgacttctagctagggagacaaaacaatatgcatgaaagagacattaa

SEQ ID NO: 122620 - DNA, 601 bp, Human
ctcgctctgtcgcccaggctggagtgcagtggcgtgatcttggctcactgcaggctccgcctcccaggttcatgccattctcctgcctcaacctccggagtagctgggactacaggcacccgccaccacacctggctaattttttgtatttttagtagagacagggtttcaccgtgttagccaggatggtctcgatctcctgaccttgtgatccgcctgccttggcctcccaggctgatagctttttctactccttcgtggcatagctggtttcattaattcctaggaaagggcttcagaraataagtagggaagagattgttgagagatgggaaatgcatcattttcttgtctatacttgggggcatggtggctattaatgagccaaagggtaacgacgctctgaggtgactcagcactgacgggaagagaaaatcatctgagagtcatcttggcccagagtcagactctagttcccatattatacattttagaaagaaatgaaaagaggaagaagatatctttatgagtagtattgaggacctggtacatatgcctttttctctcttactcgtactttcattccaaagtccaatgtttt

SEQ ID NO: 122621 - DNA, 601 bp, Human
ctctaatctagatcaatccctctccaggtcccttgcactgtagggcaaatgcctgttgtgctacaaaagacagaggctcacattcctactgtggagtctttctcaaaataactgtgttatacatagaagacaaaaacactaatcaaatataaaagagcatggtcacagtgcttgtattaaaacatgaggatgccaatactgcaacactcaagttttgaaaaagaattgttaatcactgacaagactctagtctactatataaaaagctgagtgctgatagctttttctttttatttgatasagagtctcgctctgtcgcccaggctggagtgcagtggcgtgatcttggctcactgcaggctccgcctcccaggttcatgccattctcctgcctcaacctccggagtagctgggactacaggcacccgccaccacacctggctaattttttgtatttttagtagagacagggtttcaccgtgttagccaggatggtctcgatctcctgaccttgtgatccgcctgccttggcctcccaggctgatagctttttctactccttcgtggcatagctggtttcattaattcctaggaaagggct

SEQ ID NO: 122622 - DNA, 601 bp, Human
acacagtctccaaaccttaaattggtcatgttccaaatgtttaagtatttaaatttacaatgcatttttctataaaggtaataagtaagattttcaaggctagcagctcatgaaagcagacttaaatccataaagctacccaaaatgtggtaccagagagcacccctgccactacacctaatatgaacaatactgtttctataataaaatgcagttctgtattgggatggcaggattccatctaaccgaaaatttcacaggcagagaggataagtaaaatcttttgagacactagcagcaygttaatgcatgccacatcccaagcttaatcgaatccatagaaacctctaatctagatcaatccctctccaggtcccttgcactgtagggcaaatgcctgttgtgctacaaaagacagaggctcacattcctactgtggagtctttctcaaaataactgtgttatacatagaagacaaaaacactaatcaaatataaaagagcatggtcacagtgcttgtattaaaacatgaggatgccaatactgcaacactcaagttttgaaaaagaattgttaatcactgacaagactctagtctact

SEQ ID NO: 122623 - DNA, 601 bp, Human
gcagtcaagaatcaacactgaactcatgtacctaaagaactggagatagagtcagggcacaaagaagggttctgttaaacaacagaagttggctgatgcgctgaccttgaggatgcctgcagaaatctaagtaaatacctgagagaacactgacagataaagtcacaaaccaacacagggaggctggtagggaaagaaaatctgagacgtgagtcatgtaaatggtattcaaaaccacaggaacagaaagaaagaggctaagtcttcgagaggcctaaactcagcttcacacagtgtgcaytgaacaaatatgaattatgaagtaataataattcaaccttctactcagcaagcatgggaaataatgacactagcaaaattcactcagaagtgtttattaacagagtttaaacaaaagtgctactgatttttcagtacttggcaaatccaatggtaattcaacctaaaaataattacaaccaggatgagtttcatctgacataaagattaggataaccccaataaaccaacaggatatcttgatataaggggaaggcaatagagaaaatgcttcgggtgataaatctgaaatcttaaaagg

SEQ ID NO: 122624 - DNA, 601 bp, Human
agcagtcaagaatcaacactgaactcatgtacctaaagaactggagatagagtcagggcacaaagaagggttctgttaaacaacagaagttggctgatgcgctgaccttgaggatgcctgcagaaatctaagtaaatacctgagagaacactgacagataaagtcacaaaccaacacagggaggctggtagggaaagaaaatctgagacgtgagtcatgtaaatggtattcaaaaccacaggaacagaaagaaagaggctaagtcttcgagaggcctaaactcagcttcacacagtgtgcrttgaacaaatatgaattatgaagtaataataattcaaccttctactcagcaagcatgggaaataatgacactagcaaaattcactcagaagtgtttattaacagagtttaaacaaaagtgctactgatttttcagtacttggcaaatccaatggtaattcaacctaaaaataattacaaccaggatgagtttcatctgacataaagattaggataaccccaataaaccaacaggatatcttgatataaggggaaggcaatagagaaaatgcttcgggtgataaatctgaaatcttaaaag

SEQ ID NO: 122625 - DNA, 601 bp, Human
caactgacctttggtaagcaaaatgactcaagtgtaagtgagcaatggatgagcgaacagctgcccgtgttagtcctgctagtcagttcagaccttgtccactgaatatgaagttgaccatgaaagatggctaacatttctctgattggagatagatgggacttaagaaagttggaggctgccaagcatgggtgtgggagcaagcagtcaagaatcaacactgaactcatgtacctaaagaactggagatagagtcagggcacaaagaagggttctgttaaacaacagaagttggctgatrcgctgaccttgaggatgcctgcagaaatctaagtaaatacctgagagaacactgacagataaagtcacaaaccaacacagggaggctggtagggaaagaaaatctgagacgtgagtcatgtaaatggtattcaaaaccacaggaacagaaagaaagaggctaagtcttcgagaggcctaaactcagcttcacacagtgtgcattgaacaaatatgaattatgaagtaataataattcaaccttctactcagcaagcatgggaaataatgacactagcaaaattcactcagaagtgtttat

SEQ ID NO: 122626 - DNA, 601 bp, Human
tctttctttctctttctttctttctttctttctttctttctttctttctttctttctttctttctctctctctctctttctttctttacttttttctttccttccttccttctttccttccttccttctttctttctttctttttttagagacagggtcttgctctgtcacccaggctggagtgcagtgccatgataatagctcactgcagccttgaactcctgggctccagcaatcctcctgcctcagtctcatgagtagctgggcctataggcatgtgccaccatgcccagcttttttyctttttttttttaatttctaagtagagatgaggtcttgctatattgctcaggctggtcttgaactcctgagctcaagggatcctcccgcctcagccttccaaagcattgggattacaggtgtgagccaatgtgcccaacctagaaggatctcttctgctgattagagttttttgccattattgcaaaaaactcacccagaatgcatcatctacaatttccagtttcttaaagttagaactcaaactgctgtgaaacagtaagtacagaatcctagatttttaagatccttccacctctac

SEQ ID NO: 122627 - DNA, 601 bp, Human
caaaaacaaaaacaaaaacaaaaaaactacggcaaaaacttacggtgagcactgaaaactacttaactgtaggtctaagactaaaataggattagggtaacaacagatcgtcaatactatatgctttgatgatgtataaaactccagctagcaaaaactaggaagagaagaggggaaaaaggagggaggtagaatacgaacactgatttcctcaccctcagtaactgagagtccatggatagcatttaaaactaaagtaataaagatatggttaatctgacttttactgtgacttttcccrtgaatgttcaagcctaccatcattgttataaacaacaaaactttgagagccactgaacttttggctagggccaaaaaaccctctttctttctttctctttctttctttctttctttctttctttctttctttctttctttctttctttctctctctctctctttctttctttacttttttctttccttccttccttctttccttccttccttctttctttctttctttttttagagacagggtcttgctctgtcacccaggctggagtgcagtgccatgataatagctcactgcagcctt

SEQ ID NO: 122628 - DNA, 601 bp, Human
aagatagaatctaaggtgtttctgaactataagaggattggggtctacacactgaaaggtcacactgtatcccaggggaaacaaattcagaataggcagtaccaagatacacctttaggtaaggtttctgggttcctgcaaccaggcaaaaagatcaaatcacttaaaagagaaacaaaataatgaaaatttccacattaatatttaatgctaacagaaaatggaacaacacctacaaaattctcaaggacagaaagtgtgactcaaggactttatttatttttatttttatttttgagayggagtctcgctctgttgccaggctggagtgcagtggcgcgatctcggctcagtgcaacctccacctcctgggttcaagcgattctcctgcctcagcctcccaagtagctgggactataggcatgcgccaccatgcccagctaatttttgtatttttagtagagacggggttttaccatgttggccaggatggtctgcatctcttgaccttgtgatccgcccaccttggcctcccaaagtgctgggattacaggcgtaagccactgtgcccagaagactcaaggactttatacccagtcaa

SEQ ID NO: 122629 - DNA, 601 bp, Human
atgcccagctaatttttatatttttagtagagtcggggtttcctcatgttggccaggctggtctggaactcctgacctcagatgatccccctgccttggcctcccaaagtgctgagattacaggcgtgagccaccacgcctggcctgacttcactttatatatgaagaaattgatacattttatatatgaggaaaaggcaataaaatgatcccaatgtcatgtatattagcagcagaatggtgctgattccggagctcatgttctaccctttatatcatacttcctcagaatcccaaactrtgtcttccactctattcatccctgacccctagtccacatgaaatcatttaagacttgtctttggtgtgtcaatatcttgtattaattcttccatgctttatctccaaggcctagaacaacgctcagagtaggcatgctaaatgaatgaaaggctttccatatatctaagtagcatattccttgggctttagggacttcgaagatagacaacagtgtggtggtgggggctttctggagaaggtatagtaaaaggcctaacacatgatgtcgtggagactagtggctggttaacagaaaaag

SEQ ID NO: 122630 - DNA, 601 bp, Human
tctcccaactcagcctcctgagtagctgggattacaggcacccgccaccatgcccagctaatttttatatttttagtagagtcggggtttcctcatgttggccaggctggtctggaactcctgacctcagatgatccccctgccttggcctcccaaagtgctgagattacaggcgtgagccaccacgcctggcctgacttcactttatatatgaagaaattgatacattttatatatgaggaaaaggcaataaaatgatcccaatgtcatgtatattagcagcagaatggtgctgattccrgagctcatgttctaccctttatatcatacttcctcagaatcccaaactatgtcttccactctattcatccctgacccctagtccacatgaaatcatttaagacttgtctttggtgtgtcaatatcttgtattaattcttccatgctttatctccaaggcctagaacaacgctcagagtaggcatgctaaatgaatgaaaggctttccatatatctaagtagcatattccttgggctttagggacttcgaagatagacaacagtgtggtggtgggggctttctggagaaggtatagtaaaa

SEQ ID NO: 122631 - DNA, 601 bp, Human
cgcctcctgggttcaagcgattctcccaactcagcctcctgagtagctgggattacaggcacccgccaccatgcccagctaatttttatatttttagtagagtcggggtttcctcatgttggccaggctggtctggaactcctgacctcagatgatccccctgccttggcctcccaaagtgctgagattacaggcgtgagccaccacgcctggcctgacttcactttatatatgaagaaattgatacattttatatatgaggaaaaggcaataaaatgatcccaatgtcatgtatattagyagcagaatggtgctgattccggagctcatgttctaccctttatatcatacttcctcagaatcccaaactatgtcttccactctattcatccctgacccctagtccacatgaaatcatttaagacttgtctttggtgtgtcaatatcttgtattaattcttccatgctttatctccaaggcctagaacaacgctcagagtaggcatgctaaatgaatgaaaggctttccatatatctaagtagcatattccttgggctttagggacttcgaagatagacaacagtgtggtggtgggggctt

SEQ ID NO: 122632 - DNA, 601 bp, Human
ctccagaattgtcatatgtgttccagggggcaaattcaccccagctgagaaccactggtccagagtctagagtcaaccaccagtttactctgtcagcaatgcagagtcaagaagaaagatgtgtctgcatatctgggcactgtgcacttctgacatctgaagttctctggcattggctccctgtattttgccctcagtaagtgcagggaacttctgatcttgaggacagagtataataaatcaaatgtattcccttgcgtgtgtgcccacattgagctttattaaccactgttctgtctayacacacgcacacacacactctcacgaggtgttcttacattttatacaatatgaattattcattagctatatgcaaatgaagatttaatggtaaaagtctcatatttagataatttacaaaatgttaaacaagactggttttaaaattattccctgggggaattccactgtttatacttccccatcaagaaataggcctctgaaaacagtatggtggttcctcaaaaagattaaaaacagaattaccatatggcccagcaattccacttttggatatacactcaaaagaactgaaagtaaa

SEQ ID NO: 122633 - DNA, 601 bp, Human
agtcagaatactctgtggtggtcagagtgtaacccacgaggtttccttttcctgcagcagcagagtggtcagatatgacctgtcctgactcacaactcagacactcaaacccccctgcccagtgacacaacgaggggtctctcccaggtcttggcacatggcaacacgaatctctcccctcagcagcgaggtggtagctatgagcacaggcttcaaagtctgacagctcttgtttaaattctggctctgctacttgctagctgggtggccctgggcaaatgacctttaaagtgcttcagcytccttccaggattgcagtgaggactggatgagataaatgtgtgtaaagcacctagcctggtgcccaggacacactgggttctaagtaaggaatggtggctttcattattaatattaccatcatcaacactgactgtcattaagtaggtccagctatgacagaataatccctgtccaagcaactgaaatgaatgtcttccaccttctataaggcagatcctccagcctgtgctccactgaagggacgtgatcagagcaagatagagcccaattcctttgcacctctcctcacctcatttct

SEQ ID NO: 122634 - DNA, 601 bp, Human
aaagggaagcaaaaatcaggagtcagaatactctgtggtggtcagagtgtaacccacgaggtttccttttcctgcagcagcagagtggtcagatatgacctgtcctgactcacaactcagacactcaaacccccctgcccagtgacacaacgaggggtctctcccaggtcttggcacatggcaacacgaatctctcccctcagcagcgaggtggtagctatgagcacaggcttcaaagtctgacagctcttgtttaaattctggctctgctacttgctagctgggtggccctgggcaaatkacctttaaagtgcttcagcctccttccaggattgcagtgaggactggatgagataaatgtgtgtaaagcacctagcctggtgcccaggacacactgggttctaagtaaggaatggtggctttcattattaatattaccatcatcaacactgactgtcattaagtaggtccagctatgacagaataatccctgtccaagcaactgaaatgaatgtcttccaccttctataaggcagatcctccagcctgtgctccactgaagggacgtgatcagagcaagatagagcccaattcctttgca

SEQ ID NO: 122635 - DNA, 601 bp, Human
taccaactctgcttctgccctcacccagcaagtctccatttcttctcatttccaacccccttgcctctgactcacttactattcctggaatcttcccagcctacatttctaaaagaactatagctgccaccaatagctgtggtctggaaaagcttcttccacaggactgccagtcctcacagaaagaagaattcctggtttcgcaagatcaagttccgtatacaaggcaaagaagctctttaagacactcagataattaaagaggtaatttgttctgctatttctgcatgtgaaagtatamgtctgtaacctctgtgctctgggaaggctgaggaaggggacggcgagacctcagagggataggacagaatttatgtgaacatctctatcaagcccagcaccatgtgggggtggactggggtatgttattttcaagcctagcccaaactctactgtagttttttataaagctaactggaaataaggaaattggcaactctgaggtctgaaagacaccacgagaaatggctgctgggagatcagactcttagagcacacaaactaggaaaccacactggactagggaagagggttctgggtc

SEQ ID NO: 122636 - DNA, 601 bp, Human
atttgtcaggggcacttttctggttacaaaacaaaacaaaaccctttcctcaagagaccaaagactcttattgaaacgtgcaaagtcaccgggaagttcttaaaaggaaaaggacagtcacagctctagggcaactgcttgccaactaataatgtgagatgaaaagagctggctttggaagtgtcatgtggcaacaagctgggagaaggtggggggtatcacagataaagaagagctggtgacaaaacgcaaagagtatgcacatctacagtgaacccccacctggcaggctcacccccaygtggagggaacggcaaaagtggatgaaaactctctcacaatcatttttcccctattgccttctttccggataccaactctgcttctgccctcacccagcaagtctccatttcttctcatttccaacccccttgcctctgactcacttactattcctggaatcttcccagcctacatttctaaaagaactatagctgccaccaatagctgtggtctggaaaagcttcttccacaggactgccagtcctcacagaaagaagaattcctggtttcgcaagatcaagttccgtatacaaggcaa

SEQ ID NO: 122637 - DNA, 601 bp, Human
gttttaactttccccccttattcctcaaaagtagccaacaaaacaatcttgaggttagatggggtttggcacagggatccaaagcctgcagtcctactagactaccagctcctcagaggcggagtgtggcctatacagtttcacagccccagcctctcacagtacctggcacatggtgggtacccaataaatgctgaaataatctaaggtgatttgtcaggggcacttttctggttacaaaacaaaacaaaaccctttcctcaagagaccaaagactcttattgaaacgtgcaaagtcacmgggaagttcttaaaaggaaaaggacagtcacagctctagggcaactgcttgccaactaataatgtgagatgaaaagagctggctttggaagtgtcatgtggcaacaagctgggagaaggtggggggtatcacagataaagaagagctggtgacaaaacgcaaagagtatgcacatctacagtgaacccccacctggcaggctcacccccacgtggagggaacggcaaaagtggatgaaaactctctcacaatcatttttcccctattgccttctttccggataccaactctgcttctgcc

SEQ ID NO: 122638 - DNA, 601 bp, Human
tctaaggctcaaaatgggttctgtttccagacgtgcttgccttgcttgtctttgcttgtcttaaggactctatttcaggccaatacttgatcctcagacaaactgggacaggttgggaactttgatgttgagatcgccaatgttgatgttccgaggaatctctggcaggttgatgtttttcacagcagacacagcccgcgcaggggctgctgaaaggccaccctaagaagaaatgagaggcgagtatgagacaaattctcactgttatctgcttaatgctaaaaaaaaaaaaaaaaaaaaagcaaaaacaaaaacaaacaagcaggatgggtgtggtggctcacgcctgtaatcccagcactttgggaggccgaggtgggtggatcacctgaggtcaggagttcgagataggcctggccaacatggtgaaaccccatctctaccaaaaatacaaaaattggccaggagtggtggcgggcccctgtagtcccagctactagggaggctgaggcaggaaaatcgcttgaactcagaaggcggaggttgcggtgagctgagatcacgccactgcactccaacctgggcaacagagtgagactct

SEQ ID NO: 122639 - DNA, 601 bp, Human
agtaggttttctattgattctgttcctttatgctgtcctatgaagtagaaataggaatttatattgctactggctattacctatgtcccatcaactcaccctatgactttgcttgtgcatgcccatactccatctacagttctaaattttttccatccttcaaggaccaacccttcacactgcacactcctctaggaaatctttctccatgctgccacctagatgaaaaatattttctccttttctcctgaattcccaaaacatgttattggtaacacttaggacactaatcactctccayctctggattatacttatctgttgtatgtttcaccttcttaccttgcttacaaacttcttgagagatgaatccatatcctgttacacttacgtggttattttgtttgctgttcaaagcaaccttaggaagtaggccttagccccattttcaggatgaagaaactaaaagtttagatagcgtaatctgaaaccttactatagagaactttactatgaacttgaaccataatttgaagaatccatgctgcttccatcatgccaactaggccgagtcttatattcttcatcttgctcactaaat

SEQ ID NO: 122640 - DNA, 601 bp, Human
gcaattgttttctaacacgtccaaagaaggaaatattacaagactatctgatttaccagcagagtcctcaccctattttggtacctagttttcaagtctcctttctttttgactcagttattcaagaaaatttatagtttgaatgtaccttgagaaaaggaagattaaaagttggaacaaagatacaaccatttaaatacaactaatatgacttctgttttaagatgtatgacattttttccttctaaaacttttacattgttgatttcatgaggaatttcttccagacagatgaaaagcmtcattgttccacattaacatttcatgtaaaaagaattaaggaggactgtctttattaaacagtgattgagatagatgatactattataaaattcttggtttgtaaaaggaaagctcgtccacatcagttgtacaaattgggattaattaccagttaaaacccaccatcacaaagacaaggggtttttataattagattttgctatattttgttttgtttgaagaaagcgagctgttgctaggatgtgggagctagtttggttatacaaagtttttgttttaataatactttagaacagaa

SEQ ID NO: 122641 - DNA, 601 bp, Human
tttgaaaatggatacaaaatattgtgttaggactgcagagttttcggttaggaagctattgaccaataaaaactcgaaatgagaaaacagtttttttcattccttgcgactaaaattctcaggcactcaaaaaggtatccaagaacagaaaaacataaattgttaatggtagcgtgattgcattctattctcttcccatttggtttctttctttttttcttttaaataactgtaatatttttggttaatcttgcttgtcatgggggaaaagcggggaaagcattttgcccgcttagctttstgttgatgaatactactctcatttagttttcaagtaggtaagagctacttaatttagtacttgtctaaaacttggggggtcttgtccttgcttttaagtatttatttgaagacaactttgcaaaagtaaacatattttgggctgccgaggatgaacaggtgaagcacaggatttttagggtaatgacactattctgtatgatactataaaatggctgatacatgtaattatacattaatcaaaatccatagaatgtagaacaccaagagtaaaccctaatgtaaactatgtatgttgggg

SEQ ID NO: 122642 - DNA, 601 bp, Human
ttgtggtaaatttaagctagctgtcccttatcaaatagagaagttttgcagagagaggaagggaaaaatacagaaaacagtttttgtttttctcatactcatggttcctaatattttatcttctaaacacaaagtttttgacttgagcattaattctattttatgcccagaactggatttttgaaaatggatacaaaatattgtgttaggactgcagagttttcggttaggaagctattgaccaataaaaactcgaaatgagaaaacagtttttttcattccttgcgactaaaattctcargcactcaaaaaggtatccaagaacagaaaaacataaattgttaatggtagcgtgattgcattctattctcttcccatttggtttctttctttttttcttttaaataactgtaatatttttggttaatcttgcttgtcatgggggaaaagcggggaaagcattttgcccgcttagctttctgttgatgaatactactctcatttagttttcaagtaggtaagagctacttaatttagtacttgtctaaaacttggggggtcttgtccttgcttttaagtatttatttgaagacaactttgc

SEQ ID NO: 122643 - DNA, 601 bp, Human
acgcgataggcctagcaccatctcacacagagacaaagggcaaccctctgcttccaaaggaatgacacaacctgtttctgaagtgattcacatcatctttacttttgaacaacccaatgctcagaaaacaatctaagaatcttcgctgactttagggatgtaagatacggtttcttgacagtatttgggattgtggaaaaaagcaattgaggaaagggcatctccacaacgcaatattgaatttagtgcccaaggtccatcacaggaatccctaacgatccctacaatctctctctctctcttttttttctctctttaccctgaaaataaactgagaagttagtattgggataactattccccttgacccaaataaaaagtcctgggcaaacacaggtacaaattgccaaatggaaaaagttcttctccatcttcagctagagggaggctggggatcccagctctttagaagccggcccgtggacgcccagagaatcccttcggagaccaggtcagggtcactgagcttgcccagcagggcgccgcctcggacgccgccccgcctctcaccttgccagcgccgcgctcgggccgcgaaggt

SEQ ID NO: 122644 - DNA, 601 bp, Human
gcacgcgataggcctagcaccatctcacacagagacaaagggcaaccctctgcttccaaaggaatgacacaacctgtttctgaagtgattcacatcatctttacttttgaacaacccaatgctcagaaaacaatctaagaatcttcgctgactttagggatgtaagatacggtttcttgacagtatttgggattgtggaaaaaagcaattgaggaaagggcatctccacaacgcaatattgaatttagtgcccaaggtccatcacaggaatccctaacgatccctacaatctctctctctctcttttttttctctctttaccctgaaaataaactgagaagttagtattgggataactattccccttgacccaaataaaaagtcctgggcaaacacaggtacaaattgccaaatggaaaaagttcttctccatcttcagctagagggaggctggggatcccagctctttagaagccggcccgtggacgcccagagaatcccttcggagaccaggtcagggtcactgagcttgcccagcagggcgccgcctcggacgccgccccgcctctcaccttgccagcgccgcgctcgggccgcgaag

SEQ ID NO: 122645 - DNA, 601 bp, Human
ctacatgtactcatcaaaccatgccagttctacctccttaataactgtagcttaacacctgaataactgaacaaaaacttacaatttaactctcttaacacttatctacctcaattttatttttataatttatacataatctataattatttttatataattggcacagtgataattccagataaaactcactgaatttctatttccatccttgccaatgatacacacacacaatgtaatgctgagagggttgggaaggaagaatgggagaaaggcagaagttgacagttaaaaaaaaaaagtttccagatggttttcttagtgtcatctctgcaacctcatcaaataagggtccaaaatttatgttacaacatttgtttgatgccttatttaaattgctttactggacattttccatctgttaagctctctgaaagaaacaaaattgccttgtcatagctagacctcatgatcctatacacttacaacgggcagactttgcaggggcccacacctttcaaggtggtttgggaaaatgacacagaaaagttttacatcagctgaaaagaaaaatgcataactcattttggtaatttcagtt

SEQ ID NO: 122646 - DNA, 601 bp, Human
agcattctctctgagttcacaggggagctggtcatttaaaattgtgtggcacacctcatcctcccccaccaacacattctgtctctcttgctcctgcttttaccatgtgaagtgctttctcccactttgccttctgccatgattgtaagcttcctgaggcctccccagaagccaatgcagaaggtatgcttcctgtacagcctgtagaactgtgagctaattaaacctcttttctttataaattacccagtctcaggtatttctttatagtagtgcaagaacggcctaatataacttgcartcaagagttttaactaagacacttattcatcttccaagactaagccaaggttactcttttctaaagattttacaaatcccaataccaccttctccctgactctcacgtgtgcttccctctacctgtaacatttcattactcttacacacctgctactcccatactaatctgtaaactgcttaagaacaaagggaatgtcttatgtatttttacatctctccagtgatgaagggtacataaaagtttaacacatttccctcatcggatattgtaatttgatagcatagaaactgaatttaa

SEQ ID NO: 122647 - DNA, 601 bp, Human
cagatgtactcccaaacctataataaaagtcaagggaaaaagttctccaatatcgacagaaagaaaaatcttctgcttgtacttactaagcctcttcctttgctaatttccttgtaacatctgaaacagagatagatatctttggaggcatttggaaaactcttattactccctctctgtgagatttgtcctacctataagtttgggctttagtctatgtgttgtcctttgtgtctctcaactggcaccagcttcagctaattgaatcagaagtttaagcttatccaagctgggctatttraagtctttttgttagaggggttgaaatcccaaactgggtattttgcttgaactagggtgatgtcaattaacgagctgagactgcctttattggttgcccatgtgtgcaggaaaacagagtcttcaaagagaaagaactaaagctgatggaggccaagcagcaagatgagagaccacataaccccagtgaaggagtagattccttgttccagatgttggcaagtgcctggtctagtcgcagatgcatctggcccttgagttttgcaacaagcctctgtatccttaaaataaaatgccatct

SEQ ID NO: 122648 - DNA, 601 bp, Human
tgtggtattagttttcctgaacttttataataatgcaaggttcagaaaatcttgcccaacttagctccatctttctttgtttttattttatttatttatttatttatttaatttttttgagacggagttttgctcttgttgttcgggctggagtataatggtgtgattttggctcactgcaatctctgcctcctgggttcaaacgattctcctgtctcagccttttgagtagctgggattacaggcatgcaccaccacgcctggctaattttgtattttgagtagagacagggtttcaccrcgttggtcaggctggtcttgaactcctgacctcaggttatcctcccgcctcggcctcccaaagtgttcggattacaggcgtgagccaccacacctggcctccttgtttttataaagtgctaaaaataaaaataaataaaaaatacagcagtacttttgagatttcctgatactgctcccctctctggctgttgaacatttgaagcatggccagtgtgactgagaagccaaattttaaattttaattaattttaactaattaaaacttaaataaaattaattaaaattgaaataaccacgt

SEQ ID NO: 122649 - DNA, 601 bp, Human
actcacttcttagtttttctaattctgatttgtgtgatcctttacatatattatcttgttaatgccttttagcttgttctaaaataatagcctatagttttgttttgtggacacatttttctgatgctctttcactatctgtagtgatgttatgctgctccttttttctctttttttgttatgacaacttttatggaatttgatcttgataatttgctgttgctcattttcatgtggtattagttttcctgaacttttataataatgcaaggttcagaaaatcttgcccaacttagctccwtctttctttgtttttattttatttatttatttatttatttaatttttttgagacggagttttgctcttgttgttcgggctggagtataatggtgtgattttggctcactgcaatctctgcctcctgggttcaaacgattctcctgtctcagccttttgagtagctgggattacaggcatgcaccaccacgcctggctaattttgtattttgagtagagacagggtttcaccgcgttggtcaggctggtcttgaactcctgacctcaggttatcctcccgcctcggcctcccaaagtgttc

SEQ ID NO: 122650 - DNA, 601 bp, Human
tgatttggtgttcttggagtagttcaatatgttcttctgtccatggcatttcctgccaattggcagctggatacaaagattggaccagattcaggtgttacccctttggtagccctatgggaggtgtttgacacgtaatgtcagattgtgtctcgttttatgatggcagcagtcagcgatactgattttactcattgttttgaaatggtgatattctaattctatcatttttaatgtattagttggaatacttctataaagagacacattctaatatttggttatccagtggtacagttcrtattgaaaagatacaataaatccttgattctttctctttacttactaattctttagattgttaaatgcttccctattattctccaaagatggctcgttttaaaaatattattatgaatttatagatatttgatgggttttagtttactgtaattgttattattattgaagctcaagttgaccaatttttggccagcaagagactcttcaagctggcttctaacttcttttgacatgaacccagtagtttttcataccctccttgctctcttctatgacaacatgtttcaggcttaactta

SEQ ID NO: 122651 - DNA, 601 bp, Human
tcaactaacttttgaggtatttttttttaacacaacaacagatgatccatttctggtatcatgtatagcagtggttctcaactgaggatgggtttgctctccagaagacatttggcaatgtctggaggtatttttggttgtcataactggagtgggatgctagtggcctttagtgagtcgaggcccagaatgctattatacattctgcaatacacaggagagctccctacaacaaagattatctgatccaaattatcattagtatcatggctgaggaatacttatttaaaggttcccttgwaataaaaatgacagtcaaatgttaagtaaatcccaagcctggcaaaagtagcctatatctcgttgtattatggcatcccccaaatcccaaatacccaaaggacaggacaggataggacagttgttgggataggactactctccagaacaaaaatttcaaacaatgcctctctggaaggtcatcacaggggacaatggataaggaagggcatctcggtagtaagaattcagtgcatacacaatggaagaccaagaacctaactccacccttaggaaagttagctcttatgttctcagttct

SEQ ID NO: 122652 - DNA, 601 bp, Human
tgtcccatttgggctatctcagctgatgttgtattcagcagagaaaagatatccttacctttcctgcccaaactgcagatttttgagcaaaattaatgattagggttttttttttaatcaactaacttttgaggtatttttttttaacacaacaacagatgatccatttctggtatcatgtatagcagtggttctcaactgaggatgggtttgctctccagaagacatttggcaatgtctggaggtatttttggttgtcataactggagtgggatgctagtggcctttagtgagtcgaggyccagaatgctattatacattctgcaatacacaggagagctccctacaacaaagattatctgatccaaattatcattagtatcatggctgaggaatacttatttaaaggttcccttgaaataaaaatgacagtcaaatgttaagtaaatcccaagcctggcaaaagtagcctatatctcgttgtattatggcatcccccaaatcccaaatacccaaaggacaggacaggataggacagttgttgggataggactactctccagaacaaaaatttcaaacaatgcctctctggaaggtcatc

SEQ ID NO: 122653 - DNA, 601 bp, Human
cataaaaatttcatggactccactttactcttttggaacattttcttttgaaacccagtcaccgttcataaagacaccaaagcaactcatagaagcctagctggagaggaactgatgccccaggtgacagccagcactaacttgccaatgaattgtcccatttgggctatctcagctgatgttgtattcagcagagaaaagatatccttacctttcctgcccaaactgcagatttttgagcaaaattaatgattagggttttttttttaatcaactaacttttgaggtatttttttttaasacaacaacagatgatccatttctggtatcatgtatagcagtggttctcaactgaggatgggtttgctctccagaagacatttggcaatgtctggaggtatttttggttgtcataactggagtgggatgctagtggcctttagtgagtcgaggcccagaatgctattatacattctgcaatacacaggagagctccctacaacaaagattatctgatccaaattatcattagtatcatggctgaggaatacttatttaaaggttcccttgaaataaaaatgacagtcaaatgttaagtaaa

SEQ ID NO: 122654 - DNA, 601 bp, Human
attaaaagggcacctatgataaaatgtgagaggagagaagaactaaagaatgcaatattagacaaaaaagactgtcaattcctgggttctaaagtaaacctgtgtctcatacccaggatttccatatggaaaataatttttttaaattaagaaatgacttctgggcaaagatcaagtccaggatggtgattaagagtctttgtgaagacttcagaaacacataacatagtgactgatatataacctttcagagagacagaaggccccctaggtatcttagagtgcaccacatagatattayacattaaaaagaaaagatttataagaataataaatgtgttatccaatgaaagtttcacagtttgagctcaagatagggaaagaataatctcaaagatatttgtaggtgtagctttgacctaatagaatgtattatatgttgatacataagaaactcacaagatttctttaagtaattgtaacagcacagactcaacagacagagtcagtacagctccatcgaacaggcagttcctttgaattcccaagtttgcaagctggaagctggttaaaagaatgacttaggtgcaaacatggagta

SEQ ID NO: 122655 - DNA, 601 bp, Human
gcaatgccttcctctggaatacctcctgaagcacctgcctgaggttgttttacagttaactttttccataagtaggagtacacaccaaaataataaattgttagtattataaatacctaaaccagtaacatagttattatcattgtcaagtattatatactgtgcataattatattgctataattttatataactggccacacaatgggtgtgttttggcagcataactacaaacacatgaattatgtgttgtactataacattctaatggctacagtgtcacctggctgtacgaattttyagttccattacagtcttacgggaccaccaccttatgtgcggtcattgactgaaacatcatcatttggtgcatgaatgtgtcttctatgcacttcctgcctaaatcctctaaaactctgatttcaaagcacagaaacctggaatcaatccccatacaagataaaactttctattatctctgactatctaagacagtgacctcaatttaaacaggcctttaaattgaggatagaagaaatagacggagacttaaacctgttgctgagagatttaaaactagggttacaggctagatacaaat

SEQ ID NO: 122656 - DNA, 601 bp, Human
tactttttaactctttcgtaatagcacttagcttaaaacgcaaatacattgtgcagctgtacaaaaatattttctttcttatatcttgattctataagctttttggatttcttctttttttttttactttttgaccctttttaattaaaatctaagatgcaaacacacacattagcctaggcattcacagggtcaatttcatcaatatcaccatcttccttctccacatcttgtcccactggaaggttttcagaggcaataacatgcatggagttctatctcctgtgatagcaatgccttyctctggaatacctcctgaagcacctgcctgaggttgttttacagttaactttttccataagtaggagtacacaccaaaataataaattgttagtattataaatacctaaaccagtaacatagttattatcattgtcaagtattatatactgtgcataattatattgctataattttatataactggccacacaatgggtgtgttttggcagcataactacaaacacatgaattatgtgttgtactataacattctaatggctacagtgtcacctggctgtacgaatttttagttccatta

SEQ ID NO: 122657 - DNA, 601 bp, Human
ttactgtctatcacttatacctcacattaattgaataactgaattgctatttaactgtttcctaccatttactcattcttttttttactagaatttaatgaaaggtcatcttacatctttggactatgtgccatattgactaggagaggaataagctctcagtgggaaatgaattgaattgaggtgaattaacttgaatagaattagtagcctgctgtgggcagagaaatgtaatataaaattaactatttcctaataattcaccaaaaccagaaaaaatgggatgaagtaaattgtgcamatattttgaccatattattttttaagattacagagagattaaatcttaaccagtaccaaagaaaccaattaattaattcatctgcctttgatacctataatttctcatgtgcataggaacactgatgcagtttctgtgatctatcaaaagcagatgaaatatggtggaaaatttgttgcacaatttacttttcaccgatccaaaaagaacatgttgcccttatttggcatatttttcacatcgttattttgactaatctatttgttcaaatgataggcgtcttgaagttactacatcctc

SEQ ID NO: 122658 - DNA, 601 bp, Human
taacattttactaatacaatgtgcagatcataacatatgtcatctcttatgtgtgcatgtatttctgtaggataaatccctgtgagtgggactcctgggtcaaaggtgagatacatttgtaatgtgatagatattgccaaattatacttcataaagaatatactatttgtactcataccaatgatatatgggtgcctctttcccttcagcatcactaaacttaatttttgctaatttaataactgaaaaaatgcatctgattgtggtttaatttaaattctcttattatgaaagaagttgkgtatttttttcttatgtttataataatttatttgacttttctgtgaactggtttttctgtcctttgcacatttttctcttagattattgatactttaaaaaataaattcccagcatattaattctgaatattattttcccctctggtttgccatttgtcttctgacaaatggcagatggttttgtcacaaaaaagattgtttaatgtaatcagttttgtcagttttaaaacagcttctgcattttgaatcaaagttagaaaggactctcctaacataattttataaagaagttctcttct

SEQ ID NO: 122659 - DNA, 601 bp, Human
aacatcttggctgggcgcggtggcttacgcttgtaatcccagcactttgagaggccgaggtgggcagattatgaagtcaggagtttgagaccagcctggccaacacaatgaaaccccgtctctactaaaaatgcaaaaattagctgtgtgtggtggcgagcacctgtaattccagctactcaggaggctgaggcaggagaatcacttgaacccaggaaacagaggttgcagtaagccgagatcacgccattgcactccagcctgggcgacacagcgaactctgtctcaaaaaaaaaaaaaacaaacatcttatcacatatagatctttccacatccttaacacaaagcattttctcattcttttttataactacataatattccataatgtacatctactatggtttctataccagtcctctattaatggacatgactattctctaacattttactaatacaatgtgcagatcataacatatgtcatctcttatgtgtgcatgtatttctgtaggataaatccctgtgagtgggactcctgggtcaaaggtgagatacatttgtaatgtgatagatattgccaaattatacttcataaaga

SEQ ID NO: 122660 - DNA, 601 bp, Human
atcactcattaatttattttgaatctttccaatatgagcaaatacaattatatttttatgtttctagatttttgatttttaaaaataaacatcttggctgggcgcggtggcttacgcttgtaatcccagcactttgagaggccgaggtgggcagattatgaagtcaggagtttgagaccagcctggccaacacaatgaaaccccgtctctactaaaaatgcaaaaattagctgtgtgtggtggcgagcacctgtaattccagctactcaggaggctgaggcaggagaatcacttgaacccrggaaacagaggttgcagtaagccgagatcacgccattgcactccagcctgggcgacacagcgaactctgtctcaaaaaaaaaaaaaacaaacatcttatcacatatagatctttccacatccttaacacaaagcattttctcattcttttttataactacataatattccataatgtacatctactatggtttctataccagtcctctattaatggacatgactattctctaacattttactaatacaatgtgcagatcataacatatgtcatctcttatgtgtgcatgtatttctgtag

SEQ ID NO: 122661 - DNA, 601 bp, Human
tccacctggtacgcatgggattggtcagtgctagtcatgtcgatgattatcagtgatgagcctgaaggctagagccagtgttaggcagggcctaggaaatgctgctgtgttcaattttcaaatatttcttagatctgtttttgtaaacaaacaaacaaacctttaatggtgtcccaaataaggtctcaatcccattataatccaacctctgaatctattggtccattactcattactacctaactcaactgcccagccgggcggatccctcaaagtctcataatgcagaatgtgccttcccatcctctgtgccttggctatgcttttcttttttttattattttttattttttcattttgagtgcctgctctcatttatctctgttatcaaaacaatatgatatcatatgcatgtaatgttttataaactataaaataatatataaatatgaactatatttactggaatccacaccctgcaagaactagtttttgtccccctccttccaggaaaacttactaaacccctatagccttcagtgattgactttttcttttctatgttttctgcctgcttatcttccttcaaccattctgaatt

SEQ ID NO: 122662 - DNA, 601 bp, Human
gtgttctccaactacaatgaaatgaaattagaaactgataatacagggaaaattgaaaaattaaaatatgtggaaattttacaacacatccctaagtaatcaagggttccacctggtacgcatgggattggtcagtgctagtcatgtcgatgattatcagtgatgagcctgaaggctagagccagtgttaggcagggcctaggaaatgctgctgtgttcaattttcaaatatttcttagatctgtttttgtaaacaaacaaacaaacctttaatggtgtcccaaataaggtctcaatcccwttataatccaacctctgaatctattggtccattactcattactacctaactcaactgcccagccgggcggatccctcaaagtctcataatgcagaatgtgccttcccatcctctgtgccttggctatgcttttcttttttttattattttttattttttcattttgagtgcctgctctcatttatctctgttatcaaaacaatatgatatcatatgcatgtaatgttttataaactataaaataatatataaatatgaactatatttactggaatccacaccctgcaagaactagttttt

SEQ ID NO: 122663 - DNA, 601 bp, Human
ggatatagaaatgattaaaaaaaaacagaaagagacaaagagagacttggagttgacaagtacaatgactaaaatacaaaatttactagaggggttgaagagcagacttgaggaggtagaagagtcaggtaatttgaatgtaaaaaaattgaaattacccagtctgaaaaacagaaagaaaaaagaatgaagaggccaggcgtggtggctacacctgtaatcccagcactttgggaggccaaggcaggtggatcatcaggtcaggagttcgagaccagcctgactaacatggtgaaacccygtctctactaaaaatacaaaaaaattagccaggcatggtggcatgcacctgtaatcccagctaatcccagctactcaggaggctgaagcaggagaatcacttgaatctgggaggcagaggttgcagtgagccaggagtgcaccactgtactccagcctgggcaacagagccagactccatctcaaaaaaaaaaagaatgaagaaatataaatagagctgcagtgacctctaggataacatcatgcatgaagcatacacataatatcccaggagaggagagaaaaaaatggggcagaaaga

SEQ ID NO: 122664 - DNA, 601 bp, Human
taagttctcactccaggctgtggactccacctgaaactgacagtccagcccccggttttcaggccatccatggcttgaaggtggggcttcactagggacctgcccctttctgcccaggagcctgtctgcctcctgccaccatcaacatgtcatccatggcacccaggcagttcctactgaagagcacctgaaggcctgtgctgagctgccctcagcccctattggcctccctcccatgctcgttggcacccaaagtccagaggaggcccaggcagcagggggctggcctgtcagtgccacyccaagtgcatgcacacctggctgggttgcaacaacacccaggctcagccacaactgtgctgcaccctggagtgggtgctgggagttgggagagaataggcaatgggagcaggcacttgccagcctgtgggagcaaggagctttctgggcccccaagagcacagggatgcccagctgggtggctgcagctgtaggagcatggggctcctgcccagctgactcagtagaggccagggctgccacctgttctggcccccactggctccatgcagcatgcagccccactgtgcctccgccactg

SEQ ID NO: 122665 - DNA, 601 bp, Human
aaattagagacctagttatccttagctgttatgttcagtccacaaatcatgttattctgtttataaatagggcaaaataaaaagtgatctttaattttctttgattaatgagctattaactcaacttgaagacactaagctctcttaaaaaaaaaaaaaaaaagcactcgtggcaatgaaactgccagcccagtgtcaccagttacccaagggtgacaccctcgtcctgctggagatggtgcatctgctgcttcgagagcccttttctaacctgggaaagcttgagtttaaacatgaagakagtgaaataaggtaagcctttagaagcaaaactttcatgctaagtttaggagtaatcttcgtatgtttgtttctttaaaatactgtaatagtctaaagaatctaacattaaagaccgacagattagcctgatgcctccagttttaaatatgtactagaatttagacttgtcatggaaccaatctaagtgtccaccaactgttgattgtataaagaaaatgtggtttgtataccccacgaaatactatgcacccataaaaaagaatgaaatcatgtcctttgcagcaacatggatggagca

SEQ ID NO: 122666 - DNA, 601 bp, Human
taactcaacttgaagacactaagctctcttaaaaaaaaaaaaaaaaagcactcgtggcaatgaaactgccagcccagtgtcaccagttacccaagggtgacaccctcgtcctgctggagatggtgcatctgctgcttcgagagcccttttctaacctgggaaagcttgagtttaaacatgaagatagtgaaataaggtaagcctttagaagcaaaactttcatgctaagtttaggagtaatcttcgtatgtttgtttctttaaaatactgtaatagtctaaagaatctaacattaaagacygacagattagcctgatgcctccagttttaaatatgtactagaatttagacttgtcatggaaccaatctaagtgtccaccaactgttgattgtataaagaaaatgtggtttgtataccccacgaaatactatgcacccataaaaaagaatgaaatcatgtcctttgcagcaacatggatggagcaggaggcccttatcctaagtgaactaactcagaagcaggaaatcaaaaacctcatgttctcacttataagtaggagctaaacgatgcgtacacatgggcgtaaagatggagataata

SEQ ID NO: 122667 - DNA, 601 bp, Human
aatcttcgtatgtttgtttctttaaaatactgtaatagtctaaagaatctaacattaaagaccgacagattagcctgatgcctccagttttaaatatgtactagaatttagacttgtcatggaaccaatctaagtgtccaccaactgttgattgtataaagaaaatgtggtttgtataccccacgaaatactatgcacccataaaaaagaatgaaatcatgtcctttgcagcaacatggatggagcaggaggcccttatcctaagtgaactaactcagaagcaggaaatcaaaaacctcaygttctcacttataagtaggagctaaacgatgcgtacacatgggcgtaaagatggagataatagacactggggaccccaaaactggggaggaggctgggagggaggaggagaagggttgaagcagggagaagggttgaagaatctcctattgcatataatgttcaatatttggatgatgggtacactagaaacccagtctccactattacacatataatacccatgtaacacacgagtacatgtactccctgaatctaaaatttaaaaaaaatttaaaagaatttagacttgtgattttaa

SEQ ID NO: 122668 - DNA, 601 bp, Human
aacatggatggagcaggaggcccttatcctaagtgaactaactcagaagcaggaaatcaaaaacctcatgttctcacttataagtaggagctaaacgatgcgtacacatgggcgtaaagatggagataatagacactggggaccccaaaactggggaggaggctgggagggaggaggagaagggttgaagcagggagaagggttgaagaatctcctattgcatataatgttcaatatttggatgatgggtacactagaaacccagtctccactattacacatataatacccatgtaacacrcgagtacatgtactccctgaatctaaaatttaaaaaaaatttaaaagaatttagacttgtgattttaagttgcaaagggaaaaaaatgaccttatttttctgaataattattggaatttcaaggaaaactgatgcttcactattttaataacattttatttcttagatttataagaatttattatttgaagatattttgcttgttaaggcaatacaattgctttgttaggcaactgaagtgcttacaaaagaaatgtaatatattacatttataatgcagttcagagtttaagagaattt

SEQ ID NO: 122669 - DNA, 601 bp, Human
agtgaactaactcagaagcaggaaatcaaaaacctcatgttctcacttataagtaggagctaaacgatgcgtacacatgggcgtaaagatggagataatagacactggggaccccaaaactggggaggaggctgggagggaggaggagaagggttgaagcagggagaagggttgaagaatctcctattgcatataatgttcaatatttggatgatgggtacactagaaacccagtctccactattacacatataatacccatgtaacacacgagtacatgtactccctgaatctaaaattwaaaaaaaatttaaaagaatttagacttgtgattttaagttgcaaagggaaaaaaatgaccttatttttctgaataattattggaatttcaaggaaaactgatgcttcactattttaataacattttatttcttagatttataagaatttattatttgaagatattttgcttgttaaggcaatacaattgctttgttaggcaactgaagtgcttacaaaagaaatgtaatatattacatttataatgcagttcagagtttaagagaatttaattaattaaatttacaaataattattaagg

SEQ ID NO: 122670 - DNA, 601 bp, Human
ataagaatttattatttgaagatattttgcttgttaaggcaatacaattgctttgttaggcaactgaagtgcttacaaaagaaatgtaatatattacatttataatgcagttcagagtttaagagaatttaattaattaaatttacaaataattattaaggaaacagagtcttcaagttgagttaatagctcattaatcaaagaaaattgaaggtcactgtttttattttgccccatttataaacagaataacaagatttgtagactgaacataacagctaaggataactagtttatttcmttttaatggaacattaatttaaaacccaagcaactgtgagtagccctttctggactgccctcagacattaaaataaaaaacaaaacaattcacaatgacagatattaatacgaatagctaacgtttgtatggtgttttacactaatgctctcttccattactaatgagaagcactgggaggttagtaacttgctcgaggccctgcgtctaggaagttggactggagcttggctctttgactccagaggctgcactcttttttttttttgagatggagtctcgctctgtcccccaggctgg

SEQ ID NO: 122671 - DNA, 601 bp, Human
atattttgcttgttaaggcaatacaattgctttgttaggcaactgaagtgcttacaaaagaaatgtaatatattacatttataatgcagttcagagtttaagagaatttaattaattaaatttacaaataattattaaggaaacagagtcttcaagttgagttaatagctcattaatcaaagaaaattgaaggtcactgtttttattttgccccatttataaacagaataacaagatttgtagactgaacataacagctaaggataactagtttatttcattttaatggaacattaatttwaaacccaagcaactgtgagtagccctttctggactgccctcagacattaaaataaaaaacaaaacaattcacaatgacagatattaatacgaatagctaacgtttgtatggtgttttacactaatgctctcttccattactaatgagaagcactgggaggttagtaacttgctcgaggccctgcgtctaggaagttggactggagcttggctctttgactccagaggctgcactcttttttttttttgagatggagtctcgctctgtcccccaggctggagtgcagtggcaggatctcgg

SEQ ID NO: 122672 - DNA, 601 bp, Human
attaattaaatttacaaataattattaaggaaacagagtcttcaagttgagttaatagctcattaatcaaagaaaattgaaggtcactgtttttattttgccccatttataaacagaataacaagatttgtagactgaacataacagctaaggataactagtttatttcattttaatggaacattaatttaaaacccaagcaactgtgagtagccctttctggactgccctcagacattaaaataaaaaacaaaacaattcacaatgacagatattaatacgaatagctaacgtttgtatrgtgttttacactaatgctctcttccattactaatgagaagcactgggaggttagtaacttgctcgaggccctgcgtctaggaagttggactggagcttggctctttgactccagaggctgcactcttttttttttttgagatggagtctcgctctgtcccccaggctggagtgcagtggcaggatctcggctcactgcaagctccgcctcccgggttcacgccattctcccacctcagcctcccgagtagctgggactacagacgtccgccaccactcccggctaattttttgtattttt

SEQ ID NO: 122673 - DNA, 601 bp, Human
aacataacagctaaggataactagtttatttcattttaatggaacattaatttaaaacccaagcaactgtgagtagccctttctggactgccctcagacattaaaataaaaaacaaaacaattcacaatgacagatattaatacgaatagctaacgtttgtatggtgttttacactaatgctctcttccattactaatgagaagcactgggaggttagtaacttgctcgaggccctgcgtctaggaagttggactggagcttggctctttgactccagaggctgcactcttttttttttttgagatggagtctcgctctgtcccccaggctggagtgcagtggcaggatctcggctcactgcaagctccgcctcccgggttcacgccattctcccacctcagcctcccgagtagctgggactacagacgtccgccaccactcccggctaattttttgtatttttagtagaaactgggtttcaccatgttagccaggatggtctccatctcctgacctcgtgatccgcccgcctcggcctcccaaagtgctggcattacaggcgtgagccaccgcacccggcccggaggctgctctcttaac

SEQ ID NO: 122674 - DNA, 601 bp, Human
tctttgattttaagataggtccatcttgcactgtagacaccaggttggttgcttctgactgccacatagtaccatggagcatgcgtcggccacattgtacctccccctccctgggggattgctcattcagattgccgcccaacatgctgtgataattttttttttttttttttttttgagacagagtctcactctgacgcccaggctggagtgcaatggcacaatctcagctcaccgcaacctctgcctcctgggttcaagcagttctcctgcttcaccctcgcaagtagctgggattacrggtgcacgccaccacacctggctaatttttgtatttttagtagagacggggtttcaccatgttggtctggctggtctcaaattcctgatctcgtgatctgcccaccttggcctcctaaagtgctgggattacaggtgtgagccactgcgcccggctgataaatattcttaaacgtgttgtctttttagacctgtgtgagaattccccaggataaaagtatatacccaggagtgaaattgcttggtcatagatcatagctatgtcatatgctacgtactataagattacactccaaactag

SEQ ID NO: 122675 - DNA, 601 bp, Human
tgttgtctttttagacctgtgtgagaattccccaggataaaagtatatacccaggagtgaaattgcttggtcatagatcatagctatgtcatatgctacgtactataagattacactccaaactagccatgctccccacccagataatactacatatattattctataactggatttctttcacttcatatatgacaaaattttaaacggttccaactggggaaatttaagaaaaaaattaaggtgcaaactctaatcaactgtggaaacaactgaaactgtgtataggataacagcttcyacagtcagcctgcaaagcctgtctaccactcattaactgtgtgaccctggggtaatagcctaacctccctgtgcctgcctcagttttctcattggtaaaatggatataataatagtacctaccttattttaggatgttattaaataatgtacataaagtatttagactattccctggcacatagcaagaacccaatgactgttggctattattgttgaacatttaggtaatttccagtttttttgctatttctcaacaatgctccaatgacattcaggatttttttttttatggtggtaa

SEQ ID NO: 122676 - DNA, 601 bp, Human
gatcttaggcaagtgatgccacctgtctgagcctctgttgcctcatctgtaagatgggaatgatacctatttcactgtgttgctgggaggatttgagaattgcaatgtgtcttagtctgttcagattgctataacaaaataccatagactaggtggcttataaacagcagatatttatttcttacagttttggaggctgtgaagtccgagatcaaggcactgcagattcagtgtctggcgagggccttcttggctggttcagagacaatgccttcttgctatgttctcatctggtagaagraataagtcagctctctggggcatcttttaaaagggcatgaaccccaatcagcagagctccaccgttaggacctaatcacctcccaaagggagtgcagttatttgcatgcctgtaactgaagaacggtcctcctctatcagggaaagttgtcctcttcgactgagcacacagcttcaagagggacgcatgtgaagtggtgagggaggaaggggatacccacctagccagcctcacatcctaccagacttttgatttctatcatttccttctgattctttcctagatttctcatctctctgc

SEQ ID NO: 122677 - DNA, 601 bp, Human
attagagcctgtaatgattaattttatgtgtcagttttgaggttccaagatgcttgttgaaagtgaagatatttaaagtgttgaaagaaacaaacaaccattaaattctgtagctaatgaaattattcttcaaaagtgaaggagaaataagatttgctctcagtcaaagggtatttgtagccgttagacctaccttccaagaaatgttaaaataaaattttcagagaaaaggaaaatgatatagggccaggaatttggaactaaagaaataaagaatgccagaaaaggaataagtttagaytggctgactgtagaccaaaaaaaaaaaaaaaaaaaggaataaatgaggtaaaataaaatattttaattttcctatttttaattactttgatagattattactttgttcaaagtaataatagcaacaatgtgttgggtgattatagaatacggataagtgaaatgaaagctagttgtcttataagtatagtagggaggaattgggaacagtcttgttataaatggacttctattagttgtaaatgtatatggaaaactctagggcaacttttaaaaaatgtaaagacatataattgatatg

SEQ ID NO: 122678 - DNA, 601 bp, Human
tgattaattttatgtgtcagttttgaggttccaagatgcttgttgaaagtgaagatatttaaagtgttgaaagaaacaaacaaccattaaattctgtagctaatgaaattattcttcaaaagtgaaggagaaataagatttgctctcagtcaaagggtatttgtagccgttagacctaccttccaagaaatgttaaaataaaattttcagagaaaaggaaaatgatatagggccaggaatttggaactaaagaaataaagaatgccagaaaaggaataagtttagattggctgactgtagmccaaaaaaaaaaaaaaaaaaaggaataaatgaggtaaaataaaatattttaattttcctatttttaattactttgatagattattactttgttcaaagtaataatagcaacaatgtgttgggtgattatagaatacggataagtgaaatgaaagctagttgtcttataagtatagtagggaggaattgggaacagtcttgttataaatggacttctattagttgtaaatgtatatggaaaactctagggcaacttttaaaaaatgtaaagacatataattgatatgctaggagaagaaag

SEQ ID NO: 122679 - DNA, 601 bp, Human
ttaaagtgttgaaagaaacaaacaaccattaaattctgtagctaatgaaattattcttcaaaagtgaaggagaaataagatttgctctcagtcaaagggtatttgtagccgttagacctaccttccaagaaatgttaaaataaaattttcagagaaaaggaaaatgatatagggccaggaatttggaactaaagaaataaagaatgccagaaaaggaataagtttagattggctgactgtagaccaaaaaaaaaaaaaaaaaaaggaataaatgaggtaaaataaaatattttaattttcytatttttaattactttgatagattattactttgttcaaagtaataatagcaacaatgtgttgggtgattatagaatacggataagtgaaatgaaagctagttgtcttataagtatagtagggaggaattgggaacagtcttgttataaatggacttctattagttgtaaatgtatatggaaaactctagggcaacttttaaaaaatgtaaagacatataattgatatgctaggagaagaaagaaaacagagtcatataaaatgcttaattaaaaccagacaaggcagaaaaagagagaaa

SEQ ID NO: 122680 - DNA, 601 bp, Human
taagtgaaatgaaagctagttgtcttataagtatagtagggaggaattgggaacagtcttgttataaatggacttctattagttgtaaatgtatatggaaaactctagggcaacttttaaaaaatgtaaagacatataattgatatgctaggagaagaaagaaaacagagtcatataaaatgcttaattaaaaccagacaaggcagaaaaagagagaaaattttttaaaggaaataagaacaagtgcaacaaataaaaaacagctatcaacctgttagaatatcaatctaactatatcaayaatcactaaatgtgaatggtctacatataccaattaaaagagactgtcagagtggataaaacaaagcaagaccccaactatatgttaagagcaatcttctttaaatataaagacccagataaattcaaagtaaaggaatggagaaagataaactatgctgtcactaatcaaaagagacctaggaccgctatgttaatttcaggcaaagcagattcagaacaaggaaagctgtcagggataaagaatacataacgatgaaggcatcaattctctaagaaaacatagcaatctttaacatgc

SEQ ID NO: 122681 - DNA, 601 bp, Human
tggaaaactctagggcaacttttaaaaaatgtaaagacatataattgatatgctaggagaagaaagaaaacagagtcatataaaatgcttaattaaaaccagacaaggcagaaaaagagagaaaattttttaaaggaaataagaacaagtgcaacaaataaaaaacagctatcaacctgttagaatatcaatctaactatatcaacaatcactaaatgtgaatggtctacatataccaattaaaagagactgtcagagtggataaaacaaagcaagaccccaactatatgttaagagcaaycttctttaaatataaagacccagataaattcaaagtaaaggaatggagaaagataaactatgctgtcactaatcaaaagagacctaggaccgctatgttaatttcaggcaaagcagattcagaacaaggaaagctgtcagggataaagaatacataacgatgaaggcatcaattctctaagaaaacatagcaatctttaacatgcaggcacctcacaacactgtcaaactatctgaggcaaaaactgatagaactgcaaggagaaatagacaaatccactattatatttggagaggccaa

SEQ ID NO: 122682 - DNA, 601 bp, Human
gagactgtcagagtggataaaacaaagcaagaccccaactatatgttaagagcaatcttctttaaatataaagacccagataaattcaaagtaaaggaatggagaaagataaactatgctgtcactaatcaaaagagacctaggaccgctatgttaatttcaggcaaagcagattcagaacaaggaaagctgtcagggataaagaatacataacgatgaaggcatcaattctctaagaaaacatagcaatctttaacatgcaggcacctcacaacactgtcaaactatctgaggcaaaaaytgatagaactgcaaggagaaatagacaaatccactattatatttggagaggccaatacccctctatcagtaattgacagccccagaaggtggaaaatcagtaattacatagtttacctgaatagccccatcaattgtctggattaaattgacatttatggaatacttcatttaacaacagcaagaatacacagtctacacaagctcacatgaaacattcagcaagtgtttgatatttaatgtttgtgtccctccaaaattcataggttgaagccctaacccccacgtgactgtatttgga

SEQ ID NO: 122683 - DNA, 601 bp, Human
agtctacacaagctcacatgaaacattcagcaagtgtttgatatttaatgtttgtgtccctccaaaattcataggttgaagccctaacccccacgtgactgtatttggagatggggtcttgaaggatgtaattaaagttaaatgaggtcctatggggggtgaccccatccaatatgattgatgtcttttatgtctttttttttttttttttcttttgagacaggatctcactcaggcgaccaggctggagtgcagtggtgagatctcagctcactgcaacctcagcctccagagctcaagwgattctcctacctcagcctcccaggaagctgggactataggcgggcaccactgcacccagctaatttttgtgttttttgtagagacagggttttgccatgttatccaggctgatcttgaatgcctgggatcagatgatccacctgtctaggcttcccaaagtgctgggattataggtgtgagccacggctctcggttggattaatgtccttataagaggagacactggagcgcttgcattctcccgtgcttctctctgtcccttcctccctctctctccacattggtcgtgtgaccacaa

SEQ ID NO: 122684 - DNA, 601 bp, Human
tcaggcgaccaggctggagtgcagtggtgagatctcagctcactgcaacctcagcctccagagctcaagagattctcctacctcagcctcccaggaagctgggactataggcgggcaccactgcacccagctaatttttgtgttttttgtagagacagggttttgccatgttatccaggctgatcttgaatgcctgggatcagatgatccacctgtctaggcttcccaaagtgctgggattataggtgtgagccacggctctcggttggattaatgtccttataagaggagacactggagygcttgcattctcccgtgcttctctctgtcccttcctccctctctctccacattggtcgtgtgaccacaaagccagaaagtggctgtctgcaacccaagggaagagccctcaccagacgccaacctggctggcaccttgatcttggacttccaatctccagaactgtgagaaaatacatttttgttatttaagccacctggtgtatggtattttgttttagcagcctgagcagacgaagacatcaagaaagaacacttctgggcaataaaacacactttaacaaatgtagaagaatagaaa

SEQ ID NO: 122685 - DNA, 601 bp, Human
tctcctacctcagcctcccaggaagctgggactataggcgggcaccactgcacccagctaatttttgtgttttttgtagagacagggttttgccatgttatccaggctgatcttgaatgcctgggatcagatgatccacctgtctaggcttcccaaagtgctgggattataggtgtgagccacggctctcggttggattaatgtccttataagaggagacactggagcgcttgcattctcccgtgcttctctctgtcccttcctccctctctctccacattggtcgtgtgaccacaaagcmagaaagtggctgtctgcaacccaagggaagagccctcaccagacgccaacctggctggcaccttgatcttggacttccaatctccagaactgtgagaaaatacatttttgttatttaagccacctggtgtatggtattttgttttagcagcctgagcagacgaagacatcaagaaagaacacttctgggcaataaaacacactttaacaaatgtagaagaatagaaatcatacaaagtatggtgtcaaatcacaatagaattgaaaagggcacgtacacgtgagtgccctggagtttaag

SEQ ID NO: 122686 - DNA, 601 bp, Human
cactgcacccagctaatttttgtgttttttgtagagacagggttttgccatgttatccaggctgatcttgaatgcctgggatcagatgatccacctgtctaggcttcccaaagtgctgggattataggtgtgagccacggctctcggttggattaatgtccttataagaggagacactggagcgcttgcattctcccgtgcttctctctgtcccttcctccctctctctccacattggtcgtgtgaccacaaagccagaaagtggctgtctgcaacccaagggaagagccctcaccagacrccaacctggctggcaccttgatcttggacttccaatctccagaactgtgagaaaatacatttttgttatttaagccacctggtgtatggtattttgttttagcagcctgagcagacgaagacatcaagaaagaacacttctgggcaataaaacacactttaacaaatgtagaagaatagaaatcatacaaagtatggtgtcaaatcacaatagaattgaaaagggcacgtacacgtgagtgccctggagtttaagctccattggcttcaggcaaatctgcttctgctggtgatccccttc

SEQ ID NO: 122687 - DNA, 601 bp, Human
attaatatatataataaactcataataaataataattatatataattaatatatataataaactcataataaatatatataatatataataaattcatatatgtttatatatgagtttattaagtatttatatatatatgagtttattaaatattaactcacaggattacaacatcccacaatagcctgtctgcaagctgaggagcaaggagagccagtccaagtcccaaaactgaagaacttggagtctgatgtttgagggcaggaagcatccagcatgggagaaagatgtgggctgggrggctaggcccgtctcacctttccacatttttctgcctgctttatattcgctggcagctgattagattgcggccaccagattaagggtgggtctgcctttcccagcccactgactcaaatgttaatctcctttggcaacaccctcacagacacacccaggatcaatactttatatccctcaatccaatcaagttgacactcagtattaaccctcacacttgataacaggagatttctgtagacaggaaagtgaggaagtggaaggtatctcacaagatggtcctgaagagacatcagagtc

SEQ ID NO: 122688 - DNA, 601 bp, Human
taaatattaactcacaggattacaacatcccacaatagcctgtctgcaagctgaggagcaaggagagccagtccaagtcccaaaactgaagaacttggagtctgatgtttgagggcaggaagcatccagcatgggagaaagatgtgggctgggaggctaggcccgtctcacctttccacatttttctgcctgctttatattcgctggcagctgattagattgcggccaccagattaagggtgggtctgcctttcccagcccactgactcaaatgttaatctcctttggcaacaccctcacrgacacacccaggatcaatactttatatccctcaatccaatcaagttgacactcagtattaaccctcacacttgataacaggagatttctgtagacaggaaagtgaggaagtggaaggtatctcacaagatggtcctgaagagacatcagagtcttccctctggccttgcaggggcctatgcaggtagctgcatggagcccttcttcgggtcaaggagatgatgtccccttcactgacttttgcacttccttgaatctgcaggggagtgtccctccaacttcagagtgagcagcagcagct

SEQ ID NO: 122689 - DNA, 601 bp, Human
gagggcaggaagcatccagcatgggagaaagatgtgggctgggaggctaggcccgtctcacctttccacatttttctgcctgctttatattcgctggcagctgattagattgcggccaccagattaagggtgggtctgcctttcccagcccactgactcaaatgttaatctcctttggcaacaccctcacagacacacccaggatcaatactttatatccctcaatccaatcaagttgacactcagtattaaccctcacacttgataacaggagatttctgtagacaggaaagtgaggaartggaaggtatctcacaagatggtcctgaagagacatcagagtcttccctctggccttgcaggggcctatgcaggtagctgcatggagcccttcttcgggtcaaggagatgatgtccccttcactgacttttgcacttccttgaatctgcaggggagtgtccctccaacttcagagtgagcagcagcagctgaccagattggaggacatttccactgtcttccctggcagctgtgatgtgttgtgcggtggcagctgaggattgcctgcgtgtaatctttgaggttccaagatgcttgttg

SEQ ID NO: 122690 - DNA, 601 bp, Human
atcaagttgacactcagtattaaccctcacacttgataacaggagatttctgtagacaggaaagtgaggaagtggaaggtatctcacaagatggtcctgaagagacatcagagtcttccctctggccttgcaggggcctatgcaggtagctgcatggagcccttcttcgggtcaaggagatgatgtccccttcactgacttttgcacttccttgaatctgcaggggagtgtccctccaacttcagagtgagcagcagcagctgaccagattggaggacatttccactgtcttccctggcakctgtgatgtgttgtgcggtggcagctgaggattgcctgcgtgtaatctttgaggttccaagatgcttgttggaagtggagcctggtcaagcagcagaaaggacagctggatccatgctgggtggggtgaggtggggtgcttgtcagggaagttggcttcagctggaactggaggttggctccagcaaaggaggttgaacatcactgattcctgacctgcagcacccaaatggccacaaagagatgtcatgggttttgaggaggccacagagccaacagctttagtgtcttcagaaggatg

SEQ ID NO: 122691 - DNA, 601 bp, Human
caggagatttctgtagacaggaaagtgaggaagtggaaggtatctcacaagatggtcctgaagagacatcagagtcttccctctggccttgcaggggcctatgcaggtagctgcatggagcccttcttcgggtcaaggagatgatgtccccttcactgacttttgcacttccttgaatctgcaggggagtgtccctccaacttcagagtgagcagcagcagctgaccagattggaggacatttccactgtcttccctggcagctgtgatgtgttgtgcggtggcagctgaggattgcctgygtgtaatctttgaggttccaagatgcttgttggaagtggagcctggtcaagcagcagaaaggacagctggatccatgctgggtggggtgaggtggggtgcttgtcagggaagttggcttcagctggaactggaggttggctccagcaaaggaggttgaacatcactgattcctgacctgcagcacccaaatggccacaaagagatgtcatgggttttgaggaggccacagagccaacagctttagtgtcttcagaaggatgaagaaaacttgaacaacattttaaaatagcttgagatat

SEQ ID NO: 122692 - DNA, 601 bp, Human
ttttttcaactttttttttaatcatttgacttttttttgagacagagtctcactctgtcgccaggctggagtgcagtggcgtgatctcagctcactgcaacctccgcctcctgggttcaagcgattctcctgcctcagcctcccaagtagctgagactccaggtatatgccaccatgaccagctaatgtttgtatttttagtagagacggggtttcaccatgttggtcaggatggtcttgatctcttgacctcatgatccacctgcctcagcctcccaaagtgctgggattacaggcatgrgccaccgtgcccggcctcatctgactttttaattaaagctaccctagcagacatgaagtgatatctcattatggttttgatttgtatttctcccatggctaataatattcaggacctctttatgtgcttattggccatttgtatatcttttttaaagaaatatctattcagatcctttgcttatttttgaattgggctatttgtctttttattcttgagttgtaattgttctttatatattctagatacaagcaacttattatgtttatagtttgcaaacaattttttcccattctttgg

SEQ ID NO: 122693 - DNA, 601 bp, Human
tttcaagatttctttagctatttgtgttttcttgcattttcatatgcattttaaaagcaacttgtccattgctgaagtcgaaattttgatagggattgcattgaatttggaatctgggagtattgctatcttaataatgttaagtttttcaatctataaacatgggatgtctttccactcatttagatcttctttagttttcaacaatattttgtagttttcagagcataagttttgtacttcttttgttaaatatgttcataagtatctttctgatgctaatataaatgagtttttttttaagacaaagttttgctctgtcaccaaggctggagtgcagcggtgtgatctcagctcattgcaacctctgcctaacgggttcaagtgattcccctgcctcagtctactgcgtagctgggattacaggtgcccacgaccacacccagctaattttttgtatttttagtagagacaaggtttcaccatatcggccaggctggtcttgaactcctgacctcaagtggtccacctgcctcggcctcccaaagtgctgagattacaggcttgaaccactgtacccagactggaattgttttcttaa

SEQ ID NO: 122694 - DNA, 601 bp, Human
tgtacttcttttgttaaatatgttcataagtatctttctgatgctaatataaatgagtttttttttaagacaaagttttgctctgtcaccaaggctggagtgcagcggtgtgatctcagctcattgcaacctctgcctaacgggttcaagtgattcccctgcctcagtctactgcgtagctgggattacaggtgcccacgaccacacccagctaattttttgtatttttagtagagacaaggtttcaccatatcggccaggctggtcttgaactcctgacctcaagtggtccacctgcctyggcctcccaaagtgctgagattacaggcttgaaccactgtacccagactggaattgttttcttaacttcattttttatttgctcataactactgtatagaaataaactgatttttgtacactgatcacatatccttgtaaacttgctaaactcatttattagtttaatcattttcagtgaattccttaggattttcaacgtacaagatcatgttatctgcaaatgaagacaattgtacttcttcctttccaatatggatggcttttactttatttccttgcctcattgccctggctggcc

SEQ ID NO: 122695 - DNA, 601 bp, Human
cataagtatctttctgatgctaatataaatgagtttttttttaagacaaagttttgctctgtcaccaaggctggagtgcagcggtgtgatctcagctcattgcaacctctgcctaacgggttcaagtgattcccctgcctcagtctactgcgtagctgggattacaggtgcccacgaccacacccagctaattttttgtatttttagtagagacaaggtttcaccatatcggccaggctggtcttgaactcctgacctcaagtggtccacctgcctcggcctcccaaagtgctgagattasaggcttgaaccactgtacccagactggaattgttttcttaacttcattttttatttgctcataactactgtatagaaataaactgatttttgtacactgatcacatatccttgtaaacttgctaaactcatttattagtttaatcattttcagtgaattccttaggattttcaacgtacaagatcatgttatctgcaaatgaagacaattgtacttcttcctttccaatatggatggcttttactttatttccttgcctcattgccctggctggcctctttagtacaatgttgaacagaa

SEQ ID NO: 122696 - DNA, 601 bp, Human
acaattgtacttcttcctttccaatatggatggcttttactttatttccttgcctcattgccctggctggcctctttagtacaatgttgaacagaagctgtgtgaacagacatccttgtcttgttcctgatcttctggggaaagcattttgtgtttcagcattgagtgaaagccctttagctgtggccttttctagatgtcctttaacaggttgaggagaccgagttcttcagaggaggagctgtgtcagctctgaggtgacgcacagcattgtcagctttctgagtctgaggtcccggcyggctgggaggagatgatgtcctgaaggatgtggacatgatgggctggggctctggggacttgaggggagtccccgctgcagacctgggtatgggaataaaaaggcaatatcaaaggcagtaattggacccgtgggagtggaccatctcgggaagagaaaagagcatcggggcagagatgtgggagaggggaggggagcccgagaaatggtcagagaaggaggagaaaatccagactgtgcagggaggagagaagtgccccagcagctgaagacggtgccagagcctactggctgggggga

SEQ ID NO: 122697 - DNA, 601 bp, Human
tcgaggacagccctgctgggtactaagatacagccaagagtgtctggaatgatgggcagagcatcaactggtttcagagtttgaacaaatggtgttcagaacagcatgttctgccagaatggtcagccagactgccaggactgagggtcctacagaaggaccccctttgtcattctcacttccgtattccagaaccgggggtattttagtgtgtgggaaaataaagcaatcgttgagttcgatttcagtcccaagttttggaaaacgtgtgggtgcatctgcagtagataggtctcagcayggcctttgttccaacccagtcagaactcaaccagaattggggccagtagatccttgagccagacaatgacaacatggaggtacccataaagcctaggggtgacaagcacccagccatgccattcctgtggatacgagggttgttggcccataggacaaactcttcacaacatttccctctcccttccctcttgcagctagttgcatcagtgggtggtaatagaggttctgaattttcccagtgcatgggcgggacggctgaggggctccatgaatgcaagtttattacacaaaggaagtc

SEQ ID NO: 122698 - DNA, 601 bp, Human
catgttctgccagaatggtcagccagactgccaggactgagggtcctacagaaggaccccctttgtcattctcacttccgtattccagaaccgggggtattttagtgtgtgggaaaataaagcaatcgttgagttcgatttcagtcccaagttttggaaaacgtgtgggtgcatctgcagtagataggtctcagcacggcctttgttccaacccagtcagaactcaaccagaattggggccagtagatccttgagccagacaatgacaacatggaggtacccataaagcctaggggtgacragcacccagccatgccattcctgtggatacgagggttgttggcccataggacaaactcttcacaacatttccctctcccttccctcttgcagctagttgcatcagtgggtggtaatagaggttctgaattttcccagtgcatgggcgggacggctgaggggctccatgaatgcaagtttattacacaaaggaagtcacctatctctttatgtacatagagacttccagaaggctaaagaaataaaaaatgatctaaatgagcttttctcctttgtatttcatatttcagtgttacaaata

SEQ ID NO: 122699 - DNA, 601 bp, Human
caatagagttatattatattggtttccaaattccatgtaataaactcatgacaactgccttgaacgcaaatcacagagcctctgactcaggaatttccctattagagtctgaagctccagcccacactttgatataccttggcaggtctctgaaaaggtagggtacacatgtattttgtaaacttcagcagtaagctggttttctaaaatgtatggatatgtacacagacattaaatgggcctatctggcttttgacactttttaaaatacgatttaaatcactaggacaattacatatawaaaaaagcaactgttcatttattgcttcagttacctatattccattcctcttagcataagactcccttatcccagattctagactcaagagctcttcattgtattcaatcttagaccatcaactgcccatcttcatgttccaccaaagatatgaaatcaaataaaatcaaaacatatttatttaatgcctacgacaggcgaggccttgttataggttcttgagatggaataataaaattctttcactgcagagtttataacttagttacagatgtacacttgaattactcattgctttag

SEQ ID NO: 122700 - DNA, 601 bp, Human
cactttgggaggctgaagcaggaggattgcttgagtccaggagttcaagacctgcctgagcaacatagtgatacccccatttctacaaaaaactaaaaattagctgggtgtggtggtgcacacctgtagtcctagctacacaggaggctgtggtgggaggattgcttgagcccaggagtttgaggccagcctgcacagcatggtgagactctgtctctacacaaaataatttgctgggcacagcagtgcctgtagtcccagctacttgggaggctgagggaggaggattgcttgagcccargcattcgagcctgcagtgagctatgatagttttcaagatactagaaaagtaaaagaaaagaaactaaaaaaaggaaaagaagaaaaaactcactaatgtgcaaaaagaaaatatttgaaggtttaaaacccactggtaaaattaaatacatggataaacccagtattactttaatactgtaattgtggtatataatccacatcataactatggtatacaaatctatctatctagtataaagccccaaatacaaatctatcaaaaacaataatagttatagcaacctattaagagataggg

SEQ ID NO: 122701 - DNA, 601 bp, Human
aagataattcatcatgatcaaataggattcatcctagggatgcaaggatggttcaacatacaaatcaataaacacaatatatcgcattaagagaaccaagaacaagaacgatatgattatttcaatagatgctgaaaaagcattcaataaattaaacatgcctttataagaaaaaaaccttcaacaaactaggtatagaagaaacatacttcaaaataataaaggtcattagctatgaaaaactcctagctaatataatactgatagggaaaaactgaaacccttttctttaaaatccggraccagacaaagatgcccactttcaccacttttatttgacctactactcgaagtttcagggcaataaggcaagagaaagaaataaagggcatcaaagaaagaagtttaaattagtcttgtttgcagatgacatgatattatacttagaaaaacctaaagactccaccaaacaactgttggaactgataagtgaattcagtaaagttgcagcattcaaaatcaacatacaaaaatcaatagcatttacatatcccaagaacaacaatctgaaaaagaaatcaagaaatcaatttcatttatg

SEQ ID NO: 122702 - DNA, 601 bp, Human
gggatgcaaggatggttcaacatacaaatcaataaacacaatatatcgcattaagagaaccaagaacaagaacgatatgattatttcaatagatgctgaaaaagcattcaataaattaaacatgcctttataagaaaaaaaccttcaacaaactaggtatagaagaaacatacttcaaaataataaaggtcattagctatgaaaaactcctagctaatataatactgatagggaaaaactgaaacccttttctttaaaatccggaaccagacaaagatgcccactttcaccacttttattygacctactactcgaagtttcagggcaataaggcaagagaaagaaataaagggcatcaaagaaagaagtttaaattagtcttgtttgcagatgacatgatattatacttagaaaaacctaaagactccaccaaacaactgttggaactgataagtgaattcagtaaagttgcagcattcaaaatcaacatacaaaaatcaatagcatttacatatcccaagaacaacaatctgaaaaagaaatcaagaaatcaatttcatttatggtagctacaaagaatacaaaatacctaggaatcaat

SEQ ID NO: 122703 - DNA, 601 bp, Human
tgcaaggatggttcaacatacaaatcaataaacacaatatatcgcattaagagaaccaagaacaagaacgatatgattatttcaatagatgctgaaaaagcattcaataaattaaacatgcctttataagaaaaaaaccttcaacaaactaggtatagaagaaacatacttcaaaataataaaggtcattagctatgaaaaactcctagctaatataatactgatagggaaaaactgaaacccttttctttaaaatccggaaccagacaaagatgcccactttcaccacttttatttgacmtactactcgaagtttcagggcaataaggcaagagaaagaaataaagggcatcaaagaaagaagtttaaattagtcttgtttgcagatgacatgatattatacttagaaaaacctaaagactccaccaaacaactgttggaactgataagtgaattcagtaaagttgcagcattcaaaatcaacatacaaaaatcaatagcatttacatatcccaagaacaacaatctgaaaaagaaatcaagaaatcaatttcatttatggtagctacaaagaatacaaaatacctaggaatcaatttaa

SEQ ID NO: 122704 - DNA, 601 bp, Human
tggttcaacatacaaatcaataaacacaatatatcgcattaagagaaccaagaacaagaacgatatgattatttcaatagatgctgaaaaagcattcaataaattaaacatgcctttataagaaaaaaaccttcaacaaactaggtatagaagaaacatacttcaaaataataaaggtcattagctatgaaaaactcctagctaatataatactgatagggaaaaactgaaacccttttctttaaaatccggaaccagacaaagatgcccactttcaccacttttatttgacctactactsgaagtttcagggcaataaggcaagagaaagaaataaagggcatcaaagaaagaagtttaaattagtcttgtttgcagatgacatgatattatacttagaaaaacctaaagactccaccaaacaactgttggaactgataagtgaattcagtaaagttgcagcattcaaaatcaacatacaaaaatcaatagcatttacatatcccaagaacaacaatctgaaaaagaaatcaagaaatcaatttcatttatggtagctacaaagaatacaaaatacctaggaatcaatttaaccaaagat

SEQ ID NO: 122705 - DNA, 601 bp, Human
aatataatactgatagggaaaaactgaaacccttttctttaaaatccggaaccagacaaagatgcccactttcaccacttttatttgacctactactcgaagtttcagggcaataaggcaagagaaagaaataaagggcatcaaagaaagaagtttaaattagtcttgtttgcagatgacatgatattatacttagaaaaacctaaagactccaccaaacaactgttggaactgataagtgaattcagtaaagttgcagcattcaaaatcaacatacaaaaatcaatagcatttacatatsccaagaacaacaatctgaaaaagaaatcaagaaatcaatttcatttatggtagctacaaagaatacaaaatacctaggaatcaatttaaccaaagatgtgaaagatctatccaaagacaactataaaacactaatgaaagaaactgaagagggcaccccaaaatggaaagatatttcacgctcatggacccgatgacattcttcacagaaatagaaaaaataattccaaaatttacatggaaccacaaaagaccccaaatagccaaagcaatcctgagcaaaaagaacaaagctatagga

SEQ ID NO: 122706 - DNA, 601 bp, Human
catgatattatacttagaaaaacctaaagactccaccaaacaactgttggaactgataagtgaattcagtaaagttgcagcattcaaaatcaacatacaaaaatcaatagcatttacatatcccaagaacaacaatctgaaaaagaaatcaagaaatcaatttcatttatggtagctacaaagaatacaaaatacctaggaatcaatttaaccaaagatgtgaaagatctatccaaagacaactataaaacactaatgaaagaaactgaagagggcaccccaaaatggaaagatatttcaygctcatggacccgatgacattcttcacagaaatagaaaaaataattccaaaatttacatggaaccacaaaagaccccaaatagccaaagcaatcctgagcaaaaagaacaaagctataggaatcacactacctgacttcaaaatatactacaaagctatagtaaccaaaacatcatggtactggcatgcaaagacatcagaccaatggaacagaatagagaacccagacccagatataaatccatgcgtttatagccaactcatttttgacaaaggcaccaagaacatacaatggggaaa

SEQ ID NO: 122707 - DNA, 601 bp, Human
ttagaaaaacctaaagactccaccaaacaactgttggaactgataagtgaattcagtaaagttgcagcattcaaaatcaacatacaaaaatcaatagcatttacatatcccaagaacaacaatctgaaaaagaaatcaagaaatcaatttcatttatggtagctacaaagaatacaaaatacctaggaatcaatttaaccaaagatgtgaaagatctatccaaagacaactataaaacactaatgaaagaaactgaagagggcaccccaaaatggaaagatatttcacgctcatggacccratgacattcttcacagaaatagaaaaaataattccaaaatttacatggaaccacaaaagaccccaaatagccaaagcaatcctgagcaaaaagaacaaagctataggaatcacactacctgacttcaaaatatactacaaagctatagtaaccaaaacatcatggtactggcatgcaaagacatcagaccaatggaacagaatagagaacccagacccagatataaatccatgcgtttatagccaactcatttttgacaaaggcaccaagaacatacaatggggaaaggagagagtctct

SEQ ID NO: 122708 - DNA, 601 bp, Human
attcagtaaagttgcagcattcaaaatcaacatacaaaaatcaatagcatttacatatcccaagaacaacaatctgaaaaagaaatcaagaaatcaatttcatttatggtagctacaaagaatacaaaatacctaggaatcaatttaaccaaagatgtgaaagatctatccaaagacaactataaaacactaatgaaagaaactgaagagggcaccccaaaatggaaagatatttcacgctcatggacccgatgacattcttcacagaaatagaaaaaataattccaaaatttacatggarccacaaaagaccccaaatagccaaagcaatcctgagcaaaaagaacaaagctataggaatcacactacctgacttcaaaatatactacaaagctatagtaaccaaaacatcatggtactggcatgcaaagacatcagaccaatggaacagaatagagaacccagacccagatataaatccatgcgtttatagccaactcatttttgacaaaggcaccaagaacatacaatggggaaaggagagagtctcttcaataaatgatgctgggaaaactggatagttatatgcaaaagaataaaa

SEQ ID NO: 122709 - DNA, 601 bp, Human
ctcttcaataaatgatgctgggaaaactggatagttatatgcaaaagaataaaactgaacctctatctctcaccatatacaaaaaccaaagcaaatggattaaagatttaaatctaagacctaaaactatgaaacactccaggacattggtctgggcaaaaatattttgtgtaagagctcaaaagcacaggcaaccaaagcaaaaacagacaaatagaattacatcaagctaaaaacattctgtgcagtaaaggaaacaatcaacaagtcaagagacaatccatggaatgggagaagatayttgtgaactatccatctgacaaggggttaataaccaaaatatataaagagttcaaacaactcaaaagtaaaaaacaaactgattttaaaatgggcaaaagatctaaagagacatttctcaaaaaaagacagagggccaagaggtatatgaaaaaaatgcttaatattactaatcatcaagaaatacaaatcaaaaccacaatataatctcaccccagttaaaatggatcttattaaaaagacagggaatgtaaatgctggcaaggacgtagagaaaggaaacccttgcgcattgttggtg

SEQ ID NO: 122710 - DNA, 601 bp, Human
tgggagaagatacttgtgaactatccatctgacaaggggttaataaccaaaatatataaagagttcaaacaactcaaaagtaaaaaacaaactgattttaaaatgggcaaaagatctaaagagacatttctcaaaaaaagacagagggccaagaggtatatgaaaaaaatgcttaatattactaatcatcaagaaatacaaatcaaaaccacaatataatctcaccccagttaaaatggatcttattaaaaagacagggaatgtaaatgctggcaaggacgtagagaaaggaaacccttgygcattgttggtgggaatgtaaattagtacagccactatggagtattgcatggaggttcctcaaaaaactaaaaatagaattaccatctgatccagccattccactactgattatatatccataatagtctgttttcacgctgctgataaagacatacccatgactgtgaacaaaaagagatttaattggacttacatttccacatggctggggaggcctcagaatcaaggtgggaggcaaaaggcacttcttacatggcagtggcaagagaggaggatgcaaaagtggaaacccctgata

SEQ ID NO: 122711 - DNA, 601 bp, Human
catttctcaaaaaaagacagagggccaagaggtatatgaaaaaaatgcttaatattactaatcatcaagaaatacaaatcaaaaccacaatataatctcaccccagttaaaatggatcttattaaaaagacagggaatgtaaatgctggcaaggacgtagagaaaggaaacccttgcgcattgttggtgggaatgtaaattagtacagccactatggagtattgcatggaggttcctcaaaaaactaaaaatagaattaccatctgatccagccattccactactgattatatatccatartagtctgttttcacgctgctgataaagacatacccatgactgtgaacaaaaagagatttaattggacttacatttccacatggctggggaggcctcagaatcaaggtgggaggcaaaaggcacttcttacatggcagtggcaagagaggaggatgcaaaagtggaaacccctgataaaaccatcagatcttgtgagatttatgcactaccatgggaacagtatgagggaaaccacctccatgattcaaatgatctcccacagggtccctcccacaatacatgggaattatgggagtaaaa

SEQ ID NO: 122712 - DNA, 601 bp, Human
agcaaaggtctgttttcagaagagtgtgtgtggggtgggggagtaatgggggcacagctctgaagtgaagatgcaacttccaacaaatgaatgccaaagtgtgaaaagttcttgagaatgatctccagccaactcctattggctggtggactctataaaaggtctacaaaaatatacctttttagggtatctacttaccacctgagtaagtaaaagttgagagacatgagcaaagcaacctaaggatgcaagaagggccttacagggaggagggatggggatgggagcaggcctgagaatkgctgcaagctgaccaagtggaagctttgagcaccacacatcccagcagccttgagaagcaggtaggcaagtctcctcataccagcaaggaggcgctcgtagcattaagaacgttgtctgaggaagttccggcttctccaataaccccctgagggatgtaggggtggagctgtgtggtgtaagcccagcaccacctgagccacaagggagctgtggaccatcttccagagtctcaattttctaaactcatttgatgggtgataatcttaaaacattttctcttaaacaagcagtagcttat

SEQ ID NO: 122713 - DNA, 601 bp, Human
ctggctgtgacctgggacaagttgctggtccatcgtctggcacagggatggcttcacagggatgggacctgcccagcagggtcccgcacttcctaggtttaatgctctgtcactgctatcttcaaattcttctcttttgaataagaggcctcatgtttttattttgcactgggctctgcaaattctacggctagtcctgaacctgtcaatggagctaataacagtctctacctcagggctttgttcggaggattcagtgcattctcacagataaacatcctagtgtagtgcctggtatgtrctcataattgtgcttaattgcttccgctcactgagtgtgtgcgtgtgtgcttaaacgccagcttcctccccactgccctgctccctccttgctctccagactcctcagatgtttgcccctttgccactgaaagtcatacccaatgacagggggccatctgcatctgtgtggtcccacagagaccagggaaaggccctctcgctcccgatgctgctccttcatggtttttattgtttttgtttttcttttgagatggaatcttgttctgtccccaggctggagtgcagtgacatgatcttg

SEQ ID NO: 122714 - DNA, 601 bp, Human
caggccttagcaatgcttgaagcttcaagttcaggttccccttctgtattttttcttaaacctttagctcaaatagactttgtgtcaatttgctagtgataaagggttagctttgaaatctgaggatgaggttttgggtctggatccactatgagctggctgtgacctgggacaagttgctggtccatcgtctggcacagggatggcttcacagggatgggacctgcccagcagggtcccgcacttcctaggtttaatgctctgtcactgctatcttcaaattcttctcttttgaataagrggcctcatgtttttattttgcactgggctctgcaaattctacggctagtcctgaacctgtcaatggagctaataacagtctctacctcagggctttgttcggaggattcagtgcattctcacagataaacatcctagtgtagtgcctggtatgtgctcataattgtgcttaattgcttccgctcactgagtgtgtgcgtgtgtgcttaaacgccagcttcctccccactgccctgctccctccttgctctccagactcctcagatgtttgcccctttgccactgaaagtcatacccaatg

SEQ ID NO: 122715 - DNA, 601 bp, Human
cctcccaaagtgctgggattgattacaggcatgagccactgtgcccagcctaccagatgccccttctcttattgccaaaacactgtggtcacacactgcttggggcccagcaggcacaacagtgacctctttccagggctcaggggaggaagctccgcttcggggcatgtagagccagccctgggcagggtggccttggttatctccctgcacccctggcacaccctgatggctctgtttatctgcactttgcacatgatggtcttgactgacacatcctcgcagagagccactgccaggkcgcctcacacccgctgctcccacacgcagtgggcatttttacgaggggctcaggcacagggtctccagctgacccagcccagcactgccactcttcctccttgaactctggcatggagaatcttcacattttgtcagcagccgatgagcacatgtattctcagcacagtcttaaaaggggggaaattatgggttgccagatcaaaacctgataaaacaatgatgcctctggtgtggggcccagccaagcccttctcctgtattcaccgggcaacaggggcccattggatatgaaatccac

SEQ ID NO: 122716 - DNA, 601 bp, Human
tgagccctgggcttggtgaggggtgcctgcctcgcctggcatcccccagctgtagatgggggcagagcaagacttgctgccaacctgcctggctctgtggtccctgctccctctcccgttctgctggcgtcaccacccctccttcagaactctctatggaattgcattctagtctctcctgcttctgcttatgcatgtgaaagccagatgccccttctctctctctcttttttttttttttgatacggagttttgctcttgttgcccaggctggagtgcaatggcgcaatcttggctcacygcaacctgcgtctcctgggttcatgcaattctcctgcctcagcctgccgagtagctgggattacaggcgtgcaccaccatgcctggctaattttgtatttttagtatagacagggtttctccatgttggtcaggctggtctcgaactcctgacctcaggtgatccaccctccttggcctcccaaagtgctgggattgattacaggcatgagccactgtgcccagcctaccagatgccccttctcttattgccaaaacactgtggtcacacactgcttggggcccagcaggcacaacagtg

SEQ ID NO: 122717 - DNA, 601 bp, Human
tggaccctggcatgacttctccagcccctggagagcctctgcagttctgaccccttcacaagtgagccctgggcttggtgaggggtgcctgcctcgcctggcatcccccagctgtagatgggggcagagcaagacttgctgccaacctgcctggctctgtggtccctgctccctctcccgttctgctggcgtcaccacccctccttcagaactctctatggaattgcattctagtctctcctgcttctgcttatgcatgtgaaagccagatgccccttctctctctctctttttttttttkttgatacggagttttgctcttgttgcccaggctggagtgcaatggcgcaatcttggctcactgcaacctgcgtctcctgggttcatgcaattctcctgcctcagcctgccgagtagctgggattacaggcgtgcaccaccatgcctggctaattttgtatttttagtatagacagggtttctccatgttggtcaggctggtctcgaactcctgacctcaggtgatccaccctccttggcctcccaaagtgctgggattgattacaggcatgagccactgtgcccagcctaccagatgccc

SEQ ID NO: 122718 - DNA, 601 bp, Human
tcagatccttacataatcggaacttctgacagaatgctggctcctctccttagactatacattttcatttttctacattcttccagaacaatgttcctatacaaaatcttaacccatggcagaaactggcaagagcccatttcccatgtgcaggcagagccaggccggcgacactgggttccttcttaggcaaggcgagggttgggtggaccctggcatgacttctccagcccctggagagcctctgcagttctgaccccttcacaagtgagccctgggcttggtgaggggtgcctgcctygcctggcatcccccagctgtagatgggggcagagcaagacttgctgccaacctgcctggctctgtggtccctgctccctctcccgttctgctggcgtcaccacccctccttcagaactctctatggaattgcattctagtctctcctgcttctgcttatgcatgtgaaagccagatgccccttctctctctctcttttttttttttttgatacggagttttgctcttgttgcccaggctggagtgcaatggcgcaatcttggctcactgcaacctgcgtctcctgggttcatgcaattct

SEQ ID NO: 122719 - DNA, 601 bp, Human
gcagggtatgtgggcccacagcttgtatgtgccaggcagggcctgctgctgtggctctgcacactgaggaactgcatgcacagacactcaggacccgcctgcctcccccagctcctcagccgggcctgtgtcccaccccagtccaccgttgtgtccatgctgtgctttctgtggtcaggcctggcatgctctgggctgctgctgcccttgcccgccttagcagctggctcggggtggccctcgagccctccctcacgcaccgtcccaggcttgctgcctttccagctgcacctctcacaaytgttcacgacaggcccctcaacacgccgcgggcctggcacacactcacctgctggtctgctaggacccagtttcccaagcctagaaaacgacccaccacagccttgggcacagtttgcagccctgacagattcctgagtctgccttttcccagaattctgacctctccaggggctctgtgaccccgcctgtcccccactcagggcctgtcacagacaggggtttgctgagccactttgaggcaggtggatgattgcagggatgacccaaggcccacgctcccaggactgccaccattcca

SEQ ID NO: 122720 - DNA, 601 bp, Human
cttacttccataagaggttgtattacttttcggggaagtgtcggttgatgcttttgtccatttcctgtcagcaccccacccccgtgaggaaacgtgccccagaagtgaaaggacgtgtcctcatcacatgacgagtgaggggcagagcagaggccagagcaacatccgtgctgtggagtcagccctgggtttgactgccctccaatgttcaccagctttgggagagagaggaaatacctcagcacctcagttttcccatctgtgagtgggaatgataacagccacttccccagagtcaccygaagagcaacagcagaagggcctggacctgctcccagtggcagaggcttgggaggtggcttttgttagcgaaatttattggagcaaacctggcctgaggatgctggtaatttcaggagtcaccctccagacagctgttgtttttcgcttttgataaaataacaacaaacttagatgccgagccctggtaaggggctttcctgggtctcccctgcacacctgctatgataggcattttcttttctttttctttcttttctttttttttttttttttgagacagagtctcgtgctctgtcac

SEQ ID NO: 122721 - DNA, 601 bp, Human
gcttgcctgacccccgcccccgtgcccagcccagcccagcagcccaagcagttctccaggactcaggtttcagaccttcaacacttgccttgggagacaaacagcggtgcagcccttgcttgcaagccattccacattagacttcggattgatttatggcaggatccctgctgtgcgagaactgcagggggggtggggggcggctatttcttgctgctaactcaggcaggatgtgtctatatcctgtctcagtttatgtagctgctcatcagagccagaggttagagcggagaggacccayttccgccaggccggcctgctctgctcagctcagctgggctaggccccaatgccacagttactgcgcgtgagtcatgcacagcaatccattgccttgcccttggatggaaggggtcaaggctcagtgagaagacggccaggtttggcagctttatatagaattcaccgcctctggcagaagcagaggattgcattaagtgccaaatgaaattccacctcagccattgctcaattcctccagatgtcactggcactgggagtcacatgatgctggtggtcagcagctggacccttccaaggg

SEQ ID NO: 122722 - DNA, 601 bp, Human
gcttggaaacattgctgggcctctctctgccctcttcctctgccgttggacttttgcaataaaaactaccatttgattttaccaaaaaacctaatgtacatccctcttacccccaccctgccgcggtctgattcttagagtctgtcagagaggagatatcctgagcctatcatgtgacaatgataccttattgatatgataatgatatgggtattggagacaccaactcttttataagtctttgaaatccagggggttgtgaggcctcacccctcaccccgcctgagcttggagcttggcrtggaggagtgctgcttcggtctacgtgtgtacacggcactccatgtgcctgtggttgtgcttgcgtcagcctgggagtgcgcaggcatcagtggtgcttgggagcgaggcccctcagtctgcactgggatcatctgcactgcctataaacaaggcagcctctcttagctccagtttcctcatctgcaaagtaggaaagtaggaataataacaggagataactcatccagcagcacgaagtgcgtataaatgtcccggcacggagtctgacacatcctaagtgctggatccgtgctgggca

SEQ ID NO: 122723 - DNA, 601 bp, Human
gccgcaaaggcacacagatgcgagggaatcctgcggcctggatcctttggggatttgtaattcctcgctgctggttttctcttttaaaccatcacgttttcttgctgagaggaaatcatctgtgatgaaagtctttgtagatgcttggaaacattgctgggcctctctctgccctcttcctctgccgttggacttttgcaataaaaactaccatttgattttaccaaaaaacctaatgtacatccctcttacccccaccctgccgcggtctgattcttagagtctgtcagagaggagataycctgagcctatcatgtgacaatgataccttattgatatgataatgatatgggtattggagacaccaactcttttataagtctttgaaatccagggggttgtgaggcctcacccctcaccccgcctgagcttggagcttggcgtggaggagtgctgcttcggtctacgtgtgtacacggcactccatgtgcctgtggttgtgcttgcgtcagcctgggagtgcgcaggcatcagtggtgcttgggagcgaggcccctcagtctgcactgggatcatctgcactgcctataaacaaggcagc

SEQ ID NO: 122724 - DNA, 601 bp, Human
accggccaggctccggtgaactccaggcaactccagccttgcccagggacttgctcgctccgctgggcgccgcaaaggcacacagatgcgagggaatcctgcggcctggatcctttggggatttgtaattcctcgctgctggttttctcttttaaaccatcacgttttcttgctgagaggaaatcatctgtgatgaaagtctttgtagatgcttggaaacattgctgggcctctctctgccctcttcctctgccgttggacttttgcaataaaaactaccatttgattttaccaaaaaacstaatgtacatccctcttacccccaccctgccgcggtctgattcttagagtctgtcagagaggagatatcctgagcctatcatgtgacaatgataccttattgatatgataatgatatgggtattggagacaccaactcttttataagtctttgaaatccagggggttgtgaggcctcacccctcaccccgcctgagcttggagcttggcgtggaggagtgctgcttcggtctacgtgtgtacacggcactccatgtgcctgtggttgtgcttgcgtcagcctgggagtgcgcaggcatca

SEQ ID NO: 122725 - DNA, 601 bp, Human; identical to SEQ ID NO: 122713

SEQ ID NO: 122726 - DNA, 601 bp, Human; identical to SEQ ID NO: 122714

SEQ ID NO: 122727 - DNA, 601 bp, Human; identical to SEQ ID NO: 122715

SEQ ID NO: 122728 - DNA, 601 bp, Human; identical to SEQ ID NO: 122716

SEQ ID NO: 122729 - DNA, 601 bp, Human; identical to SEQ ID NO: 122717

SEQ ID NO: 122730 - DNA, 601 bp, Human; identical to SEQ ID NO: 122718

SEQ ID NO: 122731 - DNA, 601 bp, Human; identical to SEQ ID NO: 122719

SEQ ID NO: 122732 - DNA, 601 bp, Human; identical to SEQ ID NO: 122720

SEQ ID NO: 122733 - DNA, 601 bp, Human; identical to SEQ ID NO: 122721

SEQ ID NO: 122734 - DNA, 601 bp, Human; identical to SEQ ID NO: 122722

SEQ ID NO: 122735 - DNA, 601 bp, Human; identical to SEQ ID NO: 122723

SEQ ID NO: 122736 - DNA, 601 bp, Human; identical to SEQ ID NO: 122724

SEQ ID NO: 122737 - DNA, 601 bp, Human; identical to SEQ ID NO: 34631

SEQ ID NO: 122738 - DNA, 601 bp, Human; identical to SEQ ID NO: 34632

SEQ ID NO: 122739 - DNA, 601 bp, Human; identical to SEQ ID NO: 34633

SEQ ID NO: 122740 - DNA, 601 bp, Human; identical to SEQ ID NO: 34634

SEQ ID NO: 122741 - DNA, 601 bp, Human; identical to SEQ ID NO: 34635

SEQ ID NO: 122742 - DNA, 601 bp, Human; identical to SEQ ID NO: 34636

SEQ ID NO: 122743 - DNA, 601 bp, Human; identical to SEQ ID NO: 34637

SEQ ID NO: 122744 - DNA, 601 bp, Human; identical to SEQ ID NO: 34638

SEQ ID NO: 122745 - DNA, 601 bp, Human; identical to SEQ ID NO: 34639

SEQ ID NO: 122746 - DNA, 601 bp, Human; identical to SEQ ID NO: 34640

SEQ ID NO: 122747 - DNA, 601 bp, Human; identical to SEQ ID NO: 34641

SEQ ID NO: 122748 - DNA, 601 bp, Human; identical to SEQ ID NO: 34642

SEQ ID NO: 122749 - DNA, 601 bp, Human
gcagcgccggcatcacaccctgctctccggcttccgtggcctgccctgtaagtgaggcaggaaaatcgagtctggaggcaggaatgtaaggctgattcacacttcaactctaacagggactatcccctccacagggagtatgccgagtaaatgactttgtaactttactttatcctcttcatttacatagggcccccaaagtaaccaatggaaacctctagagggtatttaaaccccccaaaaactgtaatggggccattgagcccctaggctcgggccgctcccaccctgtggtgtgtactttcattttcaatacatctttgcttttgttgcttcattcttttcttgctttgtttgtgtgttctgcctaattctttgttcaagacaccaagaacctggacactcaccaccagtaacataagcactggctcaatggtccattgacctgtgcagaacagacaggattataatgatgtctgctcagggaccttcactccaggcacatctggggctcaggggaccccataggatggggctgagttaggagcagagcaatgacagggccaggagtgtattgaacaaaccaaagtagaaagcccca

SEQ ID NO: 122750 - DNA, 601 bp, Human
gtaaagatacgagatttggggggtgcaggggcagaatgatatggtttggctctgtgtccccacccaaatctcatcttgtagctcccataattcccatgtgttgtgggagggacctgataggagataattgaatcatgggggtgggtctttcctgtgctgtttttgtgatagtgaatgggtctcacaagatctgatggtttaaaaaatgggagtttctgtgcacaaactctctccctgcctgctgccatccatgtaagatgtgatttgctcttccttgctttctgccatgattgtgaggccwccccagccatgtggaattgtaaatccaataaacttctttcttttgtaaattgcagtcttgggtatgtctttattaggagcatggaaacagactaatagaataataagaaggagtcatttgagggacctctccaacaggacaggctgcaggaactgagggcaccaaccacaggagcaccaagtctggccttgcctcacctttggtcctctgaccagcagcctcaacatcacccccttataaggaaatggaggctggtcctactcaccaggcagaacttcaaagatgcagtggttactttga

SEQ ID NO: 122751 - DNA, 601 bp, Human
ttgtgaggcctccccagccatgtggaattgtaaatccaataaacttctttcttttgtaaattgcagtcttgggtatgtctttattaggagcatggaaacagactaatagaataataagaaggagtcatttgagggacctctccaacaggacaggctgcaggaactgagggcaccaaccacaggagcaccaagtctggccttgcctcacctttggtcctctgaccagcagcctcaacatcacccccttataaggaaatggaggctggtcctactcaccaggcagaacttcaaagatgcagtrgttactttgaaaaaaaaatcgcataatttatttgcatgatattcattttcacaattgaactttacagtttaaaaaagatacaaaaaaagacaaacagttgttcacataaataagaaggggcaataaagaaggaagacgttttcaccattacaacaccttttaggatgtgtcttggggagcaagcaccttacagtgccaactgtttccaaggtccctgggaatgctgctctctacagaggcatgtgcacagacggatcctgcaaatgggattgcaagactttccatttcaaggttaagtcc

SEQ ID NO: 122752 - DNA, 601 bp, Human
tgtggaattgtaaatccaataaacttctttcttttgtaaattgcagtcttgggtatgtctttattaggagcatggaaacagactaatagaataataagaaggagtcatttgagggacctctccaacaggacaggctgcaggaactgagggcaccaaccacaggagcaccaagtctggccttgcctcacctttggtcctctgaccagcagcctcaacatcacccccttataaggaaatggaggctggtcctactcaccaggcagaacttcaaagatgcagtggttactttgaaaaaaaaatygcataatttatttgcatgatattcattttcacaattgaactttacagtttaaaaaagatacaaaaaaagacaaacagttgttcacataaataagaaggggcaataaagaaggaagacgttttcaccattacaacaccttttaggatgtgtcttggggagcaagcaccttacagtgccaactgtttccaaggtccctgggaatgctgctctctacagaggcatgtgcacagacggatcctgcaaatgggattgcaagactttccatttcaaggttaagtcctagctgtagaatcattcatt

SEQ ID NO: 122753 - DNA, 601 bp, Human
aaatggaggctggtcctactcaccaggcagaacttcaaagatgcagtggttactttgaaaaaaaaatcgcataatttatttgcatgatattcattttcacaattgaactttacagtttaaaaaagatacaaaaaaagacaaacagttgttcacataaataagaaggggcaataaagaaggaagacgttttcaccattacaacaccttttaggatgtgtcttggggagcaagcaccttacagtgccaactgtttccaaggtccctgggaatgctgctctctacagaggcatgtgcacagacrgatcctgcaaatgggattgcaagactttccatttcaaggttaagtcctagctgtagaatcattcatttcattcttgcaaaccagcctgcttggccaggaggcagaaccatggtagagtagtgctcatggttatggcacttggcaatgcaaaagggacccttcccctggttggaaacccacagcattggaagggaccacagagagtccaaaacaaaacacatctttctcttcttcgccgccaccatgggcactttgcttcagcacattcatttatagaacgttaagtcaggagccagtcat

SEQ ID NO: 122754 - DNA, 601 bp, Human
ccaggcagaacttcaaagatgcagtggttactttgaaaaaaaaatcgcataatttatttgcatgatattcattttcacaattgaactttacagtttaaaaaagatacaaaaaaagacaaacagttgttcacataaataagaaggggcaataaagaaggaagacgttttcaccattacaacaccttttaggatgtgtcttggggagcaagcaccttacagtgccaactgtttccaaggtccctgggaatgctgctctctacagaggcatgtgcacagacggatcctgcaaatgggattgcawgactttccatttcaaggttaagtcctagctgtagaatcattcatttcattcttgcaaaccagcctgcttggccaggaggcagaaccatggtagagtagtgctcatggttatggcacttggcaatgcaaaagggacccttcccctggttggaaacccacagcattggaagggaccacagagagtccaaaacaaaacacatctttctcttcttcgccgccaccatgggcactttgcttcagcacattcatttatagaacgttaagtcaggagccagtcattttgtcaaagcagctgaaatag

SEQ ID NO: 122755 - DNA, 601 bp, Human
ggtccctgggaatgctgctctctacagaggcatgtgcacagacggatcctgcaaatgggattgcaagactttccatttcaaggttaagtcctagctgtagaatcattcatttcattcttgcaaaccagcctgcttggccaggaggcagaaccatggtagagtagtgctcatggttatggcacttggcaatgcaaaagggacccttcccctggttggaaacccacagcattggaagggaccacagagagtccaaaacaaaacacatctttctcttcttcgccgccaccatgggcactttgcytcagcacattcatttatagaacgttaagtcaggagccagtcattttgtcaaagcagctgaaataggccaccactcttacttggcaaagatgatacagtttcaaagagttaaatgaaggtggactacttggagacatcaaaagctaagtttccaggagcactgaggtagcaatgtgtagaaacataacatggaaacagtgtaccttaaactgagcatccttgatttcccccatggacctcaatttccagtgactagcaggcctgaagaggccaacatggtgccagacttggcgccctgcca

SEQ ID NO: 122756 - DNA, 601 bp, Human
ttgataaatatgcatgcccatcaaatcctgctgtaaaccaaaactaaaattctaagtcccccagccaactgagtgcatccccttgcagccaccgggacccaaagaaacctgaaaaaccagttcaggccatgaatgggaaggagggctcgggatgccccattatacctgccccgctctggaatttagacacaactgaccaacattaaaataaaaacagagatcctagactgacaaaacagactctctgtagcaataagatacccaattcaacgggactccggtatagcatcacatgacacayagtagccccgaaggaatcaaagtattttacctcaaaatatatttccttgacatatgttgaaatggcccttgcaaagctgtctctcatgggggaaatgtgcattctgcagagaatctgcttcccttattaggctttttctggagactctgacaccttttaagggcctataagagacatgcacatctattctctctgaagcctgccatccggaggcttcatcaacataacaaaaaccttggcttccacaaccacccccgcccccaccttaactcaagctgagttcaactttttagacaaagc

SEQ ID NO: 122757 - DNA, 601 bp, Human
tccaagaaccctctctcggggtctggattgggacccctttcctgtaacatctttctggtgaccatggaaagaaccatagtgtggaaacccttgactcaaaggtttactttggttaagtgatggggtcctgtaacatctttctggcgaccacagaagtgactatagtgtggaaaccccagacccaaagagtaactttgggtaagtggtagggtctggtaacgtctttctggtgaatcatggaagggacgatactgaggagacccctcaacccaaaagaagtagactgcaccactggttggcygactttgaataagtggtggggtacctgggtaaaggatgggattgggttagaggcccaacgtaggggagttagagtctgtcctaagacacagtgggttagaggcccctcttaaggaaaggtaaggacgcttgctcaaccttgggttagaggcccaactcaggagggttagagtcccttctcagatttagggggttagaggcccctctcagtaaggtccctctcagtaaagtcgcttctggctaagagcaggtttggcactatgggatgttaactgctattctcttgggattaatctgcctt

SEQ ID NO: 122758 - DNA, 601 bp, Human
tttttcctccttaaacggggaaacttgggagctgacgggactgctggaaaagatcccttcatgactgacaagcagccacctaaacttttcagtgttgctgcaatggatgggtctttctctgacctccctgagcgcctcgccttccccatcctgcctcaggcaatgcttttctctctctgtgcaaactggttgaataaattgtaaaaaataattgtttatctcctgtaaagttttgattaatggaataaaggatttgtgaggctagtcttaagctgtagccaaccaggtctggtgtgctttstgtgtctttctgtattgctctgtcataaagaggagtaccttaggatagagcacggacttaggacacctttaagcctgcttttcaagacagctcagcaaactggtcaattacaaactttgctgcaggtccctcaaaaaactggatgaggtttccttcttgtcttctatgttcttgggagcttgaccttgtaaccatgtggccatgctttctcttttcacaatggtggcccaggttcagggttcaattcctggcttggaaaataagttctttatcttctatgtatttatatgtattatgtgt

SEQ ID NO: 122759 - DNA, 601 bp, Human
tcaaaaaactggatgaggtttccttcttgtcttctatgttcttgggagcttgaccttgtaaccatgtggccatgctttctcttttcacaatggtggcccaggttcagggttcaattcctggcttggaaaataagttctttatcttctatgtatttatatgtattatgtgtgtgatgtttatgaatgaaagagctttaactaattggtttaaaaataagtgcttaaatattttgtcagaaaagtaaaaagtgtaatgccttttagttcatgtgactgaagtaatctttgggaaataaggagytttaaagattattggcaaaataaaaatatcttcaaacatgtaaacatttggtctaaattatgcaggtgagatattaagtttgctaaatgctttaaggtcataaactgcttctttgacttttttttttttttttgagacagagttttactctgttgcccaggctggagggcagtggtgcgatctcggctcattgcaagctccgcctcctgggttcatgccattctcctgcctcagcctcccgagtaggtgggactacaggcacccgccaccacgcctggctaatttttttgtatttttagt

SEQ ID NO: 122760 - DNA, 601 bp, Human
tgttattaataattataattgttacataaaatcattgcatgccacaaaggtaaccaaatttcatgtttttgattgtggctgccctaaaatattttgttatccacagacaattgttatcttgttttaatcctttttagaaggtggtttataaccaactatggagctctcacaggggttcttaaacgcaggtttttaataactttggaaattgtgatattagaatggaggaaaaactttcagaactctcatagagagctgaaatgttcatgaatatcaagcaaaacaggagttaactaaattwactgaaccaataaaaaactgaagtaatgtttttaactttacttaaaatgttgctgatcctttgtttcgtttttcagagtcaaggaaacttttcttttgagctatgtacagcttttagcaattgagtaaaatatactcctgtgaacaaaatttggagcatatttctctgttttctccagaatttggaaactatttgtgagtattcttaatttaatggcaatatagttatttgcataagtgcaataaacatctgatttcttttgtaacaggagacaattggaaaaactggttattttaccaa

SEQ ID NO: 122761 - DNA, 601 bp, Human
tgcttattctgttatattgctgttgtactctttgtgtaggaatataggacaagcttactgaatgttttcttaaacacttaataatctttcatatatcaccttttgtgagaactcaagagttatgaatggctctcaccattccaaggctttctggctgagctcttctctaccctgaacagaagagaccttaataggcaggagtatcatggaccctattcaccctgaagaagttacagaagatggatcttcatccctctgcaacccttaggattaaaggttgtcttataaaagggaggggagmaatgtcagaggcatgtgaaccagagcaactccatcttgaataggagctgggtaaaatgaggctgagacctactgggctgcattcccagacacttaaggcattaagtcacaggatgagatgaggtcggcacaggatgcaggtcataaagaccttgctgataaaatgggtggcagtaaggaagtcggctaaaacccaccaaaaccaagatggccatgagagtaacctctcgttgtcctcactgctacactcccaccagcgccatgacagtttacaaacgccatggcaacgtcaggaagttac

SEQ ID NO: 122762 - DNA, 601 bp, Human
gggtggcagtaaggaagtcggctaaaacccaccaaaaccaagatggccatgagagtaacctctcgttgtcctcactgctacactcccaccagcgccatgacagtttacaaacgccatggcaacgtcaggaagttaccctacaaggtctaaaacagggaggcacgaatccaccctttgattattatatcaccaagaaataaccataaaaatgggcaaccagcagcccttggggctgctgtatggagtagccattcttctattcctttactttcttaataaacttgctttcactttactctayggattcaccctgaattctttcttgcatgagatccaagaaccctctcttggggtccagatggggtcccttttcctgtaacacacctatacctagaagcctgttttcagacctttctgggctgaaccaatgtgcactctccatgtactgactgacctctctgcctctaacttctgtccccttaaaatgtataaaatcaggctgtaacccagcaatcttaggcagctattctcaggacctcccagggctgtgtcacaggtcatagtcttcacatttggctcagaataaacctcttcaaatatt

SEQ ID NO: 122763 - DNA, 601 bp, Human
aacttctgtccccttaaaatgtataaaatcaggctgtaacccagcaatcttaggcagctattctcaggacctcccagggctgtgtcacaggtcatagtcttcacatttggctcagaataaacctcttcaaatatttcacagagcttggctttttgtcaacactgccagtaaagtgtgccagctcccacagttggcgaatgaggacctttccaacaggtggatatgaaaatgcaaaccacatggtgacattgtggcatcgcaaagctctcctgcatgagaacccgtcgtgtctgacatggtracatcgtggcatcgcaaagctctcctgcacgagaacccgttgtgtctgacatggtgacatcatggccacaggcatcgcagagctctcctgcacgagaacctgtcgtgtctgacatggtgacatcgtgacatcacaaagctctcctgcatgagaacccgtcatatatgacaccgaagtcaaatgtgtttttttctgtaaaccttgaacatacccttgaccttgaacaacttctgtgacctgctggtagaaaaacaggtagtttcagaccaaaggctggacgagaccacaaaccaaggtccc

SEQ ID NO: 122764 - DNA, 601 bp, Human
aggctgtaacccagcaatcttaggcagctattctcaggacctcccagggctgtgtcacaggtcatagtcttcacatttggctcagaataaacctcttcaaatatttcacagagcttggctttttgtcaacactgccagtaaagtgtgccagctcccacagttggcgaatgaggacctttccaacaggtggatatgaaaatgcaaaccacatggtgacattgtggcatcgcaaagctctcctgcatgagaacccgtcgtgtctgacatggtgacatcgtggcatcgcaaagctctcctgcaygagaacccgttgtgtctgacatggtgacatcatggccacaggcatcgcagagctctcctgcacgagaacctgtcgtgtctgacatggtgacatcgtgacatcacaaagctctcctgcatgagaacccgtcatatatgacaccgaagtcaaatgtgtttttttctgtaaaccttgaacatacccttgaccttgaacaacttctgtgacctgctggtagaaaaacaggtagtttcagaccaaaggctggacgagaccacaaaccaaggtcccaagtgataaaaaaggcaaaacatgaaaacc

SEQ ID NO: 122765 - DNA, 601 bp, Human
gataaaaaaggcaaaacatgaaaacccctccggagatgcccaaagctgttacttgggagacaaggacagctggggcctgctctggagggtggtgaggcaggagtgaccgtgactctaactcaggctggccaccacctagaatctagctgcgggcacatcagaggacttgggagcctgttccttctcgcttagaaaagctacaggtctaggtaaaggagccgtccacacacacacggcctgaggcatcctatgagggggacccctggtggaaatctgcatgaccccagttgacagcccacgyaggcccaactgctcttgggctgggacccccaggcagtggggctggggaccccgggcccgtgaggcctgtgggtggcagcctcagtggggaatgagcccctccgacactggcaggcaccactgacgtgttctctgggtttgtactcggaactgctccatctaattcgcaagggcctgagcactctcattcccattctctctgaaagcaggaagagtatcatagacaaaacacatgtaacccacgaagagtttgtttaaacccaaggaagcttctaaaccagagtaagatgaattcaggtgg

SEQ ID NO: 122766 - DNA, 601 bp, Human
gcatcctatgagggggacccctggtggaaatctgcatgaccccagttgacagcccacgcaggcccaactgctcttgggctgggacccccaggcagtggggctggggaccccgggcccgtgaggcctgtgggtggcagcctcagtggggaatgagcccctccgacactggcaggcaccactgacgtgttctctgggtttgtactcggaactgctccatctaattcgcaagggcctgagcactctcattcccattctctctgaaagcaggaagagtatcatagacaaaacacatgtaacccaygaagagtttgtttaaacccaaggaagcttctaaaccagagtaagatgaattcaggtggggatgctcctgggttcgagtgacaatggataccagcacctacctattgcgtctcagccctgtgctggggcactcaggcaccagggaggtcccatggcttctggtcccgctcggccacctcctgctgtctgcctgcggcagtgtccagcctattgggaccagtctcctctctgcagatgcagcaaacggcacagctcaccccacgcggttggctgagcgtcccacgagatgatgaatcctgag

SEQ ID NO: 122767 - DNA, 601 bp, Human
ggcccaactgctcttgggctgggacccccaggcagtggggctggggaccccgggcccgtgaggcctgtgggtggcagcctcagtggggaatgagcccctccgacactggcaggcaccactgacgtgttctctgggtttgtactcggaactgctccatctaattcgcaagggcctgagcactctcattcccattctctctgaaagcaggaagagtatcatagacaaaacacatgtaacccacgaagagtttgtttaaacccaaggaagcttctaaaccagagtaagatgaattcaggtgggkatgctcctgggttcgagtgacaatggataccagcacctacctattgcgtctcagccctgtgctggggcactcaggcaccagggaggtcccatggcttctggtcccgctcggccacctcctgctgtctgcctgcggcagtgtccagcctattgggaccagtctcctctctgcagatgcagcaaacggcacagctcaccccacgcggttggctgagcgtcccacgagatgatgaatcctgagtgctcagtaaggtgctggcaggcggtaggtgatcatcaaagaagtcactaattacccctc

SEQ ID NO: 122768 - DNA, 601 bp, Human
tggaccatgcccttcagacgctcaaaagttctctgggctacctggaaaaataagaactggtcttatttggttcggcaccgtcctgagacatgctgggttacatctgtttgatgggctgtggtgatacgagtgtggccacgggggtcagggggcaccagagtgacccaactccctgctactgaagacgaaggccttccgtgccctgagctgatcagaggttaagaagcaggacccagatgcaaagacagaactgctccgggaacctaacactgggaagggcagccaagcccatggccctgcrgggagcaggagtgaccgggggaggcgtgcactgatggccccggtctgctgcagtcaggctgtggccagcgccatggggacaggccacatgtgtgcaaggacttgctgggtagactctgcagggacaaacagatcatacatgttaccaataaagtgatttgtatataactggcggcagggggaggggggcggttggagactgaattgcccattcaaatcattagactttttaaaaaaacatttcctcgatggaaatttccagttccacaaaagaaagtaatcaaacagatgttcctcctta

SEQ ID NO: 122769 - DNA, 601 bp, Human
ctgctactgaagacgaaggccttccgtgccctgagctgatcagaggttaagaagcaggacccagatgcaaagacagaactgctccgggaacctaacactgggaagggcagccaagcccatggccctgcagggagcaggagtgaccgggggaggcgtgcactgatggccccggtctgctgcagtcaggctgtggccagcgccatggggacaggccacatgtgtgcaaggacttgctgggtagactctgcagggacaaacagatcatacatgttaccaataaagtgatttgtatataactggyggcagggggaggggggcggttggagactgaattgcccattcaaatcattagactttttaaaaaaacatttcctcgatggaaatttccagttccacaaaagaaagtaatcaaacagatgttcctccttaagtcttaaaccacgacattcagatgatctatgtgcaaattaataaggttatgacataattcaattatgtgacaaagccgagggagagttgacaaagaaccagactggcatcattgacttctcaatgaagtggagctcggtaaaaaatctagatgaatcacaggttgtctgac

SEQ ID NO: 122770 - DNA, 601 bp, Human
acaaaagaaagtaatcaaacagatgttcctccttaagtcttaaaccacgacattcagatgatctatgtgcaaattaataaggttatgacataattcaattatgtgacaaagccgagggagagttgacaaagaaccagactggcatcattgacttctcaatgaagtggagctcggtaaaaaatctagatgaatcacaggttgtctgaccagaagatccctgacaatgggctgtttactttagagaaaggagctgaaccctgaaaactgaatgtgcgaaattctaattatcaaaaaacccacrgcgcatcaggtagacatgatcatctgcatttcttttccacgctgcaaatcaccgcgatcccagattagtccagccggccgggtgcctccctcccgtccgcctgggcagttgaggccaatcagcagtttaggcgcacaggtgcgggctcagaaagcagcagcaatctccggtgtgttctggaatcagaagttgaggtccacgtctgattagttcccttcgtttcattagacttggctgaatgtgtgccagtcccactagagcttcgatttcagacttcctatgacaggtttgttcacagaa

SEQ ID NO: 122771 - DNA, 601 bp, Human; identical to SEQ ID NO: 27723

SEQ ID NO: 122772 - DNA, 601 bp, Human; identical to SEQ ID NO: 27724

SEQ ID NO: 122773 - DNA, 601 bp, Human; identical to SEQ ID NO: 27725

SEQ ID NO: 122774 - DNA, 601 bp, Human; identical to SEQ ID NO: 27726

SEQ ID NO: 122775 - DNA, 601 bp, Human; identical to SEQ ID NO: 27727

SEQ ID NO: 122776 - DNA, 601 bp, Human; identical to SEQ ID NO: 27728

SEQ ID NO: 122777 - DNA, 601 bp, Human; identical to SEQ ID NO: 27729

SEQ ID NO: 122778 - DNA, 601 bp, Human; identical to SEQ ID NO: 27730

SEQ ID NO: 122779 - DNA, 601 bp, Human; identical to SEQ ID NO: 27731

SEQ ID NO: 122780 - DNA, 601 bp, Human; identical to SEQ ID NO: 27732

SEQ ID NO: 122781 - DNA, 601 bp, Human; identical to SEQ ID NO: 27733

SEQ ID NO: 122782 - DNA, 601 bp, Human; identical to SEQ ID NO: 27734

SEQ ID NO: 122783 - DNA, 601 bp, Human; identical to SEQ ID NO: 27735

SEQ ID NO: 122784 - DNA, 601 bp, Human; identical to SEQ ID NO: 27736

SEQ ID NO: 122785 - DNA, 601 bp, Human; identical to SEQ ID NO: 27737

SEQ ID NO: 122786 - DNA, 601 bp, Human; identical to SEQ ID NO: 27738

SEQ ID NO: 122787 - DNA, 601 bp, Human; identical to SEQ ID NO: 27739

SEQ ID NO: 122788 - DNA, 601 bp, Human; identical to SEQ ID NO: 27740

SEQ ID NO: 122789 - DNA, 601 bp, Human
atgaccataaagaatccttcgttccactacggaggggactaaaggaaggtcctatccccacctctccctctcggggccagaagactagttagacatcttggattcccctccagggcgggaaaaccaaagtgagctgggagcgtgcctcccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccgrtccacttgcagaaaccggtggacgatgagtaggtggaccacaaaggcgtcctcggcactttgggggcaggtgtattatttttaacattcggggcagctcataggaatacatcctccagagaaggcgggaagaactccgtgattgctttcttttaattgatactctccgtctggtaggcctcatgggtctccatcatggaatcacagaacttgagaataaaggggcttcatcaccttagcttccactcggtgagcactagctctacctggtatctcatttgatccacactcctttaaggta

SEQ ID NO: 122790 - DNA, 601 bp, Human
agctcataggaatacatcctccagagaaggcgggaagaactccgtgattgctttcttttaattgatactctccgtctggtaggcctcatgggtctccatcatggaatcacagaacttgagaataaaggggcttcatcaccttagcttccactcggtgagcactagctctacctggtatctcatttgatccacactcctttaaggtaaagatttttaccagatttacggtgaggaaagttcagctcagatttgctccaggccacgtgaacggtaactgtgccagctgagatttgaactgggrtgtggtagatggcaaagccatgtaagtatattacgggatcagaaatgcctctcatccctcagtcactcaggtgactccagaggactgagacttgccataagcccagccagaactagatgtgcggaatacagccctcccccgaccccaccccactgtgtccctgaaacaggacgctttcctgaagaacctgagttaaggccaccctacctgaatttccactaagtgtcaaggcaggctagtattttgaaattcagagcaaagtttgtgtagaaaaggctcccagcccctgacagctaccta

SEQ ID NO: 122791 - DNA, 601 bp, Human
ggaaagttcagctcagatttgctccaggccacgtgaacggtaactgtgccagctgagatttgaactgggatgtggtagatggcaaagccatgtaagtatattacgggatcagaaatgcctctcatccctcagtcactcaggtgactccagaggactgagacttgccataagcccagccagaactagatgtgcggaatacagccctcccccgaccccaccccactgtgtccctgaaacaggacgctttcctgaagaacctgagttaaggccaccctacctgaatttccactaagtgtcaagrcaggctagtattttgaaattcagagcaaagtttgtgtagaaaaggctcccagcccctgacagctacctagatgtgttgttgatatcgttacaaattaggaaatggtctcctagttctcaaatggtgagtcttaagcttcagtttgtaaaaacaagccctaaaatgatgaaacattaattctgcatttatcttctttctgattccttttgtcttatattttaattttttttttttttttagctttctgacttacgggtgtaatccatttagctttgcttttttactgatagagttatttag

SEQ ID NO: 122792 - DNA, 601 bp, Human
ggacgctttcctgaagaacctgagttaaggccaccctacctgaatttccactaagtgtcaaggcaggctagtattttgaaattcagagcaaagtttgtgtagaaaaggctcccagcccctgacagctacctagatgtgttgttgatatcgttacaaattaggaaatggtctcctagttctcaaatggtgagtcttaagcttcagtttgtaaaaacaagccctaaaatgatgaaacattaattctgcatttatcttctttctgattccttttgtcttatattttaattttttttttttttttagctttctgacttacgggtgtaatccatttagctttgcttttttactgatagagttatttagttctgttatttttcttctaataactgctttagctgtgtcacataggttcagctatgttgtgttttattattaagaaattctgcaatttaattttgtgtttaatttttgacctaatgggtagcagaacattttaaatgaccctgtggtcattcgatagggtcagtaaaatccggactctggaaacaaacatacccagtttctacaacaacgatgcacaaagaaaaacaagagagatgga

SEQ ID NO: 122793 - DNA, 601 bp, Human
gtcttatattttaattttttttttttttttagctttctgacttacgggtgtaatccatttagctttgcttttttactgatagagttatttagttctgttatttttcttctaataactgctttagctgtgtcacataggttcagctatgttgtgttttattattaagaaattctgcaatttaattttgtgtttaatttttgacctaatgggtagcagaacattttaaatgaccctgtggtcattcgatagggtcagtaaaatccggactctggaaacaaacatacccagtttctacaacaaygatgcacaaagaaaaacaagagagatggagacagaaccaagagattaaaaaaagacttagccaactgccatgtatggatcttattggattcttttttttttttttttttggatcttattggattctaatcaaagaataaactagtagaaaatcaatttttatgagacaaccttggaaaatatgacactgacaggatattttctagtattaatgaacaatttatgttaggggtgataatgtgattacacacacacatatatttttcttttcttaagtccttgcttttcaagaacagtgcca

SEQ ID NO: 122794 - DNA, 601 bp, Human
taataactgctttagctgtgtcacataggttcagctatgttgtgttttattattaagaaattctgcaatttaattttgtgtttaatttttgacctaatgggtagcagaacattttaaatgaccctgtggtcattcgatagggtcagtaaaatccggactctggaaacaaacatacccagtttctacaacaacgatgcacaaagaaaaacaagagagatggagacagaaccaagagattaaaaaaagacttagccaactgccatgtatggatcttattggattcttttttttttttttttttggatcttattggattctaatcaaagaataaactagtagaaaatcaatttttatgagacaaccttggaaaatatgacactgacaggatattttctagtattaatgaacaatttatgttaggggtgataatgtgattacacacacacatatatttttcttttcttaagtccttgcttttcaagaacagtgccaaaatatttcctagtgaaataacattatgcctggagttgtttcaaaataatttggggtggggaaatggatagggcctatatatatacgaaatactatcagccatggattg

SEQ ID NO: 122795 - DNA, 601 bp, Human
catatacacacatatacacatgtatgtatatgtatatatgtatctgtatgtatatatgtatatatatgtgtatatatgtatatatatgtgtgtatatatatatgtgtgtgtgtgtatatatatatgtatttgagatggagtcttgctctgttgcccatgctggagtacagtggcgctgtcttggctcactgaaacctctgcctcccaggtgcaagcgattctcctgcctcagcctcctgagtagctgggactacaggcatgtgccaccacacccggctaattttttataattttagtagasacgaggtttcatcatgttagccaggatggtcttgatctcctgatcttgtgatccacccacttggcctcccaaagtgctgaaattacaggtgtgggcgaccatgcctggcccaaaaactaaatatattttaaaaataaaagcaacagactcctttaaggaaaataggaaacaaatttgttaaactgatattaatagtaagtcaaaggaggatggcaagaaattgaggaggggaatgcaatttctgggtttaatgacatatgctttcatgagcaattccatcgaaggacaaagtattaaaaa

SEQ ID NO: 122796 - DNA, 601 bp, Human
tgtatatatatgtgtgtatatatatatgtgtgtgtgtgtatatatatatgtatttgagatggagtcttgctctgttgcccatgctggagtacagtggcgctgtcttggctcactgaaacctctgcctcccaggtgcaagcgattctcctgcctcagcctcctgagtagctgggactacaggcatgtgccaccacacccggctaattttttataattttagtagagacgaggtttcatcatgttagccaggatggtcttgatctcctgatcttgtgatccacccacttggcctcccaaagtgctgaaattacaggtgtgggcgaccatgcctggcccaaaaactaaatatattttaaaaataaaagcaacagactcctttaaggaaaataggaaacaaatttgttaaactgatattaatagtaagtcaaaggaggatggcaagaaattgaggaggggaatgcaatttctgggtttaatgacatatgctttcatgagcaattccatcgaaggacaaagtattaaaaacaaattttcatgagacaatctaagaaaatatgttttgaaaagttccatccatcttgtacatcattatattcctagg

SEQ ID NO: 122797 - DNA, 601 bp, Human
tgtatatatatatgtgtgtgtgtgtatatatatatgtatttgagatggagtcttgctctgttgcccatgctggagtacagtggcgctgtcttggctcactgaaacctctgcctcccaggtgcaagcgattctcctgcctcagcctcctgagtagctgggactacaggcatgtgccaccacacccggctaattttttataattttagtagagacgaggtttcatcatgttagccaggatggtcttgatctcctgatcttgtgatccacccacttggcctcccaaagtgctgaaattacaggygtgggcgaccatgcctggcccaaaaactaaatatattttaaaaataaaagcaacagactcctttaaggaaaataggaaacaaatttgttaaactgatattaatagtaagtcaaaggaggatggcaagaaattgaggaggggaatgcaatttctgggtttaatgacatatgctttcatgagcaattccatcgaaggacaaagtattaaaaacaaattttcatgagacaatctaagaaaatatgttttgaaaagttccatccatcttgtacatcattatattcctaggacctaattaattat

SEQ ID NO: 122798 - DNA, 601 bp, Human
ttaaggaaaataggaaacaaatttgttaaactgatattaatagtaagtcaaaggaggatggcaagaaattgaggaggggaatgcaatttctgggtttaatgacatatgctttcatgagcaattccatcgaaggacaaagtattaaaaacaaattttcatgagacaatctaagaaaatatgttttgaaaagttccatccatcttgtacatcattatattcctaggacctaattaattatagagcatggcacatagtatgtgcttaataaatatgtgtattgaataagtgacagatcacagawttgtttgtgacaagtctttcactatagaaagcgtaatgctgtctatggcagcatagcttgatctttgaagtcaagccaggatttgaatctctgttctatctatgactactatgatctccagtaactacaaaacttccctaaccctcagtttgctagtttgtaaaatgggctaataacatatagtctgtgaaattgtggcgaaggtcttttgagatgcacataaaccacttagaactattaacacattacttggcatgaagtaggccctttgtaaagtcctctgttttattcaatggcaaa

SEQ ID NO: 122799 - DNA, 601 bp, Human
acatcattatattcctaggacctaattaattatagagcatggcacatagtatgtgcttaataaatatgtgtattgaataagtgacagatcacagaattgtttgtgacaagtctttcactatagaaagcgtaatgctgtctatggcagcatagcttgatctttgaagtcaagccaggatttgaatctctgttctatctatgactactatgatctccagtaactacaaaacttccctaaccctcagtttgctagtttgtaaaatgggctaataacatatagtctgtgaaattgtggcgaaggycttttgagatgcacataaaccacttagaactattaacacattacttggcatgaagtaggccctttgtaaagtcctctgttttattcaatggcaaaggggaaattaatccagaataagaaggaaatggactgaactcccaccagaagaagaattaaggttcagatcctgttcagatcctgtttcttcttgagagaaaacctctctgctatggataaaaggctagttcatggaagaaaataaaaacaaaaagtactatttcctggggaaaggatcaacggtgactgtgatcagttattcaag

SEQ ID NO: 122800 - DNA, 601 bp, Human
attcctaggacctaattaattatagagcatggcacatagtatgtgcttaataaatatgtgtattgaataagtgacagatcacagaattgtttgtgacaagtctttcactatagaaagcgtaatgctgtctatggcagcatagcttgatctttgaagtcaagccaggatttgaatctctgttctatctatgactactatgatctccagtaactacaaaacttccctaaccctcagtttgctagtttgtaaaatgggctaataacatatagtctgtgaaattgtggcgaaggtcttttgagakgcacataaaccacttagaactattaacacattacttggcatgaagtaggccctttgtaaagtcctctgttttattcaatggcaaaggggaaattaatccagaataagaaggaaatggactgaactcccaccagaagaagaattaaggttcagatcctgttcagatcctgtttcttcttgagagaaaacctctctgctatggataaaaggctagttcatggaagaaaataaaaacaaaaagtactatttcctggggaaaggatcaacggtgactgtgatcagttattcaagttcttctttt

SEQ ID NO: 122801 - DNA, 601 bp, Human
gctagtttgtaaaatgggctaataacatatagtctgtgaaattgtggcgaaggtcttttgagatgcacataaaccacttagaactattaacacattacttggcatgaagtaggccctttgtaaagtcctctgttttattcaatggcaaaggggaaattaatccagaataagaaggaaatggactgaactcccaccagaagaagaattaaggttcagatcctgttcagatcctgtttcttcttgagagaaaacctctctgctatggataaaaggctagttcatggaagaaaataaaaacaaraagtactatttcctggggaaaggatcaacggtgactgtgatcagttattcaagttcttcttttgtttattccaattatcctgacattccttcttgagacaacactgcccataacgttttcccgtctctcctgtaggtgggcttcagggagaggcacagctaggaagggaggaaagagaggaaaagacttcctgcggctagcaggtctcaaagccttgtcccagagtgcagcaggatcccctgcaaacctgttagaagtgcacattctcaggccagctcctgctttaacacgccctccagg

SEQ ID NO: 122802 - DNA, 601 bp, Human
atttaccagaaacctacgaaatgtcagtttagggcgtgggggagggacagggaaatagagatagactaaacatagactagactcaggaactctaaaatccagttggaagtattacttcctctgtcagttacttcactcagggaagcaggaggtagaagtttgagccaggaggtagaagtttcagccagtgggtctgagctgtacaaatgctgaaatttcattctctgggagaggccaaagaaaggcagggcttctaggcgtgtgctcgcaactgccaccctgtggtggggtcgtggggggkaggctggtgggctagacccatctgtgcaggggccaacagtagcctcctacccggatgggggctaccccagggggattaggatgagctcaccattaccaggtagaaagtgaacacaggaaaacatgagctggaggtcagaccgccctatgttcgttaccctaactgaccactgccatcaagattgttaagcattttgtcaccgttaaaggatttcacacaagctgttcctcccactcaaaccttggccaggaaactggtggatgatttgcccttgattcagaggcaatcattcttaattgc

SEQ ID NO: 122803 - DNA, 601 bp, Human
ccatcaagattgttaagcattttgtcaccgttaaaggatttcacacaagctgttcctcccactcaaaccttggccaggaaactggtggatgatttgcccttgattcagaggcaatcattcttaattgcctcacatggttggaaggtgagtaagtgtctaagatcataaatgctggcgggaaggggtcaggagtgatcaaaccagcacccctcctggcagtggggtcaggaggcaagtccctgcatgccttcccatgacacagtaccagatcccagggtggtggcacagaaagctggattcrctttttctggaaacactatttgcccggatccagcagggaagtctatgaaagatgactctacgggcagggtatgcacctgcctgtgcccgtgagctgggtgcagttgtgacgggagacccaagggcctccagcaaacaggaggaacttgatctggttacaggaacgatcttgcaggatccaaactttgtttctctgcctgtcagactttcaggaaaagctcagctttccacaaagggcaagctcttttccttttcttctcccttctgccatgctctggttaggagggaaaatgattggctc

SEQ ID NO: 122804 - DNA, 601 bp, Human
tccttttcttctcccttctgccatgctctggttaggagggaaaatgattggctctttcttgagatacacaatttccatatcccatttcttccctctctcctttttcacaaactatttgttggatataaataatcagtgtttaaagcctcaaaacatgcctgacttttagccaaatccacaaacaactccatgattccgagtttcccatccttggttagagtttatttggagcgtcggatacagtttccactgtggctttgatacctctttaagaaagactctgtttggtacattaatgacsaatagaatgaaactattcacacccatagttcatttgggccagtaaatgttgctggatggtttcagatgaaaagtatttgtaaggtagactctgaaaaactttgcttcttatttgagatctctttgtctctgatttcagtccttttcaggagcaatccattcacttctctgcctgccttctcttagagttttactctttttttcctctgtcaatgattccaaaatccatttaaaggaagtattaatgtctaaagtctgtgcaaacctggcaaaattctcttttgagtgaacggtttgcttc

SEQ ID NO: 122805 - DNA, 601 bp, Human
ctattcacacccatagttcatttgggccagtaaatgttgctggatggtttcagatgaaaagtatttgtaaggtagactctgaaaaactttgcttcttatttgagatctctttgtctctgatttcagtccttttcaggagcaatccattcacttctctgcctgccttctcttagagttttactctttttttcctctgtcaatgattccaaaatccatttaaaggaagtattaatgtctaaagtctgtgcaaacctggcaaaattctcttttgagtgaacggtttgcttccctaaaatacctsaaatgggagattcttccaggcatttctgaaatgggggagtctcatgcctcacttgttcctcagaatgtttatgttattttatttgagacagagtcttactctgtcacccaggctggaatgcagtggagcaatctccgctcactgtaaactctgccttccctgattcaagtgattcccctgccatggcctcccaaagtgctaggattacaggcgtgagccaccatgcctggcaagagtgtttattttaaaccacaccaagatctgttattctttgtgaattaactttatgagtcaacatta

SEQ ID NO: 122806 - DNA, 601 bp, Human
tattaatgtctaaagtctgtgcaaacctggcaaaattctcttttgagtgaacggtttgcttccctaaaatacctgaaatgggagattcttccaggcatttctgaaatgggggagtctcatgcctcacttgttcctcagaatgtttatgttattttatttgagacagagtcttactctgtcacccaggctggaatgcagtggagcaatctccgctcactgtaaactctgccttccctgattcaagtgattcccctgccatggcctcccaaagtgctaggattacaggcgtgagccaccatgsctggcaagagtgtttattttaaaccacaccaagatctgttattctttgtgaattaactttatgagtcaacattaaaaatttgaaatcccaagttctctcttcactgccaccaaggtcgttttgtgctatttccactttgattagggtcattaacagaaaatcccaatagtctaactagaaagagcctggactggccaggctctaggaggcagggggtgaaccccaggtccaggagctcctatggagcagtgtatgtggccacaggtaacacccttcacctttgtatgtcttctttacatt

SEQ ID NO: 122807 - DNA, 601 bp, Human
gaaaacctatgctttaagttctagagagcatgtttaggaatacctttcacctatttcagaaggtactttaaaattggacctgggagtcatgacagagcttcctggaacaaccaagcatctttctccatccttgcaatagtagttgactgctgaagtaccagaaacagattttctaaaatatctgaccttcagcatctcctggcaggactgtttggcaaaaataaaaaaaccttcaaaaattctgggccatcctaacactataaatatacttggaatcgtgtgtacagtcagagatgctgarcaattactcctcagtaagaccagaggagtcattgtctccacggagggccggaggggttccagcggtgaatcaccatcagatatctgaactattcatgtagccatctttaaactcgagggctttttcttatcttttttttttttttggccttccttttgataacttgaaattcaatttccatttggcacatggctgtaatgtaatctagctccccagccattgctaacactttctggactcagttctctgtctcacgctctttgcatggagggtctgtctgtattgctgtattgcttctgg

SEQ ID NO: 122808 - DNA, 601 bp, Human
acctttcacctatttcagaaggtactttaaaattggacctgggagtcatgacagagcttcctggaacaaccaagcatctttctccatccttgcaatagtagttgactgctgaagtaccagaaacagattttctaaaatatctgaccttcagcatctcctggcaggactgtttggcaaaaataaaaaaaccttcaaaaattctgggccatcctaacactataaatatacttggaatcgtgtgtacagtcagagatgctgagcaattactcctcagtaagaccagaggagtcattgtctccayggagggccggaggggttccagcggtgaatcaccatcagatatctgaactattcatgtagccatctttaaactcgagggctttttcttatcttttttttttttttggccttccttttgataacttgaaattcaatttccatttggcacatggctgtaatgtaatctagctccccagccattgctaacactttctggactcagttctctgtctcacgctctttgcatggagggtctgtctgtattgctgtattgcttctggtcccttgaatttccaggtcagggtagaagcagatggaaaga

SEQ ID NO: 122809 - DNA, 601 bp, Human
actgctgaagtaccagaaacagattttctaaaatatctgaccttcagcatctcctggcaggactgtttggcaaaaataaaaaaaccttcaaaaattctgggccatcctaacactataaatatacttggaatcgtgtgtacagtcagagatgctgagcaattactcctcagtaagaccagaggagtcattgtctccacggagggccggaggggttccagcggtgaatcaccatcagatatctgaactattcatgtagccatctttaaactcgagggctttttcttatcttttttttttttttggccttccttttgataacttgaaattcaatttccatttggcacatggctgtaatgtaatctagctccccagccattgctaacactttctggactcagttctctgtctcacgctctttgcatggagggtctgtctgtattgctgtattgcttctggtcccttgaatttccaggtcagggtagaagcagatggaaagaatgcttgagaggttttctttttctaagaatatgtttggaaaatgatgaggtcaggaaagcagacactgcaatcctgcgcaggagagagtctttgagagccctcg

SEQ ID NO: 122810 - DNA, 601 bp, Human
ttggcaaaaataaaaaaaccttcaaaaattctgggccatcctaacactataaatatacttggaatcgtgtgtacagtcagagatgctgagcaattactcctcagtaagaccagaggagtcattgtctccacggagggccggaggggttccagcggtgaatcaccatcagatatctgaactattcatgtagccatctttaaactcgagggctttttcttatcttttttttttttttggccttccttttgataacttgaaattcaatttccatttggcacatggctgtaatgtaatctagctycccagccattgctaacactttctggactcagttctctgtctcacgctctttgcatggagggtctgtctgtattgctgtattgcttctggtcccttgaatttccaggtcagggtagaagcagatggaaagaatgcttgagaggttttctttttctaagaatatgtttggaaaatgatgaggtcaggaaagcagacactgcaatcctgcgcaggagagagtctttgagagccctcgctgctcactctctttgcacctcacatgttctacctgcggccagtgaggggagagcctttcatcctg

SEQ ID NO: 122811 - DNA, 601 bp, Human
gcagggaagtgtgcatgtggacgttcttgggatggtgcttctctctcagagtccagcttttctttgctagtgaggggcttcttctcctgccccaatcctccccccgctgccaccaccaccaccagcctaggccttaatcgcagagaaggccactcattgagggacttccttgaaatctgcatcctgcaaacggaagccaccatcttaatttttaggagtctatctggggaattcatggctttagtttctgcttgaagcttgttgattttctatcaaatgctttaaaaaatttctgtctgcrtaaatggtaacatacaaagttaaacaaaaattctgtctcccacagaaattccataaaggttctttcatctctaccagcatgagcatgtctcatttgtggaagcaggcctacttgccatgacaacaactattctgtggctttgcagaggtaccctcacagttgcagtgtgcttttgctaggcagccggcagagatggcccacatatgaccactgcctttcaaccctacctgttttaaggtggactcacttggattgagaaactggtattttcccctcacttgcacgtattttggatgtata

SEQ ID NO: 122812 - DNA, 601 bp, Human
gtattatctttgagtttgttttaaaaagtaactttttaagataaagacaaattgtaactttagaaagaatactatgaactgtcaattctgtcacatactgagcaaattttaaaaaaaagtataatgtacaatttttttttctcattctttttcaagcacagcttgataaaccttgtctcttactcctggttttagatggaattcttttttcctactcacccagaatcctcatctttgaaatgatgaatttgtaaatggtcctgaacttagggtttttttttttttttttttttttttgacyttaaaagttctcatggttcccagcactttggtaggccgaggcgggcggatcacttgaggtcaggaattcaagaccagcctgaccaacatggtgaaaccctgtctctactcaaaatacaaaaattaattgggcatggtggtgagctcagaaggctgagacaggataatggcttgaacccaggaggcggaggttgtggtaagccgagatcacgccagtgcactccagcctgggcaacagagcaagactccatctcaaaaaaaaaaaagttcacatggcatccttctcctagtaattggattg

SEQ ID NO: 122813 - DNA, 601 bp, Human
tgacaatggagggtgtggagacggtgatgtaagaggtctgatgggaaaaaaaggaagaaattccacgtagctcagtaaggaaactgaggcccagagagggcaaataatgtactcaaagtcagagttaatggtgtagaaggacaggatgcaaatgaggacagcgtgtgactggtgtgactgctcacgtttcctggttccatcccttccaccaggctgcctcctgaagcaaggcagtgatcagtttctgagctctcatgacccatcttcatagcgtctccttctcaaccagcacaagaaatamaatagtcaaaacagaaaggcaaagcctctctgcaaccctcttccctatttcttcactctcctgacaaaaagggactgaaaaatttccaaaatcaagaagcataaagcctgatttctttttctagtcagactaacgaaacgatttattttctttccactctcttttaaagaaaagaggaacagcaccgctccctggagctattctagcagttaacaacaaagctaagcactacttaccacagaactttgtaagatatcagaaaaaaaaaacagtttacaaaaatttttttagaggcagggt

SEQ ID NO: 122814 - DNA, 601 bp, Human
tctctgcaaccctcttccctatttcttcactctcctgacaaaaagggactgaaaaatttccaaaatcaagaagcataaagcctgatttctttttctagtcagactaacgaaacgatttattttctttccactctcttttaaagaaaagaggaacagcaccgctccctggagctattctagcagttaacaacaaagctaagcactacttaccacagaactttgtaagatatcagaaaaaaaaaacagtttacaaaaatttttttagaggcagggttacccgggctggagtacagtggcatgwtcacagctcactataacctcaagttcctgggctcaggtgatcctcccacctcagcctcccgacaagctgggaccacaggtgctccaccacacccaactaatctttttttaatttttgtttttatagagacaaggtcttgctatgttgcccgggctagtcttgaactcctggcctcaagcaattgtctttctttggcttcccaaagccctgagattacaagtgtgagccatcacgcccaaccccaagctgtttttcttctactggatgctcacaatgcagaacacttctgtgaccccagat

SEQ ID NO: 122815 - DNA, 601 bp, Human
actctgtacttcagatgccgcttgcaaatagtaggttgtcacctatacttctgaccaacaggctattagttggggagggggtcctagaacccctccttggcttccattaatttggtagagcagctcacagaactgagggaagcactttattaatatttaccatgtattatgaagatattgtgagggatacagaacaaagcatggggaaagacacgtggagcttctgtttcctccttggggtcaccaccctccaggaacctccctatgttcaaccatccggacacccatctgaaccctgccytttagggttttcatggaggcttcattgcataggcatgattgattagaccattggccactagtgatcaacttaaccttgagcccctctgccctcctgggaggttggcgttggggctgaaagtcccaaccctctagtcatgccttgttctttccagtgaccaacccccatcctgaagctagctaggacccgccccccctccgccgccattatctcattagcatacaaaagtactcttgtcactcaagagatttaaaggtttttgtttggtttggtttggtttggtttttgagacagagtctc

SEQ ID NO: 122816 - DNA, 601 bp, Human
ttggccaggctggtctccaatttctggcttcaagtgatccacccaccttggcctctcaaagtgctaagattacaagtgtgagccactgtgcctggccagatttaaaggattttaggagctgtacatcaggaaactgaaagaagaccaaatatctgtttcacaatatcaccagcttctttacaattcctcagtaacctatgacttacaattttctctaatacaactgtagtctaagtaatgttggcttacatatcttttgatccttaaagttatattagtatatgtttgttgtacacaaacrcagatgtatacagatactagaacattctttaaggtagcataagttgggaaacaatctaaatgtttataggtaggggcagagtcaagtcattcgtccatacaatggagcaagcgctacaccgctataaatagtgaggcaaaatctcactctctgggacaatctccaagacagggtgttaagtgaaagaggaaagtgcaagtcattgtgtggagtatcctaccatttgtaagaaaaggatgtgtggctattatacatgtttggaatatctggaaggatgcacaaggagttggcaatagtagt

SEQ ID NO: 122817 - DNA, 601 bp, Human
ggagcaagcgctacaccgctataaatagtgaggcaaaatctcactctctgggacaatctccaagacagggtgttaagtgaaagaggaaagtgcaagtcattgtgtggagtatcctaccatttgtaagaaaaggatgtgtggctattatacatgtttggaatatctggaaggatgcacaaggagttggcaatagtagttgcttctggggagaactaaggaagagaatggagggagggggaaaattacttttaattattctctttttgttgcttctgaattttgcaccgtgtgcattgattayctgttaataactaaaataatataaagtaaataaataatcagcatatcttaccacagcaaaggtggtttaaataatgtctttaaacaattaaattcaataacacttttaaacagagattgaaggtggcttcacaatgggcagggaaataatatgtgacacagtttgcaagaacgaaaaccgtgtctgaaaatcacattaaaatgtgttgggaaacagcctgaagaaaaactgttcctaaaatagaaccaacaataaataaataaacaaatgaagtaagcaatgcaaatttcttaaaagcac

SEQ ID NO: 122818 - DNA, 601 bp, Human
aattttcacctgaaaactcaaattttatccttgaaaacaaaaacaaatactgtcagttgtttcccttagaatgacaggctactctgcatttttgggaaaatatctactgccaaaatctaagtatgctttgtctgtcagttgttcttccaagtgaaaatggaagaaacatcttgttgaactcacgacttgggccactgcacaacttcctttcctcaagacagtcacagttctttgatatgagcagaagtgcttcatgcatcttccctttcatcactctgaatactaaaaagatgtgtgttgyggccgggcgcggtggctcacgccggtaatcccagcactttgggaggccaaggtgggtggatcaagaggtcaggagactgagaccatcctggctaacacggtgaaaccccatctctactaaaaatacaaaaattagctgggcatggtggcacgtgcctgtaatcccagctactcgggaggctgaggcaggagaatcgcttgaacccaggaggcagaggttgcagtgagccaagatcttgccactgaactccagcctggcaacagagctagactccatctcaaaaaagaaaaaaaaaatgtg

SEQ ID NO: 122819 - DNA, 601 bp, Human
ttattacagcatattgttataattgttctattttattattatttattgttaatctcttacggtgactagtttataagttaaaatttatcatatgtatgtatacacaggaaaaaacatagtatatgcagggtttgggactatccacagtttcaggcatgcactgcaagtcttggaacttatccccaccagataaggggagactggtgtgtaatatttgtatacaagtattttctttagtatatgtctgtccacaaagtaggctttcctatacccatacatcagaaagacagacatgtagatytatagaaggccactggagaatcaaaatatgccaaaccaaaatatgtcacaccagaatatgccactttggcataaggatttttaaaaaatttttttattttcataggtttttcggaactggtggtgtttggttacgtaagtaagttctttagtggtgatttgtgaaatttgggtgcacccgtcacccaagcagtagacactgcacccaatttgtagtcttttatccctcacccccttcccaccctttctccaagagtccccaaagtctattgcatcatttgtataaggattgttttgaggt

SEQ ID NO: 122820 - DNA, 601 bp, Human
accaaaatatgtcacaccagaatatgccactttggcataaggatttttaaaaaatttttttattttcataggtttttcggaactggtggtgtttggttacgtaagtaagttctttagtggtgatttgtgaaatttgggtgcacccgtcacccaagcagtagacactgcacccaatttgtagtcttttatccctcacccccttcccaccctttctccaagagtccccaaagtctattgcatcatttgtataaggattgttttgaggtgaaggcaattaagaagcagcaaatgcagaaaaagsaggacataaatttccctttgtgaaggtgtttctcctcccatcttccataccaagaggagaccaactcttgtcactggaaacagaaagtcagcaccaagacaggtctgcacaaacaaacctcaccaatatcacccttatctttcattaggttcccctatatgtgtactctcccagtcctagaagcccaggttgctttttgcttgttttgttacttctctgcaaatttatcaccctttgttaaaatggtatataaactcctgggtctaacagcctctttggttcttcacttcttttctatga

SEQ ID NO: 122821 - DNA, 601 bp, Human
aatggtatataaactcctgggtctaacagcctctttggttcttcacttcttttctatgaatgtcccttcacataaaaattaaaataataacataaaataagatttgtctgtcttttctcctgatggtctcacttttgccagtgtaattaacagaccccagctaaggaacagaagaaggttgaggaaaagttttattttcctcccctatactacatagtccagtatgactgaacatgcattgtcattaagggaaagtgttcagttgagggtgggaggggatgcattggccaaggtctcaagrggagaagtgactgcttggattcagttcttcatttgctcaaagataagccacccaatgccccattgtgttagtctgccagggctgtcatcacaaagtaccacacactggatggcttaaacaacagaaatttattgtctccaagttttggaagctggaagtccaagatcaaggtgtcagcagggttggtcccttctgagggctgtgagggagcatttgctccatgcctctccctagctgctggtggtttgctggcaatctttggcatcccttggcttgtagactcacttccctgatctctgt

SEQ ID NO: 122822 - DNA, 601 bp, Human
cctgctgctcacctcctgctgtgtggctgggttcctaacaggccatgaaccaagtaccggtctatggcctggggactggggacccctgaactagtgggacaagttttaggagaaaacggggctccatccacaccatgagaatggggcactggggttgtacagagccagtggtggcccagtgtccctgtcctatactggatccagctcatgagacagatgcagtttatggtcagactccatgtggtccagtgctcccttgataaagaaggtaatccaatgggaagaaagtgaactgtccctrgtcccatcgtcactgggttctctctggcttgtaaggacagccagtttcacatggaatgtctgggacagagtccacacaaatttgatttggtgtcagtgatctggggctttgtggcaatgttctgccctgcttgaggttacaggccaaagttcaaagaccagcaacccaaaagcctggtcactggagtgtagatgctgggtggagtattcacaagcacgctacagaaggcccaatgcctgaagttaagaccataagctcaactctcctgatcaaaaagacaaacactattctcttaacaca

SEQ ID NO: 122823 - DNA, 601 bp, Human
ctcttggggtcctgttgcgtgcattggcagcgtagctcagaggagttgccctaggaaagaatcacggtggagggcagtccttccccacatacatgcaagtcctccaacaccatgcatgtccagcagcaatcttggccgcgttgtggaccagaaaggaaaagccatagtaagaaacagctgtttggcttgaagatgtgttggtttgcttatgtttgtaacttgtttgcttttatgctttgggttttcaagatgctggtgttattggtgagaatggcaagaactcccatgccttgtgaaccayaaccagctcctggcattctcaagttggtggcaagatgcatatggaggtgcatgtcatgtgcatgggaattgcaggggccctatgtggatggatccttggtgcttctcagataagacaaaactacttaggaagcaaaactgtgatgggaatagtggatcacatataagagaaatattttttttatttatagtttcctcttggtttaatttactttttcattataggattatagctctagataagacatgatctacaaactaaaccacaagccacttagagacaacaggaccatgaaaatca

SEQ ID NO: 122824 - DNA, 601 bp, Human
ggccctatgtggatggatccttggtgcttctcagataagacaaaactacttaggaagcaaaactgtgatgggaatagtggatcacatataagagaaatattttttttatttatagtttcctcttggtttaatttactttttcattataggattatagctctagataagacatgatctacaaactaaaccacaagccacttagagacaacaggaccatgaaaatcaattttccgctaatttgttgttgttgttattgttgtgacagatgtgattcatctctggcaaaaaaaaaaaaaaaaaatgctccaggtgagagaaatcaaaattaaatactgtctggagtttaatactgccacgagattgcatctttaggttgatttttttgtcctgtttattttatcaattgattacttgattgagaaaaggattgtctgtatcagttatactacaggttgcattgtacaagataccaaaatcattgcagaaccactgtttttcgttctgacagttttactcaatagacactgtacctctcagataactaggaaacgagagtaaagtcttccgtcaataatgtcagaacactaatttactctcccac

SEQ ID NO: 122825 - DNA, 601 bp, Human
aacagaggacacattttgcttgcctgaggcttcgatgaaacttctgacaatatcaggggacatatttatacttctaacagtatttttagctatttgatagacaacagttgcttctcttttcaaagatcacagccattgaggaatccaccatatttctgtagcaggaagaatgtttatctctgtgtcttgtctttctggttaaaggtatttacttccatcacactacctgacttcaaactatattacaaggctacagtaacaaaaacagcatggtactggtaccaaaacagatatatagacmagtggaacataacagaggcctcagaaacaacaccacacatctacaaccatctgatctttgacaaacctgacaaacaccagaaatagggaaaggattcccaattatataaatggtgttgggaaaactggctagccatatgcagaaagctgaaactggatcccttccttacaccttgtacaaaaattgactcaagatgggttaaagacttaaacataagacctgaaaccataaaaaccctagaagaaaacctaggcaataccattcaggacataggcatgggcaaagacttcatgactaaaa

SEQ ID NO: 122826 - DNA, 601 bp, Human
cagtatttttagctatttgatagacaacagttgcttctcttttcaaagatcacagccattgaggaatccaccatatttctgtagcaggaagaatgtttatctctgtgtcttgtctttctggttaaaggtatttacttccatcacactacctgacttcaaactatattacaaggctacagtaacaaaaacagcatggtactggtaccaaaacagatatatagaccagtggaacataacagaggcctcagaaacaacaccacacatctacaaccatctgatctttgacaaacctgacaaacamcagaaatagggaaaggattcccaattatataaatggtgttgggaaaactggctagccatatgcagaaagctgaaactggatcccttccttacaccttgtacaaaaattgactcaagatgggttaaagacttaaacataagacctgaaaccataaaaaccctagaagaaaacctaggcaataccattcaggacataggcatgggcaaagacttcatgactaaaacaccaaaagcaatggcaacaaaagcccaaatagacaaatgggatctaattaaactaaagagcttctgaacagtaaaa

SEQ ID NO: 122827 - DNA, 601 bp, Human
gcagtctactttattcttattgctttgtcacaaaaacacacagcccatgtaaattcacctctgatttctaacactgtgatgctcacattaagcaaaggatcaaagcaactgggtaccaggtaagtaatcctgttctgagaactcatggtcataaaaggtctcagtcaactagaagcctgctgagggtggcccctagtctttcccacctggaggaacaaaggtccttttagattccagtcctggaggccctgagccacccccaagtgagtggaggtatgcgtatatgtgtaagggcggcccrtgccacccataggtgaggtctggacatagctcagctgacacagatttgggagccaggggcttgctgagctgtgaacaccccatcttccccaaactacagctcatctccagcttctagtttccctgcaaccccacttcttttgtacccaaataattctcatgtcctgttgacttgctccctccctggtggatcaaacctggctggtttgctgggccttggaattaccttcgggatctttccatccctgagaggttgggctcctcataggccgccagcctgactcggaggaccgtctactac

SEQ ID NO: 122828 - DNA, 601 bp, Human
ccacccccaagtgagtggaggtatgcgtatatgtgtaagggcggcccgtgccacccataggtgaggtctggacatagctcagctgacacagatttgggagccaggggcttgctgagctgtgaacaccccatcttccccaaactacagctcatctccagcttctagtttccctgcaaccccacttcttttgtacccaaataattctcatgtcctgttgacttgctccctccctggtggatcaaacctggctggtttgctgggccttggaattaccttcgggatctttccatccctgagaggytgggctcctcataggccgccagcctgactcggaggaccgtctactaccctctcctgcggacaggcccgcccatggctgccccatgaccatgcttgccctgtcccttggcttcgtgtgggtcagcttgttctgccaccttgctaggctggttcctggagcttctatctgttgtggcctgggttgccacgctctccctggtcacctgtgtgcccggaccctgtgtccctcactggagcactctgagctaggccgcctcagctcttccttacctgctcctcttactgtggggatcctgcttcc

SEQ ID NO: 122829 - DNA, 601 bp, Human
gtttgctgggccttggaattaccttcgggatctttccatccctgagaggttgggctcctcataggccgccagcctgactcggaggaccgtctactaccctctcctgcggacaggcccgcccatggctgccccatgaccatgcttgccctgtcccttggcttcgtgtgggtcagcttgttctgccaccttgctaggctggttcctggagcttctatctgttgtggcctgggttgccacgctctccctggtcacctgtgtgcccggaccctgtgtccctcactggagcactctgagctaggcygcctcagctcttccttacctgctcctcttactgtggggatcctgcttccaggtctgcccttggcggctgctctgtactctgtacagacaccctgttggatgggaggcatgtcatggcctgtccccatgctaggctttcatttttactttgtaacctacttttatcaaacgtctgtggttgcttaaaagtcaataatatatttggagatggggtgagatggattgttttaaaccttaccttcataagataaaacaatgttgaaagttaactgtgagcctttggcgtcctatactgcagagg

SEQ ID NO: 122830 - DNA, 601 bp, Human
ttggatgggaggcatgtcatggcctgtccccatgctaggctttcatttttactttgtaacctacttttatcaaacgtctgtggttgcttaaaagtcaataatatatttggagatggggtgagatggattgttttaaaccttaccttcataagataaaacaatgttgaaagttaactgtgagcctttggcgtcctatactgcagaggagaagggcagaaggggatgacctgtcctgtttaatgtggcatacaaaacctgaatctgggatccagaggtttccaccctccctccactgccacargggggaaaaaggacttaataaacaccaaagactttgccccacaatatgatggtcaagaaatcggctgggagtcaaatcgcagttctgcctcttagtaattggtagcaaaatgatggtctcccaaaatgtgcacatctgaattcctggaacccatgaatatgacaccttacatggcaagaggggctttgcagatgtgattaagttaaggatcatgagatagggggattattctacattatctggacatcccccaatgtaatcaccagtgtccttatatatgaaagatggagacaggagagc

SEQ ID NO: 122831 - DNA, 601 bp, Human
ctatgctctgggctttgaagatagaagaaggggccatgagccaaggaacgtaggtagcttccagaagctggaaaaggtggggaaacattccttctctagagcctccagaatgcagccctgctgataccttgattctggcctagtgagacctgtttcagacttctgacctccaaaaatgaaagtaaatttgtgttgctttaagacagtaagtttatggtaatttgctacggcatccataggaaactagtacagcaactatagctccttagttcagatacttttctaggtttgttccctcatytgcagcctaggaattgtaattgtccctgcaccaggtggctgctgtgaagacgggacagtgcaaagcaagtcaagagtatggggtactttctgtgatacaacgtgggctcagttcatggtagccatggctgttagtgcctccttgaatccctgcaagtgaccgacaaggttactgttattattcccattttacagacgtggttctgggaagttaaaatcttgcctgggcccagtgtgaacagcagaactaggaccttgtgccctggcaacctgactcgtcagctcccacctcccttccttg

SEQ ID NO: 122832 - DNA, 601 bp, Human
aagaaggggccatgagccaaggaacgtaggtagcttccagaagctggaaaaggtggggaaacattccttctctagagcctccagaatgcagccctgctgataccttgattctggcctagtgagacctgtttcagacttctgacctccaaaaatgaaagtaaatttgtgttgctttaagacagtaagtttatggtaatttgctacggcatccataggaaactagtacagcaactatagctccttagttcagatacttttctaggtttgttccctcatctgcagcctaggaattgtaattgtycctgcaccaggtggctgctgtgaagacgggacagtgcaaagcaagtcaagagtatggggtactttctgtgatacaacgtgggctcagttcatggtagccatggctgttagtgcctccttgaatccctgcaagtgaccgacaaggttactgttattattcccattttacagacgtggttctgggaagttaaaatcttgcctgggcccagtgtgaacagcagaactaggaccttgtgccctggcaacctgactcgtcagctcccacctcccttccttgacaaaatgcaagtgtagtggaaat

SEQ ID NO: 122833 - DNA, 601 bp, Human
ctctagagcctccagaatgcagccctgctgataccttgattctggcctagtgagacctgtttcagacttctgacctccaaaaatgaaagtaaatttgtgttgctttaagacagtaagtttatggtaatttgctacggcatccataggaaactagtacagcaactatagctccttagttcagatacttttctaggtttgttccctcatctgcagcctaggaattgtaattgtccctgcaccaggtggctgctgtgaagacgggacagtgcaaagcaagtcaagagtatggggtactttctgygatacaacgtgggctcagttcatggtagccatggctgttagtgcctccttgaatccctgcaagtgaccgacaaggttactgttattattcccattttacagacgtggttctgggaagttaaaatcttgcctgggcccagtgtgaacagcagaactaggaccttgtgccctggcaacctgactcgtcagctcccacctcccttccttgacaaaatgcaagtgtagtggaaatttttaaagtgaagtttaagtggtgaacaagggacattagacttgaatcctaacaagaacactgtgacca

SEQ ID NO: 122834 - DNA, 601 bp, Human
caccactcactgctgtaggtattgggcatatctcagtgaacaaaatagagtctctgcattcattggagttcacattttattggaggagagataaacatatatgtaggtggatgtgtatatgtgtgagatagcaagtgaaccagggtaaggagctagagattgataaggagtgtcattttagatgaagtgtttaggggtagctctcagattgggtatgaatgaaggaaggaggaaggcatgtgattgtcttggggaagagtctgacagagatgccagcaggtgcaaatgccctggggcaggrcagtgcttggcacagctgggtcagggcagtgtgactggtgcctctctagatggacagagagagaaggaagagatgaggtcagattcctagggcctggatcatgtagggctctgttggctatggttggagttaggattttattttgacttgggaagccattggaacgtttgggaaaaggagacacactgtctaatttaagttacaaatatgatcgcaaattttaaacagagacctgtggttaaattgggctcacattggcctctggggttgcctggctgctcctgcccaaggctggcggag

SEQ ID NO: 122835 - DNA, 601 bp, Human
atatgatcgcaaattttaaacagagacctgtggttaaattgggctcacattggcctctggggttgcctggctgctcctgcccaaggctggcggaggtttgctgacacttcccaggaaagagtgaagcacagcagacaaaagtagaagcagctcagggcagcaggccaggatcctgccggagctcatcagcagccagagtggaggatgtgctgctgctgctgctgttaataaaagtagctgaagggtttatcagtccttctacccaactttcattattcaaacaatgttgaacttgccactrtgagtttccaaactgtctgacttgtggagagccctgtcttaattagaaggtcctcatcccacttttccttgctgcctgcagagattttccttctgagagtgtttgtagacatgaaattgtgggtgtgcttatttctcccctcacttggatgatcgcccatgctggttcatttgagtcccaacacatttgcacctgctcatagatttttgcattttcaatttgcaggagtagagaaacagggacctaaaaggagtttgtctcatgcactttccacatctcagctttatgtcttacactcgc

SEQ ID NO: 122836 - DNA, 601 bp, Human
ctttccacatctcagctttatgtcttacactcgctattattttttctctgaacctaactgatttgactgtcttgtttgacctctgtctttgattttgggattggaagggcataacatttggccattggttctctattcaatgtaaataaagttgaaggaaagagactatcctctctcacctgctttttcggttcctaaattatatttaaagagagcaaaatattacagtttcctagtaagttaattaaaagattctgaagaaaattggacgcttttcaaaaaggaagtttacagagtttagaattttttcagcatttccatcctcttctcttcccccaacacaaacagacttatacagaggcacacacagacacacgcagagacatgtgtacacagagacatgtgtgcacacaggcacactcacacaaactaataaattagtaaatggaagctttcaagtcagagaatctactccttaagcatacattatcatcaaatgttaatactgattgcgtccaaaaaattccatgtaaaaaacacgtccttgtgctacgtattgaaaggtagggagtgaatatgaaacctggttcccagccaggat

SEQ ID NO: 122837 - DNA, 601 bp, Human
catttggccattggttctctattcaatgtaaataaagttgaaggaaagagactatcctctctcacctgctttttcggttcctaaattatatttaaagagagcaaaatattacagtttcctagtaagttaattaaaagattctgaagaaaattggacgcttttcaaaaaggaagtttacagagtttagaattttttcagcatttccatcctcttctcttcccccaacacaaacagacttatacagaggcacacacagacacacgcagagacatgtgtacacagagacatgtgtgcacacagrcacactcacacaaactaataaattagtaaatggaagctttcaagtcagagaatctactccttaagcatacattatcatcaaatgttaatactgattgcgtccaaaaaattccatgtaaaaaacacgtccttgtgctacgtattgaaaggtagggagtgaatatgaaacctggttcccagccaggattgcagaagggaaaagtactagccaagaagagaaacttctagctccttcctttggatttcaacactcctagaactcaactgaattaaacacaacagtttggttcagcaaatattt

SEQ ID NO: 122838 - DNA, 601 bp, Human
agccaagaagagaaacttctagctccttcctttggatttcaacactcctagaactcaactgaattaaacacaacagtttggttcagcaaatatttattagtcagttgtgcactgtgtgcaggttacagtgctagctctcagggtttaactaggatggatgaatacccttcccagcctcttgagaaggtgctgaaactaaagggagaattaaaaacgaaaaataaaaataagttcaaagtcctcattcttcttcttcttcttttttttttttttttgagaaggagtctctctctgtcacccygggtgaagtgcagtggcacgatctcagctcactgcaacctccacctctcaagttcaagcaattctcctccctcagcctcctgagtaactgggattacaggcacgctccaccatgcccagctaattttggtattttttaggagaggcagggtttccccgtgctggccagactggtcttgaacttctgacttcaggtgatctgcccacctcggcctcccaaagtgctgggattacaggcgtgagccaccgcgcccggcttcatttttaagatgaggtcctttctccgttgtggagacttttc

SEQ ID NO: 122839 - DNA, 601 bp, Human
tagctccttcctttggatttcaacactcctagaactcaactgaattaaacacaacagtttggttcagcaaatatttattagtcagttgtgcactgtgtgcaggttacagtgctagctctcagggtttaactaggatggatgaatacccttcccagcctcttgagaaggtgctgaaactaaagggagaattaaaaacgaaaaataaaaataagttcaaagtcctcattcttcttcttcttcttttttttttttttttgagaaggagtctctctctgtcaccctgggtgaagtgcagtggcaygatctcagctcactgcaacctccacctctcaagttcaagcaattctcctccctcagcctcctgagtaactgggattacaggcacgctccaccatgcccagctaattttggtattttttaggagaggcagggtttccccgtgctggccagactggtcttgaacttctgacttcaggtgatctgcccacctcggcctcccaaagtgctgggattacaggcgtgagccaccgcgcccggcttcatttttaagatgaggtcctttctccgttgtggagacttttccaagtttctagtgggatta

SEQ ID NO: 122840 - DNA, 601 bp, Human
tgaatacccttcccagcctcttgagaaggtgctgaaactaaagggagaattaaaaacgaaaaataaaaataagttcaaagtcctcattcttcttcttcttcttttttttttttttttgagaaggagtctctctctgtcaccctgggtgaagtgcagtggcacgatctcagctcactgcaacctccacctctcaagttcaagcaattctcctccctcagcctcctgagtaactgggattacaggcacgctccaccatgcccagctaattttggtattttttaggagaggcagggtttccccrtgctggccagactggtcttgaacttctgacttcaggtgatctgcccacctcggcctcccaaagtgctgggattacaggcgtgagccaccgcgcccggcttcatttttaagatgaggtcctttctccgttgtggagacttttccaagtttctagtgggattagtgtgaaactggcattgcactgcttgtatttaaatctggcttcccctgtactgcctctgtgcccctttgcctctcagtgcctcggcgtcctcacctgtaaacaaggaaaccaggaacactcctcatagagccaccctgt

SEQ ID NO: 122841 - DNA, 601 bp, Human
ttctttatgaaaatgatttttttcttttttccccttttactttggggagtcaagagactttcttatttcatcttacagaatgttgagttttcaaaatgtccaaaagagaacaaagagaagtgaggtagcccttgtccttaagtcattacccacccctcaacacatttagcatattttctggtaccttcaaaggaatcctatcactttccatctccatattgttcacattccttctcacctgtaatgttctcagcctctgctaatttctcctttccttgaggcaccacgtccctttctctgyaaactttatcccaagtattttaaaacattcatagattttgccctcaatacctgaagcattcatttatgtcattcaaaccatgctgtcccttgcatatggcaacagggttgctcttttgcaattgaagtctaatgccaactggatcggaaagtactggaaagaaagacattgaccaggcacggtggctcacgcctgtaatcctagtactttgggaggctgaggtgggcggatcgcctgaggtcaggagttcgagaccagcctggccaacatggtgaaacactgtctctactaaaaatacaa

SEQ ID NO: 122842 - DNA, 601 bp, Human
ttgagttttcaaaatgtccaaaagagaacaaagagaagtgaggtagcccttgtccttaagtcattacccacccctcaacacatttagcatattttctggtaccttcaaaggaatcctatcactttccatctccatattgttcacattccttctcacctgtaatgttctcagcctctgctaatttctcctttccttgaggcaccacgtccctttctctgtaaactttatcccaagtattttaaaacattcatagattttgccctcaatacctgaagcattcatttatgtcattcaaaccatrctgtcccttgcatatggcaacagggttgctcttttgcaattgaagtctaatgccaactggatcggaaagtactggaaagaaagacattgaccaggcacggtggctcacgcctgtaatcctagtactttgggaggctgaggtgggcggatcgcctgaggtcaggagttcgagaccagcctggccaacatggtgaaacactgtctctactaaaaatacaaaaattagcagtggtggcctatgcctgtaatcccagctactcaggaggctgaggcactagaatcacttgaacctgggagacgg

SEQ ID NO: 122843 - DNA, 601 bp, Human
ttcacattccttctcacctgtaatgttctcagcctctgctaatttctcctttccttgaggcaccacgtccctttctctgtaaactttatcccaagtattttaaaacattcatagattttgccctcaatacctgaagcattcatttatgtcattcaaaccatgctgtcccttgcatatggcaacagggttgctcttttgcaattgaagtctaatgccaactggatcggaaagtactggaaagaaagacattgaccaggcacggtggctcacgcctgtaatcctagtactttgggaggctgargtgggcggatcgcctgaggtcaggagttcgagaccagcctggccaacatggtgaaacactgtctctactaaaaatacaaaaattagcagtggtggcctatgcctgtaatcccagctactcaggaggctgaggcactagaatcacttgaacctgggagacggaggttgcagtgagctgagatcttgccactgcactccggcttgggcaacagagtgagactccatctcaaaaaaaaaacaaaacaaacaaacaaaaaaaacaagacattatctttaacttggttgcaccctcggcaatgaa

SEQ ID NO: 122844 - DNA, 601 bp, Human
tccttgaggcaccacgtccctttctctgtaaactttatcccaagtattttaaaacattcatagattttgccctcaatacctgaagcattcatttatgtcattcaaaccatgctgtcccttgcatatggcaacagggttgctcttttgcaattgaagtctaatgccaactggatcggaaagtactggaaagaaagacattgaccaggcacggtggctcacgcctgtaatcctagtactttgggaggctgaggtgggcggatcgcctgaggtcaggagttcgagaccagcctggccaacatgrtgaaacactgtctctactaaaaatacaaaaattagcagtggtggcctatgcctgtaatcccagctactcaggaggctgaggcactagaatcacttgaacctgggagacggaggttgcagtgagctgagatcttgccactgcactccggcttgggcaacagagtgagactccatctcaaaaaaaaaacaaaacaaacaaacaaaaaaaacaagacattatctttaacttggttgcaccctcggcaatgaataacatggttataagcttcagtttccttctctgaaaataggaataataaca

SEQ ID NO: 122845 - DNA, 601 bp, Human
tcacttgaacctgggagacggaggttgcagtgagctgagatcttgccactgcactccggcttgggcaacagagtgagactccatctcaaaaaaaaaacaaaacaaacaaacaaaaaaaacaagacattatctttaacttggttgcaccctcggcaatgaataacatggttataagcttcagtttccttctctgaaaataggaataataacaaaattaataataatgtttacctatagtgctgttgtattaaatgagctaaaacatagttactggatataatgatctttcaataaatttcarcttttttttttaaatggggtcttgatctcttgcccaggctgttttcaaactcctgggctcaaccaatcctctcacctcagcctccgaaactagctattatttttaatagactaaatcattctggttggttatttatgatttttataattggtggtaataattagactgttttatgtttgcatagaattttgcattacgaaaactttcatgatcagacttagtatagaaaatttagtaaactatttaaaatgtagagaaaaatgtaacattactaccaatcttatccttcagaatcaataa

SEQ ID NO: 122846 - DNA, 601 bp, Human
tataagcttcagtttccttctctgaaaataggaataataacaaaattaataataatgtttacctatagtgctgttgtattaaatgagctaaaacatagttactggatataatgatctttcaataaatttcaacttttttttttaaatggggtcttgatctcttgcccaggctgttttcaaactcctgggctcaaccaatcctctcacctcagcctccgaaactagctattatttttaatagactaaatcattctggttggttatttatgatttttataattggtggtaataattagactgytttatgtttgcatagaattttgcattacgaaaactttcatgatcagacttagtatagaaaatttagtaaactatttaaaatgtagagaaaaatgtaacattactaccaatcttatccttcagaatcaataattttatatattttggtgtattttttcagttcatatattatgaatattgctttctagtttgagttttaaaaatcaaaagttctatgcaaactttatttttgatggttgcatatattccatactatggctaatcatattttatttaaccatacttcacttttgagctattg

SEQ ID NO: 122847 - DNA, 601 bp, Human
tttaaccatacttcacttttgagctattgcactgtttattggttttagttattacatattattacatatatgtaatgttttcatataacccattgtgccttcatcttaaccatttcatcttcctacaaaggatacgacttggagtagaacattcaaatcatgtcattttctattttgtgttcatacgaaaccgtgaactgataccttgaaattactctagatttatctgcacagaactaagcccaggcaaaaagcactatgatggcttctacttaacatgaaagtaggtggttcccatagmcgcttcagataccatctagacatgcttactctttaaagaccagaatgacagcactttgggaggctgaggcaggtggatcacctgggatcaggagttcatgaccagcctggccaacatgacgaaacactgtcttcactaaaaaaacaaaaattagccggacatggtggcaggcgcctgtaatcccagctactcgggaggctgaggcagaagaatcacttgaacccaggaggtggaggttgcagtgagccgagattgtgccactgcactccagcctgggtgacagagtgagactccttctca

SEQ ID NO: 122848 - DNA, 601 bp, Human
cttgatatggtcttagttcagtttaatttttcagtattactttttaactataacaaaagtcctgtgttaaaatggatttttattcctcttttctccatctaaaatgtatccattaaattcaaatgaagtatcaaattgtaaaacattaaattgctcagaacttatgtgagttcttttctatttttcatccacattttagtgtattagagattaagtgaggaggtgctgacaaatcaacggtaataaaaaaaaatcagtaaaccagattttgtggggtgtggagggcatgcagatcaaggckcaaggtggttgagtttttcatgattcaaaagggaccagtaatagtgtagaagtcaattaccagatcatactttgaactgatgttatattgctatattctaataaaatgtcttatctaaatctttatccttttttacttctcatctatccaactattatgaatattttaatatgttgactaaacaaattggtcataatgatatatagagataaccaattttcaaggaattagattttgaatcaacagtaaaagacattggccataaattggaagaaagaagattagcaaataacttgattt

SEQ ID NO: 122849 - DNA, 601 bp, Human
tcaaggcgcaaggtggttgagtttttcatgattcaaaagggaccagtaatagtgtagaagtcaattaccagatcatactttgaactgatgttatattgctatattctaataaaatgtcttatctaaatctttatccttttttacttctcatctatccaactattatgaatattttaatatgttgactaaacaaattggtcataatgatatatagagataaccaattttcaaggaattagattttgaatcaacagtaaaagacattggccataaattggaagaaagaagattagcaaataamttgatttatatatacatatatatatgttttgttaattattatttacagtttcccacataatttaatgtttttggattcaccttaaaatatctcatagtggtatttttttaaaaaaaacgaatattaagttaatggttaatctttcaatcaaagatatcttagaatgaataaataattaagataaacaattaactgcaaaaatagttatctttgagtagtaagactatatatgattttccattttcttctttttgctggtctgtattttttatagtaaacagattatttgtagagtgaaaa

SEQ ID NO: 122850 - DNA, 601 bp, Human
ttcaggattcttaacccaaaggccacaattccttttaattctgggggttggggaacttggtaccacatactttatgttacgtcattttgagaaggggtctggaggcctcacaggagtgccatgatataaaaagtcagaaaccccacctaggtaatcaaagatccagaggtgtctggggatccccacccaacagaacccaagggatggcatgctggcagtcagggtaaggtgccttgaggaaacctgtgaacatctgcacagagaagaaagctggcctccaggcaaggtctaggaaacgctmttcaggtgtgagccagctctctcctgaaacagactttcactgatagccttttcccacatatattcaaccaagtgcacaactttgtctaattacaaggaactactcccaggctgggctgggctttgtacaagtatcaacaggccttatgacaaccctgcaaggcatgtgccactacacccattttacatgatgaagtattgaggccaaagagtaaagttaatttgcccaagggcatcaaaccaatgggtactggagttgaggtgtgaatttggtcctgcctggcttcgttcctcccccttt

SEQ ID NO: 122851 - DNA, 601 bp, Human
atgatcacaggttgttcatttgatctgctagttttctcattttaaaaatggggacaatgcttatttatacaataaggcagtttttagattaaacaatatatgcaaaacacctagaatagtgtctgccacatgacaggtaataattacaaatacttctataaagcttaatatatgctttacttatgtttatattacctcatttaatcctcataacaactaaagtaagcactaccactattctcattttatgagtggggaaactgaggcatagagctattaaatgactcataactgtgaaacyaaaataaaattatcaattcaacttaaaaatgaataccaataaaattccaattcaaaattatttcactgatgttttgctaaactaaacccctggtagcaatacagatgtagtaccgacctccatggctatggcataggttcttcttaagctgagtagttcctgcactgccgtgtgctggatgaggattcaattctctctgcttattttcttttggaagtactgtgaaaccaccatgaagccctctttcctatagtgaactgggaagtaatttggccctaatgtattacatggtgtctgttc

SEQ ID NO: 122852 - DNA, 601 bp, Human
aaaaaaaaaaaaaaaaagtggatggtgatagttgaatattccttatattgttctctactttgtatgtctgaactatttcataatggaaggagggagaggaagttgattgactggtttaaacacacctggattaactccaccgttataatagctgcgcaaccttgggcttcattttctcaagctaaaaatggggataggtagctctctctacccacagaaatattgtgaaggcaagataaggtaagcaaatgccttggcaggaatccagtagctgtcagcttgaagacagaggggacatctmactctatccagcctgctatcagtactctagtaggaaaacccaccaaccagcacctagaacatagctgcagagcaacaaacaaggtaaggacaaaactgagctgattggtcactataaaccttcttttttggggacattaaaatgcactccaaagtaaagcaacagttccacatatggtggtgactgtctaagaaacaaagttcaagccggatgcggtggctcacgcctgtaatcccagcactttgggaggccaaggcgggcagatcacgaggtcaggagatcaagaccatcctggccaac

SEQ ID NO: 122853 - DNA, 601 bp, Human
aggaatagcctctgaatagtatggcctgctgtaaagggcaagctggaagtacagatcctagggtgtctcactgtcatgtagggccaacattttctcgtctcccttctcaacaaattagtctgcctcgaccactttaaaatgcctggttctggctgggcatggtggctcacgcctgtaatcccagcactttcggaggccgaggtgggtggatcacctgaggtcaggagtttgagaccagcctgaccaacatagcgaaaccccgtctctgctaaatttaaaaaaaaaaaaaaaaaaaaaaaaagattagccgggtgtggtggcagatgcctgcaatcccagctacttgggaggctgaggcaggagaattgcttgaaccaggaagcggaggttgcactgagcgaagattgtaccactgcactccagcctgggcgacagagcgagactctgacgaaaagaaaaaagcctggttctgaatggccagcttcctcagatgccttaaccagtacagaaagttgttctgctaagaagacatgttatgtctgccctgccctgagtggtatctaaaaacacaagcgattgattcccctttccccatcatctt

SEQ ID NO: 122854 - DNA, 601 bp, Human
agttcccttcctaccagttgaactgtttgctgagcatgcaggaatagcctctgaatagtatggcctgctgtaaagggcaagctggaagtacagatcctagggtgtctcactgtcatgtagggccaacattttctcgtctcccttctcaacaaattagtctgcctcgaccactttaaaatgcctggttctggctgggcatggtggctcacgcctgtaatcccagcactttcggaggccgaggtgggtggatcacctgaggtcaggagtttgagaccagcctgaccaacatagcgaaaccccrtctctgctaaatttaaaaaaaaaaaaaaaaaaaaaaaaagattagccgggtgtggtggcagatgcctgcaatcccagctacttgggaggctgaggcaggagaattgcttgaaccaggaagcggaggttgcactgagcgaagattgtaccactgcactccagcctgggcgacagagcgagactctgacgaaaagaaaaaagcctggttctgaatggccagcttcctcagatgccttaaccagtacagaaagttgttctgctaagaagacatgttatgtctgccctgccctgagtggtatct

SEQ ID NO: 122855 - DNA, 601 bp, Human
cacgattgtagcataaatagctgtgtctgtgactcgtacaactgcatgcacggaacttttgccgtaaccacaacaaacgcccatccagatggctccggcttaagtttctatgcttcactaaccccaaggcccactagtgcagccagcagttgggttttcctctttggcaagtcagtcaggccatacagaatctgctacaagttcccttcctaccagttgaactgtttgctgagcatgcaggaatagcctctgaatagtatggcctgctgtaaagggcaagctggaagtacagatcctaggrtgtctcactgtcatgtagggccaacattttctcgtctcccttctcaacaaattagtctgcctcgaccactttaaaatgcctggttctggctgggcatggtggctcacgcctgtaatcccagcactttcggaggccgaggtgggtggatcacctgaggtcaggagtttgagaccagcctgaccaacatagcgaaaccccgtctctgctaaatttaaaaaaaaaaaaaaaaaaaaaaaaagattagccgggtgtggtggcagatgcctgcaatcccagctacttgggaggctgaggcaggag

SEQ ID NO: 122856 - DNA, 601 bp, Human
tttcattacatgtttaattaattgtaacaacactaaattcttaacgtttaacatatataagctataacacgctttctagggaacaaagtgtgttgccctgcaagaacaagttttatatttgtttgctgaaattacacgattgtagcataaatagctgtgtctgtgactcgtacaactgcatgcacggaacttttgccgtaaccacaacaaacgcccatccagatggctccggcttaagtttctatgcttcactaaccccaaggcccactagtgcagccagcagttgggttttcctctttgrcaagtcagtcaggccatacagaatctgctacaagttcccttcctaccagttgaactgtttgctgagcatgcaggaatagcctctgaatagtatggcctgctgtaaagggcaagctggaagtacagatcctagggtgtctcactgtcatgtagggccaacattttctcgtctcccttctcaacaaattagtctgcctcgaccactttaaaatgcctggttctggctgggcatggtggctcacgcctgtaatcccagcactttcggaggccgaggtgggtggatcacctgaggtcaggagtt

SEQ ID NO: 122857 - DNA, 601 bp, Human
tcacactgcacctcttctgcgtggtacacggtcctcccacaggccccacacttgtttccacctccccagacaggcattctgaaggaataaaggattcattagaatgtccctgtgctggtcgtacggctccctagagggctatttaagcccagggacagctgcagattttcgtttctttatgaacctctctaaccacatctttcaaaggcctgcgttcctccaaaataacctcatctcctctcccaaataacaactctttcattaggaaactggcttgtcgtgcacaagattttttttttttcctgccagacaaaggacctgcattcagtacaatagtacaggtcaccaggcacaaaacaagctatgccattagaatccacaggagttaagaaagaagcgtggggaggggaaaggcaagccttgtccccctccctaatatgcccatttttaataaacatatttttttgaactcagctgaagatcttacccttgggtggaggttttcattacatgtttaattaattgtaacaacactaaattcttaacgtttaacatatataagctataacacgctttctagggaacaaagtgtgttgccctg

SEQ ID NO: 122858 - DNA, 601 bp, Human
taatgaagtgctttaagttgctactctacagttttaaaaccgaagactttgttgtcattaaagggaacctgagaaagagaaagctggggtggatgaggagcaatcatttactcaaaaatgggagctaagcccttgtaatgtgccagaaactgtgctaggtgccagaccacataagtgacacccagcactcagtgaggtgggggaggcagatgtgttaacaaaataaaggccaaaatggaggccaaaagctatggggacacaaagggaggctgggtgtcttgggccacccctcctgtcttcrctgctaggcttggcatttacaacatctaagaagacaggtaaaaaccattcgtgctttcaaaatgatctttgttggcaaaaccacaatttttccttaaatagacatattgaagctctgtacatacaaattccgtcaaaggtggagcatggagagctacttactgcagagaaagcagcagcggtggaagctcctgccatcacactgcacctcttctgcgtggtacacggtcctcccacaggccccacacttgtttccacctccccagacaggcattctgaaggaataaaggattcattagaa

SEQ ID NO: 122859 - DNA, 601 bp, Human
tcattaaagaaaattctgtcattaaatcagaagatgattaatgaagtgctttaagttgctactctacagttttaaaaccgaagactttgttgtcattaaagggaacctgagaaagagaaagctggggtggatgaggagcaatcatttactcaaaaatgggagctaagcccttgtaatgtgccagaaactgtgctaggtgccagaccacataagtgacacccagcactcagtgaggtgggggaggcagatgtgttaacaaaataaaggccaaaatggaggccaaaagctatggggacacaamgggaggctgggtgtcttgggccacccctcctgtcttcgctgctaggcttggcatttacaacatctaagaagacaggtaaaaaccattcgtgctttcaaaatgatctttgttggcaaaaccacaatttttccttaaatagacatattgaagctctgtacatacaaattccgtcaaaggtggagcatggagagctacttactgcagagaaagcagcagcggtggaagctcctgccatcacactgcacctcttctgcgtggtacacggtcctcccacaggccccacacttgtttccacctccc

SEQ ID NO: 122860 - DNA, 601 bp, Human
aagcagtttagttatgctattaaagaggtccagataccttgaatgctggctccaatgagggaaaaggacaattcaaatttgagaaagaagtcttttcctgaagattatttctcaatgtaacctatttttaacctatggttttctgtaggaattttccctgtacaatactattgataaggcaaacatctgcccgtatgggtgggtttacctgacataatcattcattaaagaaaattctgtcattaaatcagaagatgattaatgaagtgctttaagttgctactctacagttttaaaaccraagactttgttgtcattaaagggaacctgagaaagagaaagctggggtggatgaggagcaatcatttactcaaaaatgggagctaagcccttgtaatgtgccagaaactgtgctaggtgccagaccacataagtgacacccagcactcagtgaggtgggggaggcagatgtgttaacaaaataaaggccaaaatggaggccaaaagctatggggacacaaagggaggctgggtgtcttgggccacccctcctgtcttcgctgctaggcttggcatttacaacatctaagaagacaggtaa

SEQ ID NO: 122861 - DNA, 601 bp, Human
catgtgcctaaagataactatatcttaaaccatagttaacctaacaccatgcactgctgaaggacaactacccttaacagagagaataaatgtaaatactgttttgaaaaacctgtatgaaccaaaacaagtgtaggtatatgaaagtgttactatataaccacccctttcttccccagtcctcatgctgttctctgcagtaaaattctcataggtctgcaaactactctgaattatttccttaaaaggcattagtcagcagagacagatattagaaaggattcgtagaaatgaccagtaragaacttgacatttagtaaaacaaatgtcaacagcatacacgcatatgttactatggtgtagacattgtggcttaacctagacagatgaaactgagagcaatttctaaagtatttgcattctgtttccatactttcttggttacaagcctgctgaaaaatagattccttttttaaaaaagtaacttctaaaagcaatggttaaaccaagtcttctgaggaaggcatacatagtgaacattcctatgtagtatttttatttttttgtaactgcaactttctgttgtctgcttctggttgtc

SEQ ID NO: 122862 - DNA, 601 bp, Human
aaatggcatctactctggaatctaactgttgaggctcaagtgctgaaatacatgtgcctaaagataactatatcttaaaccatagttaacctaacaccatgcactgctgaaggacaactacccttaacagagagaataaatgtaaatactgttttgaaaaacctgtatgaaccaaaacaagtgtaggtatatgaaagtgttactatataaccacccctttcttccccagtcctcatgctgttctctgcagtaaaattctcataggtctgcaaactactctgaattatttccttaaaaggcwttagtcagcagagacagatattagaaaggattcgtagaaatgaccagtagagaacttgacatttagtaaaacaaatgtcaacagcatacacgcatatgttactatggtgtagacattgtggcttaacctagacagatgaaactgagagcaatttctaaagtatttgcattctgtttccatactttcttggttacaagcctgctgaaaaatagattccttttttaaaaaagtaacttctaaaagcaatggttaaaccaagtcttctgaggaaggcatacatagtgaacattcctatgtagt

SEQ ID NO: 122863 - DNA, 601 bp, Human
aaatcacaacctaatacagaacagaagggaagctcagtgccttcggggacttgcctctgtagcctttcctcccccaaaagcacctcctgggataataatagttttaaatcctgaattctagttttcatcactagtctagactgggaagtatcacactttcctctccccagcagcttctccagcagtgatgagtctgcctgaaaatcgtcaagtgctttaaagtctgcatttgttttcccttctgtcccaaaggagaatgcattctttcttgatggatctcttgccacaggacatttccacrtgtcccacttcataaaactgccaaatgtcatcgagtttcatccagacattatttcattttctaaaacttcaattaagcttgagaaaaaagtaaattgtgaggaaactcactggtagcacaatctggcagctggaaatcaaagatcagaatttcttccccttatttaaaagacaattgtatgatgattcagagtagaatgatggttaccagaagctcggaagggtagggtgtcgggaaggaagtgaggagagttaatgggtgtaaaaatatagttagaatgaataagatctagtatttgat

SEQ ID NO: 122864 - DNA, 601 bp, Human
tatttacattcctccatggatatgacagttgcttcagaaatgtatcagaatataacatccagaagcctcaagctttatttttagtttgtttcgtttattttttattccctttcctgtggtgctgatcaaactcttactatgatttccctttctgggagatcatattaagggagaaaagtttcaaaggtggctataaaaatgcttaaacaaaaggaataaaacaccaccttgctcccaaccctcaacactcttaatcttttcagccttctcttaaccaagtactgttaaatcacaacctaayacagaacagaagggaagctcagtgccttcggggacttgcctctgtagcctttcctcccccaaaagcacctcctgggataataatagttttaaatcctgaattctagttttcatcactagtctagactgggaagtatcacactttcctctccccagcagcttctccagcagtgatgagtctgcctgaaaatcgtcaagtgctttaaagtctgcatttgttttcccttctgtcccaaaggagaatgcattctttcttgatggatctcttgccacaggacatttccacgtgtcccacttcata

SEQ ID NO: 122865 - DNA, 601 bp, Human
tatgaaatactaagtgaactttcacaaatttagcaccttgatacgttggcaacaaagcctttaaagtttaacactactctctcaaagaatcaaaaataagaagtaatttccatttttaagtaaaaaattttaagttagagaaaagtgatttcttgatgaaaaatgtttacatagaaggagtgacttaggaattttcattggctgcttacattgcacatgagaaacacctctcatgattcacacagcacatttctctaccatttaatttcatgacatccggtctccaaggtgctgtgaaatkgaagtaaatacaaatcacttgcttttgagaacacgactccttgatacagcttggaatgctataaagccagaagtagaaatcactggaattattaataagaactttgttaggtccaaaactcaatattttgaactagttgacattagaaaatcagagtcccattttatttgcttagtttcaactaaaaatctggagactgccaggttcctgttcagcaagcggcactaactgtcgcaactcatttctgaaggtaaccaacggtctcccaactcacctctctggtttgatgcccagcctctc

SEQ ID NO: 122866 - DNA, 601 bp, Human
ccggtgtggtggtgcacgcctgtaatcccagctactcaggaggctgagacaagagaatcacttgaacctgggaggcagaggttgcagtgagccgagattgtgccagtgcactccagcttgggtgacagagtgagattctgtgacaaaaaagaaaaaaaaaagtgtgtggggggaattctaaacaaataagttatttaacctgaatatgaaatactaagtgaactttcacaaatttagcaccttgatacgttggcaacaaagcctttaaagtttaacactactctctcaaagaatcaaaaayaagaagtaatttccatttttaagtaaaaaattttaagttagagaaaagtgatttcttgatgaaaaatgtttacatagaaggagtgacttaggaattttcattggctgcttacattgcacatgagaaacacctctcatgattcacacagcacatttctctaccatttaatttcatgacatccggtctccaaggtgctgtgaaattgaagtaaatacaaatcacttgcttttgagaacacgactccttgatacagcttggaatgctataaagccagaagtagaaatcactggaattattaat

SEQ ID NO: 122867 - DNA, 601 bp, Human
atggatgtgaaaatgtgaagttcaaatagtggaatcactgggttaaaagtaggagttaggaggaaattccaggttgggcacggtggctcatgcctgttattccatgcactttgggaggccgagataagtagatcacttgaggccaggagttcaggaccagcctggccaatatggtgagaccccgcctctaccaaaaatacaaaaattagcccggtgtggtggtgcacgcctgtaatcccagctactcaggaggctgagacaagagaatcacttgaacctgggaggcagaggttgcagtgarccgagattgtgccagtgcactccagcttgggtgacagagtgagattctgtgacaaaaaagaaaaaaaaaagtgtgtggggggaattctaaacaaataagttatttaacctgaatatgaaatactaagtgaactttcacaaatttagcaccttgatacgttggcaacaaagcctttaaagtttaacactactctctcaaagaatcaaaaataagaagtaatttccatttttaagtaaaaaattttaagttagagaaaagtgatttcttgatgaaaaatgtttacatagaaggagtgactta

SEQ ID NO: 122868 - DNA, 601 bp, Human
aagaacacagaggtgagcctcaatgtagtacatactgcagtaggaagagaacagattttggaaccaaatggacattgattcaaatcctggctccctcacttatttgtgtgacccgactcttagtgtcgtcatctataaatggacaaagtatacctcagagttactctaaggattatacagaatgaagataaatgttcaacagacaacagggactcaatacatggtaattattattttagccaagccaagcaccacgtttcattcaggtcataaggtttggagttagactaggttaagttcyaggctctacaattaactaacagtgtgactttgggcaaagtttttacttaatttttcttgtcttcatctgttctgaagaaagagaggaagccctatgttgtaggactgttgtgaggattacacgagttaacatatgctaatgctgcacggtggctggcatggtttatggtcttgtccaaaggccattttgttggactattacaccaattttggacttctcaatataaaatggatgtgaaaatgtgaagttcaaatagtggaatcactgggttaaaagtaggagttaggaggaaattccagg

SEQ ID NO: 122869 - DNA, 601 bp, Human
gggatatggattttgaaaggttttcaacaaaacctttaaaacacaaaaatagatgtaacaagatggaaaaggagagcagaacaagtaaaataaattttaacaaagataaaaaggtaagctgggcatcatggcccagaaactctgagggtggaagaagctcaaagaacacagaggtgagcctcaatgtagtacatactgcagtaggaagagaacagattttggaaccaaatggacattgattcaaatcctggctccctcacttatttgtgtgacccgactcttagtgtcgtcatctataaayggacaaagtatacctcagagttactctaaggattatacagaatgaagataaatgttcaacagacaacagggactcaatacatggtaattattattttagccaagccaagcaccacgtttcattcaggtcataaggtttggagttagactaggttaagttccaggctctacaattaactaacagtgtgactttgggcaaagtttttacttaatttttcttgtcttcatctgttctgaagaaagagaggaagccctatgttgtaggactgttgtgaggattacacgagttaacatatgctaa

SEQ ID NO: 122870 - DNA, 601 bp, Human
aaaaaagtaggcaagagtttccacagggcccttttaagtacacaaggcaggaacaatagaactctgggacttaaccgctacactgcctcaaagctggaagcctttgcaggccagcacaggggagggaataaagaagaagtgactcaggtgccagccagagttactacttgaacctatctatgggctcattattatttcaaaaaaccagatagggacccaaacgtaaagatctgtccctctgagtctaaacagaattcatttactcctcagtgttggcctctccactaagcaattatgttayggtttataaaaacttaccagagcatatatttttactccagaataatatcactggaatcatacctagctttttacttcacaggagtcggaaaaaccactattaagtagtttaaaaattccacaaataggtaagttaactttggtctgtaactaagaaatttaagcatgttttatagattacttagtctcccagtatatcttgaataaaggaaagtgtgaatagccaactttcttcatggaaaaatattttataaattttgattattactatgcaatctgtttatctttcatttttctctgg

SEQ ID NO: 122871 - DNA, 601 bp, Human
aaaggataactactcttgtgatattgtagattaagggattcattgtcagtccatagagtctaaatggtgtgtccagctcctacaaaaaacatcaaagaattgaaatgagatacatgttttctcatagctactcagtgacttcttgctgtgttttgtcttgggtatagatgaatgcttaaggctgtctttccttaatattcaaagagctaccttcaaaaaatccataacgtgttctcacctacttttctactaactaagatttttttaggtggatttgagcaatatgtcatttgtagttttttatatatacacacacacacacacacacacacacacacacacatacacacatatataaaatatgacagacatcagcaatcatcagaacctgggtaacaaaattggaaattttttcacagtagttattaacccaaaaccatcaggtcagcattttgaatctacacagcctagcatctatctcttactgggttctgagaagtaaaacattaattaatgtatttaaaacaggttaactcactttatttttctggtataaaaccaccacatggtggccatagctagagcttgggtcctctacatg

SEQ ID NO: 122872 - DNA, 601 bp, Human
actactcttgtgatattgtagattaagggattcattgtcagtccatagagtctaaatggtgtgtccagctcctacaaaaaacatcaaagaattgaaatgagatacatgttttctcatagctactcagtgacttcttgctgtgttttgtcttgggtatagatgaatgcttaaggctgtctttccttaatattcaaagagctaccttcaaaaaatccataacgtgttctcacctacttttctactaactaagatttttttaggtggatttgagcaatatgtcatttgtagttttatatatatccacacacacacacacacacacacacacacacacatacacacatatataaaatatgacagacatcagcaatcatcagaacctgggtaacaaaattggaaattttttcacagtagttattaacccaaaaccatcaggtcagcattttgaatctacacagcctagcatctatctcttactgggttctgagaagtaaaacattaattaatgtatttaaaacaggttaactcactttatttttctggtataaaaccaccacatggtggccatagctagagcttgggtcctctacatggagagtct

SEQ ID NO: 122873 - DNA, 601 bp, Human; identical to SEQ ID NO: 19142

SEQ ID NO: 122874 - DNA, 601 bp, Human; identical to SEQ ID NO: 19141

SEQ ID NO: 122875 - DNA, 601 bp, Human; identical to SEQ ID NO: 19140

SEQ ID NO: 122876 - DNA, 601 bp, Human; identical to SEQ ID NO: 19139

SEQ ID NO: 122877 - DNA, 601 bp, Human; identical to SEQ ID NO: 19138

SEQ ID NO: 122878 - DNA, 601 bp, Human; identical to SEQ ID NO: 19137

SEQ ID NO: 122879 - DNA, 601 bp, Human; identical to SEQ ID NO: 19136

SEQ ID NO: 122880 - DNA, 601 bp, Human; identical to SEQ ID NO: 19135

SEQ ID NO: 122881 - DNA, 601 bp, Human; identical to SEQ ID NO: 19134

SEQ ID NO: 122882 - DNA, 601 bp, Human; identical to SEQ ID NO: 19133

SEQ ID NO: 122883 - DNA, 601 bp, Human
gaatgtccacactaatgcgccatgcaaggctgggaatggagctcaaaggaaaccccctctaactccacagagatcccctcaccgatccatgtggtccctcgaaaccgggcaagggcggctcagctggccgggtggaaccccagtgcccgagaacagcgaggcggctccagcggagggccaggccccaggcgccccagctgggtccccacgcgggtgggtcccgcgaatcccgtgctgacgctctcgagatccaaccacccgagcgcacgcacggacgctcagcggcgcgggggctcggggrtcctgaccacaccgcgttcttaccagatctgatggagttgtgaggcatcgccggggagtcgctcgcagcccgccgagggctcggggcttcctcccgtaggtccgggccgcgcctgccgctgccctgcacaaacccaggagaagggcatgagatgcgatgagattcgatgcctgcatcctcaggccccctccccaggcctcatcctttacacctgcatcgtctgccaggagtaggaggatttttaggcgaagtagggccaacctcagcctagcctagctaacaggcttcccgggaggatca

SEQ ID NO: 122884 - DNA, 601 bp, Human
ccgcactcgctgcgcgccgggacggctgcacccaccagccctgaccctggagctccttcccagcaaagaccctgcccagccctggccgggaagggggaaaacaggcatcgcggcctgggagctcgagtgtgtttgaaggccctgcttccgggcgcaggtggggagggggttttgactccgcgagcggcttagtcctcaccagccggacgccccgcgcgcggcgcccggcctgcccggtgctgggccaggaggagtcggagagcacctgagtgcgctgccggctcccgggcccgggaccacyggctccattgccgttggcttgagagatgcggggagctcacagtccagccaggggagtcactgggaaggactgcgcgcacccgaggaagaggacttagaggtcggggacggggaaacggcaagtccagcaccggtgcagcccagggacagagcacgaagaatgtccacactaatgcgccatgcaaggctgggaatggagctcaaaggaaaccccctctaactccacagagatcccctcaccgatccatgtggtccctcgaaaccgggcaagggcggctcagctggccgggtggaaccccag

SEQ ID NO: 122885 - DNA, 601 bp, Human
tgcgccgcagagcccgggcccccgcagtgcgcttggctaaatagagatctcagcctcgctgcgcgcccgatccgaccctccttattataacaaatgtcccgtttgcagagcgggacatcatattcgcggagaattcattctgaaatattgatttcctctcacttcgccggcccaaatcgatagcgatgcgccctggccccataaatcgccttctctgcggccggccgggctccatccatcactgcgggccgcgctgcgcctccgccgctgtccgcactcgctgcgcgccgggacggctgcrcccaccagccctgaccctggagctccttcccagcaaagaccctgcccagccctggccgggaagggggaaaacaggcatcgcggcctgggagctcgagtgtgtttgaaggccctgcttccgggcgcaggtggggagggggttttgactccgcgagcggcttagtcctcaccagccggacgccccgcgcgcggcgcccggcctgcccggtgctgggccaggaggagtcggagagcacctgagtgcgctgccggctcccgggcccgggaccaccggctccattgccgttggcttgagagatgc

SEQ ID NO: 122886 - DNA, 601 bp, Human
cagggctccccaaccccgccgcgccggggaatggctgcgaggtctctcccctgaggaccttgaagggaccccgcgccttctgggggcagccggacgattctggcccaggtctctgaggggaatgggggccgggagggagcattcgtctgcagctctagagagaacccgagtgagaaatcttccggcgccccagggggttcccgctcccctcctagttgggccatggccctgggactggagactgcgccgcagagcccgggcccccgcagtgcgcttggctaaatagagatctcagcctcgytgcgcgcccgatccgaccctccttattataacaaatgtcccgtttgcagagcgggacatcatattcgcggagaattcattctgaaatattgatttcctctcacttcgccggcccaaatcgatagcgatgcgccctggccccataaatcgccttctctgcggccggccgggctccatccatcactgcgggccgcgctgcgcctccgccgctgtccgcactcgctgcgcgccgggacggctgcacccaccagccctgaccctggagctccttcccagcaaagaccctgcccagccctggccg

SEQ ID NO: 122887 - DNA, 601 bp, Human
gaccgtaaagaggtgccagggagctctgctcggtcccagggctccccaaccccgccgcgccggggaatggctgcgaggtctctcccctgaggaccttgaagggaccccgcgccttctgggggcagccggacgattctggcccaggtctctgaggggaatgggggccgggagggagcattcgtctgcagctctagagagaacccgagtgagaaatcttccggcgccccagggggttcccgctcccctcctagttgggccatggccctgggactggagactgcgccgcagagcccgggccccygcagtgcgcttggctaaatagagatctcagcctcgctgcgcgcccgatccgaccctccttattataacaaatgtcccgtttgcagagcgggacatcatattcgcggagaattcattctgaaatattgatttcctctcacttcgccggcccaaatcgatagcgatgcgccctggccccataaatcgccttctctgcggccggccgggctccatccatcactgcgggccgcgctgcgcctccgccgctgtccgcactcgctgcgcgccgggacggctgcacccaccagccctgaccctggag

SEQ ID NO: 122888 - DNA, 601 bp, Human
ccagcttggcgcagaagtgccattgcaccagcttggcatgggcaccgggcactgcacattaggcctcagggatggtcctggcgatgtctggtatcgtaccacggtttggctaaagattaagggactaaaacctgatcctgaccttagatagtggcctaggagcgctcgtggttccaggacgcggaccgtaaagaggtgccagggagctctgctcggtcccagggctccccaaccccgccgcgccggggaatggctgcgaggtctctcccctgaggaccttgaagggaccccgcgccttctrggggcagccggacgattctggcccaggtctctgaggggaatgggggccgggagggagcattcgtctgcagctctagagagaacccgagtgagaaatcttccggcgccccagggggttcccgctcccctcctagttgggccatggccctgggactggagactgcgccgcagagcccgggcccccgcagtgcgcttggctaaatagagatctcagcctcgctgcgcgcccgatccgaccctccttattataacaaatgtcccgtttgcagagcgggacatcatattcgcggagaattcattc

SEQ ID NO: 122889 - DNA, 601 bp, Human
ccaccgccggaagggtcaggggaaggttaggaggaaagatggacctccagagccgagcagaagtgccattgcaccagcttggcgcagaagtgccattgcaccagcttggcatgggcaccgggcactgcacattaggcctcagggatggtcctggcgatgtctggtatcgtaccacggtttggctaaagattaagggactaaaacctgatcctgaccttagatagtggcctaggagcgctcgtggttccaggacgcggaccgtaaagaggtgccagggagctctgctcggtcccagggctcsccaaccccgccgcgccggggaatggctgcgaggtctctcccctgaggaccttgaagggaccccgcgccttctgggggcagccggacgattctggcccaggtctctgaggggaatgggggccgggagggagcattcgtctgcagctctagagagaacccgagtgagaaatcttccggcgccccagggggttcccgctcccctcctagttgggccatggccctgggactggagactgcgccgcagagcccgggcccccgcagtgcgcttggctaaatagagatctcagcctcgctgcgcgcc

SEQ ID NO: 122890 - DNA, 601 bp, Human
gaatttgatttccgagagcactcactcctcctgccaccgccggaagggtcaggggaaggttaggaggaaagatggacctccagagccgagcagaagtgccattgcaccagcttggcgcagaagtgccattgcaccagcttggcatgggcaccgggcactgcacattaggcctcagggatggtcctggcgatgtctggtatcgtaccacggtttggctaaagattaagggactaaaacctgatcctgaccttagatagtggcctaggagcgctcgtggttccaggacgcggaccgtaaagargtgccagggagctctgctcggtcccagggctccccaaccccgccgcgccggggaatggctgcgaggtctctcccctgaggaccttgaagggaccccgcgccttctgggggcagccggacgattctggcccaggtctctgaggggaatgggggccgggagggagcattcgtctgcagctctagagagaacccgagtgagaaatcttccggcgccccagggggttcccgctcccctcctagttgggccatggccctgggactggagactgcgccgcagagcccgggcccccgcagtgcgctt

SEQ ID NO: 122891 - DNA, 601 bp, Human
aaaatgaatacctataaaatgcatctcaataaattagagatttgaggccataaatagaacgttttgacgtattatattagtagatgccctctaatttaaaccaaagtgtcccttaataattaaaattccatgagattgattttttatttggtttccttcacttcctttgtcttcttcaacaaaattaggcagagtccttttgggggtagactgataaaattaattaactttccttccacccccaaaaagttccaaataaatgcttccaatagacatcaaaaaagtgtcaattagaaataaytacttcttatcaatcagtggggcaattaaagtgacaaagcttaaaaagatacttatcttaaaactaattcacaaggtagctaaattatctcctaattaacttgcattgtggagggtgggggggaaccatcttgaaacaaagatgaattgatgaaccccaatacctctttatgttcctcaaagttgcttccatcccctgaaaccttattttcaacccaggcaggaaacctgggaagaaaacagatcctttccaaatgcatttattccactttcctcaattctaaaaccaagagttaggaat

SEQ ID NO: 122892 - DNA, 601 bp, Human
tcagcaccacaccacacctgtggcagtcctcagagagaagaatcacagctttcattcattgagagctcactaagtgccaggtatgctcagctcttgtgcagacgttctttttctttggatgtaaatgtgacatgggcagagcaggaggagctgtgaggctggcttggctgagccacagggattgctggcatcttatatggcattcaggactatggagggtccacgggaagaaacacagaaacagaacccaagtatccttcggggactcttggactttcttccccttgatcttagacatgcytcagtaaacagatgctggtttctatcgagactcattcctggggaaggacccccaccagccaagcaaggtaaagcccagactcagttacatgaattacaggtttaagacagaagccttcctatgaatatttttctggccagtggcttatataagagaaatttgctcattgtatttctatctggccaacgaaggggtctagaggggctttcagcaacccaaacagtcttgtcagccctaactctggacctaaggaaataattatgaatcctcaagatccatttaaaagtgtcattactgtag

SEQ ID NO: 122893 - DNA, 601 bp, Human
ggcagctatgtgccaggtgaggagacaggttttactcacatgactccccagaagccctgcagcatccccatattttataaaggggaagtacaagcccagagagacatctgacttgactaagttcacacaaaaacagcaaggtctgggccaagatggaagcccgggctttgccttcttcttctgcctgcagggcaggggctttcatcctggcttcacgctgatttcaaaagcctctcattctcttgacacctcatggcccctgagtttatcccaagaataataagttctactgtcctcctgkagatgccgaagaatcaaaactgcaacacacagagggcctgggtgtgcgcgaacactgtagtacacaccgatgacagcagattaagccatttctctcttaggtgcgtcacccaaccagctcctggacccttctgctgtgctgccctgacagtcacaatatgtcctagtggactaattagcactaactacccatgtcaccccaaggccatttaagaagacaaataaaaaagacaaaaccaatgagtattgtggctgaagatgacgaaaaaaagttaaaagcagggaggaatgaattattttt

SEQ ID NO: 122894 - DNA, 601 bp, Human
tcatttaatcccagtactcctaggtggtagatctattattttgtccacatgaattattgaaaagtctgtcctaaattttaaatggaacgaagtactgggttgcaagttactggtggctgtttcacaggaaatactacgacaatgggactttgggaatgtgttctggagactccactccttggtgactactacatggagcacagaaaattgtcttgagtggcagctatgtgccaggtgaggagacaggttttactcacatgactccccagaagccctgcagcatccccatattttataaagrggaagtacaagcccagagagacatctgacttgactaagttcacacaaaaacagcaaggtctgggccaagatggaagcccgggctttgccttcttcttctgcctgcagggcaggggctttcatcctggcttcacgctgatttcaaaagcctctcattctcttgacacctcatggcccctgagtttatcccaagaataataagttctactgtcctcctggagatgccgaagaatcaaaactgcaacacacagagggcctgggtgtgcgcgaacactgtagtacacaccgatgacagcagatt

SEQ ID NO: 122895 - DNA, 601 bp, Human
agatttggtgctcagctaatcacagagacttttaaatgtcaaccagggtttgctatcaggccaaagctggattattattacccaaagtagaaaattgtgagacagaggcaggtggggagggagggagagagaagaaagcagaaggtggaggatacgtggatttaattttttaaaaataaatatatgattccgtgtcaattaaaaacaagtaccccaggcaagtcttcctgcagtcctgtcttagccacacacacagcataactgcaaacccacttgagctcatttttgctcaaagaccaaytctattaaacccttagaatgttctggatttcaacacacagtccacagacagccattctatcaaaagcttagtgttttccctatgactgggttttctggtaaggtgaactaaggcatccttttccatttcaggctgtggtaacagcagataacagccgcagaggtcatagccagcactttctatgcgtcccttcatttaatcccagtactcctaggtggtagatctattattttgtccacatgaattattgaaaagtctgtcctaaattttaaatggaacgaagtactgggttgcaagtta

SEQ ID NO: 122896 - DNA, 601 bp, Human
gccttctaccttgctcagtgttgaagcaaaggagcaaagcaaagcttaagtcagagatttggtgctcagctaatcacagagacttttaaatgtcaaccagggtttgctatcaggccaaagctggattattattacccaaagtagaaaattgtgagacagaggcaggtggggagggagggagagagaagaaagcagaaggtggaggatacgtggatttaattttttaaaaataaatatatgattccgtgtcaattaaaaacaagtaccccaggcaagtcttcctgcagtcctgtcttagccrcacacacagcataactgcaaacccacttgagctcatttttgctcaaagaccaattctattaaacccttagaatgttctggatttcaacacacagtccacagacagccattctatcaaaagcttagtgttttccctatgactgggttttctggtaaggtgaactaaggcatccttttccatttcaggctgtggtaacagcagataacagccgcagaggtcatagccagcactttctatgcgtcccttcatttaatcccagtactcctaggtggtagatctattattttgtccacatgaatt

SEQ ID NO: 122897 - DNA, 601 bp, Human
accacaggttgcaagaacagggaggtcacatgtcagtgacctcatgcctaaatagatgcatagcacagagcagattcctggatagcttacaccctactttccccagtgcatcgattatgacttcctttctagcaactgtgagtacagccgggactcatcaatcacacctgtaacttcccagctgcatttctcagggtctctgaaagcagggccttctctggtctttttaaattacccacagacctaggacagtcttctgcacatacttctacattttaaaggcttacttttagtatgtttwtgtgtgtgagatggggaatattgtattcatgtgtgcatgtatatgtctgtgagtactgtggtctgtgtgtgtaactgggtatgactgtgtgtgtcatatggatacaggggactagaatgaggacagccaggtgtccaggctataagatctaaggaggcacttgctctcagggccaaccctgcccttgcgtgagcctgagagagagagcctcctggaattttgcaccttgagtgccttcctgcttcaccctaatccccccggttgtctgtatgtttggatgtgagtgttgtacatatgctg

SEQ ID NO: 122898 - DNA, 601 bp, Human
atgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggctgatcaaatgtacaaaatatgcatgatggcaccatattgtgtataatagtgacaaatacagtctatgtgggtggagaaacaagctcggkgttgtgcatgcggctgtggtttgtgttcacacttctcctttagagtgtagtagacagaacatgcctgaactgcctggggctgaggggtctcaggcgcagagtggcccaggaattctgagcaaggacagaatgttagagagaatatcctgagctgagcagagaggcctgcccatgctagctggcagccacctgccttcagtgcttcattcttgggggaccttgaggccagttcttgagtggatgagtcctgccgctactgctgctgcccacttggtagctctgtcctcatctgggaagagc

SEQ ID NO: 122899 - DNA, 601 bp, Human
ttctcggattgtacatcagcagtttgcctgaaaatggcttgttaatgattggattaaaaggaagtgcaaggagaaatctgattattttggaaaatcaccaggctaagtttgtctgaaacagagccaagagaggagagaaaccagaacattttgaaaaagtgaataacctagctatcacagattattgccatggcttttccacttaataaaatcaccgcaaaacctgaagacaacagcgtcagtaggtatgcagctgtggcaagagagccaagaaggatatgaaaactgccaacaacagaarcgtgaggccaagccaggggaggatggaagtttcatgcacaagtgaataaaatgccctaaaacgtatacatcgagtgcactttacccagacgttctgatggcacattggaattaacaccatagcttagcttctcttgtcaacccctgcagttgggctgaaccctgaccatgttcccattgctgtctccttccctcagggctgactgctggtgcctggaacctgcacaccctcctgggactctgcatctctgctggggctggtttctcctctgagccaccttaaggaatcccaccctgaccc

SEQ ID NO: 122900 - DNA, 601 bp, Human
gggaaggaggtggagcttgactgaggctttgtcaagggagtgggagtgggaagggtgttccaggtagctgcattgaatgggcagagacacagaggtgagaatgtacatggtgtattttggaaacaatgactagctggctggaacatgggtttgcatacggaaatagtgggaaataggccacggaggtaggagaaagtcttctcggattgtacatcagcagtttgcctgaaaatggcttgttaatgattggattaaaaggaagtgcaaggagaaatctgattattttggaaaatcaccaggytaagtttgtctgaaacagagccaagagaggagagaaaccagaacattttgaaaaagtgaataacctagctatcacagattattgccatggcttttccacttaataaaatcaccgcaaaacctgaagacaacagcgtcagtaggtatgcagctgtggcaagagagccaagaaggatatgaaaactgccaacaacagaagcgtgaggccaagccaggggaggatggaagtttcatgcacaagtgaataaaatgccctaaaacgtatacatcgagtgcactttacccagacgttctgatggca

SEQ ID NO: 122901 - DNA, 601 bp, Human
gctgctctcctagggtaactggctgcccctccagttccctccaaatgactcttaagtgtaaggcaggttcagtcagtcaagtagagggtaaaatcctttctaatagcttaccctcttttggtgaaaacctgtttctcttgacattactatacttgctaccatcttgttcatcatcttgttctccatttgtgatccttgcatcatgtggcaatgtttttttttgttttgttttgttttttttcagtgaaagaacatcagtgtatcagcacagcaaatattccaaatgccaggctggattccytccaattaccaggacctccaggcttctcctcctttcaagaactttctgaccctggatccagtctaaatgttggttataaactcacctgacatccacagggcccttccaaaatactgtcaagtaagtgattcttaaatttagttcaacaaacaccagttgttggacttggttgcatccaggattagttttcacaacaatcccatgaggtaggtggggctggcactttgccccattttatagataaagatgccatctcggaggctcaaatggcatgtgcacagccagttaggggcagacctg

SEQ ID NO: 122902 - DNA, 601 bp, Human
atcaacagagttttagagctttagccctgaatttcacacagcaggcttgggcagcccctggaggctgctctcctagggtaactggctgcccctccagttccctccaaatgactcttaagtgtaaggcaggttcagtcagtcaagtagagggtaaaatcctttctaatagcttaccctcttttggtgaaaacctgtttctcttgacattactatacttgctaccatcttgttcatcatcttgttctccatttgtgatccttgcatcatgtggcaatgtttttttttgttttgttttgttttktttcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaagtaagtgattcttaaatttagttcaacaaacaccagttgttggacttggttgcatccaggattagttttcacaacaatcccatgaggtaggtggggctggcactttgccccatttta

SEQ ID NO: 122903 - DNA, 601 bp, Human
gctagcaaacgcatgcacagatcaacagagttttagagctttagccctgaatttcacacagcaggcttgggcagcccctggaggctgctctcctagggtaactggctgcccctccagttccctccaaatgactcttaagtgtaaggcaggttcagtcagtcaagtagagggtaaaatcctttctaatagcttaccctcttttggtgaaaacctgtttctcttgacattactatacttgctaccatcttgttcatcatcttgttctccatttgtgatccttgcatcatgtggcaatgttttkttttgttttgttttgttttttttcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaagtaagtgattcttaaatttagttcaacaaacaccagttgttggacttggttgcatccaggattagttttcacaacaatcccatgaggtaggtggggc

SEQ ID NO: 122904 - DNA, 601 bp, Human
tgggctcaagcaatcttctggcctcagcctcccaaagtgctgggattacaggtgtgagccaccatgactcgccttttctaagtgttgaacctggacttcaggctctctttgggggattctggcttgggagggggagtccccttctctgttggagcaataggaaaggttctggaggatggatgtcaccttccccttctttttctgtcagctccaaatcagagcttctgcagcggtgttgctcagacccaaagcagctgagagtcaagtcagggctgggtggggactgaaacggactaaggasacacaatacttaggtgttatgaattgaatagtctctcccctgtctccacccaccaccctagcaccttggaaacaaggtctttgcagatgatctagttaaggtgaggtcattagggtgggcctaatccaatatgatcaagtccttgtgaaaaggggagatttggatacagagataaagtgagaaagccatatgaatatcagagttatgctgtcacaagccaaggaatgccaaagacttctagcaaaccaccaggagctacgagagaggcacagaacagattctcctccagcctcagaagga

SEQ ID NO: 122905 - DNA, 601 bp, Human
ttcttaagtgttttttattttttgtagagaggtgattttgctatgatgctcaggctggtcttgaactcctgggctcaagcaatcttctggcctcagcctcccaaagtgctgggattacaggtgtgagccaccatgactcgccttttctaagtgttgaacctggacttcaggctctctttgggggattctggcttgggagggggagtccccttctctgttggagcaataggaaaggttctggaggatggatgtcaccttccccttctttttctgtcagctccaaatcagagcttctgcagcsgtgttgctcagacccaaagcagctgagagtcaagtcagggctgggtggggactgaaacggactaaggagacacaatacttaggtgttatgaattgaatagtctctcccctgtctccacccaccaccctagcaccttggaaacaaggtctttgcagatgatctagttaaggtgaggtcattagggtgggcctaatccaatatgatcaagtccttgtgaaaaggggagatttggatacagagataaagtgagaaagccatatgaatatcagagttatgctgtcacaagccaaggaatgccaa

SEQ ID NO: 122906 - DNA, 601 bp, Human
gccagtctgtgcctcagttttttcatctggcttgacagaagcagatgatccttccagtcctaatgtctacaactctgggactgccctcagccggggaacagaggccagaaacccccagaagctggtacagagagagctctagagggaaacattgagtaaccttcctatgtgacaaaacaccaggggtgacactgggcgtgccataagatgagggaaggtagcacacagtggggcctatgggctgccacatgacttgcatggtgacaaagtgggctgccacggcttacagactatgaaggtkgatgtgcacagtgtctgtggagtggcagagttgcaaggcacacttctgagaggatccttgaccaggaaggagaggtgagctgtctaatgtcacagattcacctcatggcagaaccaagaaagaacctcagcgttctgacctaaatccctgtcttagccctttgggagcttagtggcttcttggctggggccatgttggtagagtggaggaagaaagtgaggtttgcgcagaacatgtcctgaagcaaggcatgccctgaaagattttaggtttttttttttttttagacagagtttcact

SEQ ID NO: 122907 - DNA, 601 bp, Human
gaattaggaggcctaggttctgcccactctgtgacgatgccagtctgtgcctcagttttttcatctggcttgacagaagcagatgatccttccagtcctaatgtctacaactctgggactgccctcagccggggaacagaggccagaaacccccagaagctggtacagagagagctctagagggaaacattgagtaaccttcctatgtgacaaaacaccaggggtgacactgggcgtgccataagatgagggaaggtagcacacagtggggcctatgggctgccacatgacttgcatggtracaaagtgggctgccacggcttacagactatgaaggttgatgtgcacagtgtctgtggagtggcagagttgcaaggcacacttctgagaggatccttgaccaggaaggagaggtgagctgtctaatgtcacagattcacctcatggcagaaccaagaaagaacctcagcgttctgacctaaatccctgtcttagccctttgggagcttagtggcttcttggctggggccatgttggtagagtggaggaagaaagtgaggtttgcgcagaacatgtcctgaagcaaggcatgccctgaaag

SEQ ID NO: 122908 - DNA, 601 bp, Human
cccctgctgagggcaggaaaccatgagagtaggggtaggtagggaggatggggagaagggggaataggaaggaaataacagctgtagctggggtgactgcagagactgagaagccagaggaactagggaatattgaatataatgaagtcacataaagatgcctccctcacccggacagttgaactaaatgacctctaagtttcttttgaaggccgagattctttgcttctgagatcttaactaggatacaacctgatgggcttgactagctcatggaggaggcatttgtaaagggtgggckttagcctgaattagggcacgtttagagagagagagagagtgactgttttgtgtgtgtgtgtgtgtgtgtatgtgtgtgactgtgtgtgtgagttgcagagtcttcagggtgggggacagaaggagggcctggccatcctggggaccataacaggtaagaacaaatgaaggggaaccgcctttttgagggacacacaggagcaaaatctgtgacaaaaccgtgcatctgttgtttccacacctgtcgatagcaggcaccatggcgaaggagattatccactctaaaagctgccctcactgc

SEQ ID NO: 122909 - DNA, 601 bp, Human
gaacccctgctgagggcaggaaaccatgagagtaggggtaggtagggaggatggggagaagggggaataggaaggaaataacagctgtagctggggtgactgcagagactgagaagccagaggaactagggaatattgaatataatgaagtcacataaagatgcctccctcacccggacagttgaactaaatgacctctaagtttcttttgaaggccgagattctttgcttctgagatcttaactaggatacaacctgatgggcttgactagctcatggaggaggcatttgtaaagggtgrgcgttagcctgaattagggcacgtttagagagagagagagagtgactgttttgtgtgtgtgtgtgtgtgtgtatgtgtgtgactgtgtgtgtgagttgcagagtcttcagggtgggggacagaaggagggcctggccatcctggggaccataacaggtaagaacaaatgaaggggaaccgcctttttgagggacacacaggagcaaaatctgtgacaaaaccgtgcatctgttgtttccacacctgtcgatagcaggcaccatggcgaaggagattatccactctaaaagctgccctcac

SEQ ID NO: 122910 - DNA, 601 bp, Human
aatactataaatgtgagtttagtgggcactgatttaaaaatcactcagagatgggtaaggagggaaatagagggatggtgagaagaacccctgctgagggcaggaaaccatgagagtaggggtaggtagggaggatggggagaagggggaataggaaggaaataacagctgtagctggggtgactgcagagactgagaagccagaggaactagggaatattgaatataatgaagtcacataaagatgcctccctcacccggacagttgaactaaatgacctctaagtttcttttgaaggcygagattctttgcttctgagatcttaactaggatacaacctgatgggcttgactagctcatggaggaggcatttgtaaagggtgggcgttagcctgaattagggcacgtttagagagagagagagagtgactgttttgtgtgtgtgtgtgtgtgtgtatgtgtgtgactgtgtgtgtgagttgcagagtcttcagggtgggggacagaaggagggcctggccatcctggggaccataacaggtaagaacaaatgaaggggaaccgcctttttgagggacacacaggagcaaaatctgtgac

SEQ ID NO: 122911 - DNA, 601 bp, Human
agcaattttcagtacattagatttcaattcagtgagcacctactctgtgtctaataatattccaggctgtgtgtatgtggggtgatggtttctgagtagaagacagtccttgcccttgagaaacttacaagttaatagtccctgacatattatagaaccttaaagattttcaacacatttacatgcacagtctccttcaattctgtccacaagtagctccgtggaatatctgtggaggtgtgtatatgggtgtctgtgtgaatgtgtgtatgaatgagtgggtgtgggggtgtgtgctcaygtgtgagtatgtgtgtgtgttggggatggggatggatagtaaaggacataaagtactggtaggttctacagctcaaagttataatactataaatgtgagtttagtgggcactgatttaaaaatcactcagagatgggtaaggagggaaatagagggatggtgagaagaacccctgctgagggcaggaaaccatgagagtaggggtaggtagggaggatggggagaagggggaataggaaggaaataacagctgtagctggggtgactgcagagactgagaagccagaggaactagggaat

SEQ ID NO: 122912 - DNA, 601 bp, Human
cccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcaggtcagttcagtcagaatcttttggcatagcatccctgaatctgtatttttaaaaatctcctctgttgatagcctagagtttatatctactctgtggatgtcaacaaacacttatcgaaagcattaattgatgaaacatgaacttctagtcaggggctgcaaatggagcttcccagtgctccctgcaggtttactagaggtcattcttcccagatccttcccactgagcttcctagacacttgcagactcctggcatcgcacaccagggctgtggaagggccctctgggctgcagaaggaaggtccagggtctctgcgtttggggagggaaacaggcaaggcaggtatggcagcacctgccgaacacgcgtttagatgcttagcgactgtacaagttactgcactacaccctcaactccccct

SEQ ID NO: 122913 - DNA, 601 bp, Human
tgggccaagctgagtattttaaatgcatcttttcaattaattcttataataaccctttgagaaatgaagtacattatcattttattgatgagaagatgaggaacagattcggcatgtaacaggttcaaggctccacctttacaaagtggcattactgagactcaagctgagagctctcagatgccatagtgaatgctctgcactgcttacttttgcccacccacctccggcgccacccctggcagcagcactgtattccaggaatagccagaccccgccctaagagcgaatatgtcctttsgtcacctaccaagtatgggtgctttccaaaacacacttccaagtcctctccagcttttcattttcttggggcctaatttttcctttttaaattttctccagtcagagagggcacctaattcctttatttccctttactcttgtgtactggctggttgtcctccattctctttgtttacatccatcgctgcctcctttcttcccagtctttccggctctgggtttgcatccctgccctcagtgtctcccagtttccttgctttcttttatttccctcctgattgctgcctccccagttctt

SEQ ID NO: 122914 - DNA, 601 bp, Human
catgaatttctgtcacttctttctgtctttccttctaagtgtgccaagtgatctaaataacatggtgcacgtgcagcacctgacacaggacctgggcttcagtagaccgtccacaaatgttagccattaccctcaccactgagacccaccatttccataacaggcactgttccaggttctggggacatagggggatgaagaaagatgggtctctgccctcttggaggttatggttttatgggaagattctttttgtaatgatttcaagttaattaacttatttattagcaaatggcaaagmtcccccacccctatctgcccctcttcttgcctggattgatttctcttctctctcttctaaaatccttagtaatgataaaagggcagggttctgggatgcctggaggggtaggaaataatcccagctccttctttccccttctagtgcccatgactaggctgttaccgattgactcctagcttgttattgttgctgtgtgctggtctttggggctctgtttccctggtggggtgtctatgctctttaatgcatcccaggaggatcctaagatgtgaggccatgaggaccaacgccagctcc

SEQ ID NO: 122915 - DNA, 601 bp, Human
tggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatatatgtgtgtgtatatatatatatatgtgtgtgtgtgtgtgtgtgtgtrtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatctaaataacatggtgcacgtgcagcacctgacacaggacctgggcttcagtagaccgtccacaaatgttagccattacc

SEQ ID NO: 122916 - DNA, 601 bp, Human
aagagcctgtggagctggggattggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatatatgtgtgtgtatatatatatatatrtgtgtgtgtgtgtgtgtgtgtgtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatctaaataacatggtgcacgtgcagcacctgacacaggacctgggcttcagtagaccg

SEQ ID NO: 122917 - DNA, 601 bp, Human
ggaagagcctgtggagctggggattggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatatatgtgtgtgtatatatatatatrtgtgtgtgtgtgtgtgtgtgtgtgtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatctaaataacatggtgcacgtgcagcacctgacacaggacctgggcttcagtagac

SEQ ID NO: 122918 - DNA, 601 bp, Human
aggaagagcctgtggagctggggattggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatatatgtgtgtgtatatatatatagatgtgtgtgtgtgtgtgtgtgtgtgtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatctaaataacatggtgcacgtgcagcacctgacacaggacctgggcttcagtaga

SEQ ID NO: 122919 - DNA, 601 bp, Human
tacatgtttagaggaagagcctgtggagctggggattggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatatatgtgtgtgtrtatatatatatatgtgtgtgtgtgtgtgtgtgtgtgtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatctaaataacatggtgcacgtgcagcacctgacacaggacctgg

SEQ ID NO: 122920 - DNA, 601 bp, Human
ctacatgtttagaggaagagcctgtggagctggggattggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatatatgtgtgtgtatatatatatatatgtgtgtgtgtgtgtgtgtgtgtgtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatctaaataacatggtgcacgtgcagcacctgacacaggacctg

SEQ ID NO: 122921 - DNA, 601 bp, Human
tatcagagctacatgtttagaggaagagcctgtggagctggggattggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatataggtgtgtgtatatatatatatatgtgtgtgtgtgtgtgtgtgtgtgtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatctaaataacatggtgcacgtgcagcacctgacac

SEQ ID NO: 122922 - DNA, 601 bp, Human
agcctggaggaatcaaagggaagaaactggagttatcagagctacatgtttagaggaagagcctgtggagctggggattggatctccgaagggctggctcatcccagctattgctgggggcatgtgaggctggctctgggagagctgagagctggaatctgattcaactactgctgctgaggtattggctgacaagagccacatacaacaacaagaagaaagtccttccactatcctttaaacttctactacttgccgggtggcccatttatcagtccctcatatattctattattctatatatatatacatattccatatatggaatatatatgtgtgtgtatatatatatatatgtgtgtgtgtgtgtgtgtgtgtgtatatatatatatagaataacacccaaactgagaggtagctttcaaatctgtcctcttgccctgatgagtgggtgaggttcatgtattcatttatttccattccttaaagctatatggaggagagagtcagaaacccctgcttcacctctgactaacttattactttggcatgaatttctgtcacttctttctgtctttccttctaagtgtgccaagtgatc

SEQ ID NO: 122923 - DNA, 601 bp, Human
ttttcttctaacctgggccatagagactctatggagaatgatgggaggtgatctacacagactcctccctcactgggttgatagctctgttgggaagatgttaacatccatcaggggaaaaaaccacgagagacagctcaagctagggaggcagagggttagcagcaaatgctaccccttctgagaactcagacattccagactcagagaccccatgagaagtttctgactcaggactgtgtaggcagtgctgcatgcatatgcctgccagggctcaatcagtaaaaaaaaaaaaaaaaatttctccagttctcattgtcaaggagctcagtactgtgttcaaggccaaggacatgatcaatccagtcttaaaatctggtttcctcagatctcttctggtatcagccagggcttggtcagaggacagaaaccttcctaggtatttcaacaaaggggctttaatatggggaattgttgtctggtgttggagggctgtaagagcacaaaggaaacactgaaatagcccagagatagtagctacaggaagcaaccactgctcctcagcctggaggaatcaaagggaagaaactggagttatcag

SEQ ID NO: 122924 - DNA, 601 bp, Human
acaatgcctaccactacctgaccctgacttagtgttcaagcctcatttcttacctgtctgagccttgaacctgatgccctaacaacacagaattgcttgccattctttcgctgcatctgaatcctctcctgggtccttgactgtgtcctccatgcctggagtgcccgtcctcaccttctccagattgatttccattcatgccttaggagtcggttcaggaagctccctcctacagaaagtcttccctggctttccctgcctgctctctttggtcctttcttttaaataagccaggacatartctcagtaagcagaatataagtgcctgttggttattgaaaggaaagaacaaaggaaagaagggaagaaggaaggaaggaagggaaggaggaaggaaggaaggacagaaagaaggaaggaaggaaaaaagaaggaaggagggagagaggaatagagggaaggaggaaggaaggaaggaaggaaagaaggaaggaagaaaaaaagaaggaaggagggacagaggaatagagggaaggagagagggaaggagggaggggaggagggaggggaggagggaggggaggagggagggaggagggag

SEQ ID NO: 122925 - DNA, 601 bp, Human
taaacatgtcacatgaatcaactaatagcctttatctttttccattctctgcatatggaatactcacaagaccacgttttacctcctaaatatttacctaaccaataccttcctgtctgtccccagcattcaaatattcctgcattcatttatccattctacatgtattttatatgcctaccatgtggcaaacattttaatagaactgattacatagaattgatttctaccttcatgaagctttcaggctagggataggtaggctggggatgggtatatatttaaaaagtaaatacagaamtaaatgtgtaattactacttggaataagtgctaagaagaacacaacagggtgtaatggggtgggggtgcaagagagaatgagctcaagctgattaggaagatgtctctaaatgacatgtaacctgagtggaaggtgagtaggagttaactactcacctggactcattggtctccacatccaaccttgctcaagtgaacctttgctacccagctcgggagcaacacatctaaatcctagtctggccatatcactcccatatttaagaatccttgcaaggcatggcatcattttcttcatgg

SEQ ID NO: 122926 - DNA, 601 bp, Human
ccatgatactcttctttcctattgttttcaactaaatttctcaaaaagcagctatacttgcagcccattcctcccttcacattcggtgctcagcctgctctgtgcctcctgcttagcatgtgcttggtgatgagtggccatggatggacagtgagtggttggagggtgccatgttctccctcttgaagagattttagtgacaatcccatctcctgattccttataccttcagtctaggctttttgctttgctttaatggggttctgttcccttatttgctccatgacatatgttttctccyttcaggcttctcttagttctcagtgtttctctcccccttcaaggccatccttggtgatcctacacacccttattgtcatacctactacccatctcatgatggcatcatgggcatcccaggtaaccccagtcaggtccttcccccaacttttgttttcaatttctattggagatttcctcttaggtgataagggggctcctcctctagtgttgtcttggttggtaacaataccagctgtcatgcaagctcagggcctgccccttccactcaacctcctgccacctgccaccacactctctg

SEQ ID NO: 122927 - DNA, 601 bp, Human
gtttctcattgatctcttgcccttctacctgtgctggaatcctactccgtcaattatcctcccatttaaaaacattacttacctcttcttttataccaggtccttcccctaaacgtacaaatggaattaaattaatctatgttgcctctccaccccctgacctcaaaatacattaaacaaaaaaaattcttcccttgaccatgatactcttctttcctattgttttcaactaaatttctcaaaaagcagctatacttgcagcccattcctcccttcacattcggtgctcagcctgctctgygcctcctgcttagcatgtgcttggtgatgagtggccatggatggacagtgagtggttggagggtgccatgttctccctcttgaagagattttagtgacaatcccatctcctgattccttataccttcagtctaggctttttgctttgctttaatggggttctgttcccttatttgctccatgacatatgttttctcccttcaggcttctcttagttctcagtgtttctctcccccttcaaggccatccttggtgatcctacacacccttattgtcatacctactacccatctcatgatgg

SEQ ID NO: 122928 - DNA, 601 bp, Human
ttgtccatgcgaatcagtccctggcattctcagcttggtgttgttgccttccccagctgctcacttgcaggtctgtgatctccatgtgccacctcccagctaatcctcttggcttggtgcctttctggagtaaaggccagggtctgtgcctccaactgctcctgaagaaagtgtcccagggccatggaatcccagtgtccaaagtctgcacactggatcatgccagcacacatgaggttatgggttacctggacacatgagacccttggactgggtaaaagaggctggcatgctggaaagcagcatcctgcatctgctgttacccccaacttgctgcatgacccttggttacctctgtgccttacacttgtcttcctaagggaaactgtagccgaaagacagcagctaggcaaagctgcggcttgtgtttctcattgatctcttgcccttctacctgtgctggaatcctactccgtcaattatcctcccatttaaaaacattacttacctcttcttttataccaggtccttcccctaaacgtacaaatggaattaaattaatctatgttgcctctccaccccctgacctcaaaatacatta

SEQ ID NO: 122929 - DNA, 601 bp, Human
cccatagagtgtcaaggtgatagctgagccttggcagggctatagtgagaggtgcagtggcctctttgggtgcctttcaaatcatgccaggcctatacgccttccacaaaggaaaggccttgtccatgcgaatcagtccctggcattctcagcttggtgttgttgccttccccagctgctcacttgcaggtctgtgatctccatgtgccacctcccagctaatcctcttggcttggtgcctttctggagtaaaggccagggtctgtgcctccaactgctcctgaagaaagtgtcccagggycatggaatcccagtgtccaaagtctgcacactggatcatgccagcacacatgaggttatgggttacctggacacatgagacccttggactgggtaaaagaggctggcatgctggaaagcagcatcctgcatctgctgttacccccaacttgctgcatgacccttggttacctctgtgccttacacttgtcttcctaagggaaactgtagccgaaagacagcagctaggcaaagctgcggcttgtgtttctcattgatctcttgcccttctacctgtgctggaatcctactccgtcaatta

SEQ ID NO: 122930 - DNA, 601 bp, Human
gtgagtggggaggtggggtgggtatgggggaggaagacaagaccgcctggccggatgcaagcaggttcctgagtgaaaggtactcagacgggaaatgcaagctttcctggggtcagagaggacttatcgtacagtaaagggattggagctcagcaaaggtctaggtgaagcttgctgtccagaaacatatccttttgaaaagtgaccattcagggaggtcttaggactttgttggtaatttcttcatcctttatagagctctgagtagttgggatggcagaaagaaaacagagacacttaytgaccaaaattcttgttatatgcaccaatatccaaacccttaagatgtggaaatcctttctccatgttcctatagtcctttgcacaaattcctatcatagcactgactgcattgaacagtaactttctctatttgagtttctttatgagttactcaaaggcaggggccctgtctttgtctactgtaattagtgttttcttatatacaagtgatagaaaaatggtttacattggttatggttgttgcatggattcccatgattctgcatggtgggacccccaaatcccatgcttcagtact

SEQ ID NO: 122931 - DNA, 601 bp, Human
ttgtttgtatattatggttttcatttcttttcaactcaagacattgaccaagtgcctatcatgactcaggtacaaagcactgggaatacaaccttgaacaagacaagaatcctggccttcaaggaacttcgaaccttttgggggatatgataagacacattaggaatcaccatgttaatggttatctttcttgaaggatataagtccaggtgcttggggagacccgtaagtggttagagggaagctgcaaggaagagtatctaggaggtaactaggtgaagaattttcttcagggggaaaraaatccatgcataaagtcttggtgccttcaagaaattgaaagacatttagtgtggctgtaggacaggcaggaaagagaatttggaaagagcctgctggctgcagatggagatggcccctatggtttgaagttttaagctgagtctctgcaatggaaagacctttgtctttcctgtgtccggtgtgggggagtggactcttctgggtgagtcaccaccaaatgcccagaggtgggtgcagacttccttcctgcactggggttggggggacgattggcgcccactgtgctgaccacctcttc

SEQ ID NO: 122932 - DNA, 601 bp, Human
aaggactgactcgcatccttagaaacccaaaccctcaggaagccacctgagaggttatttaccgttatcagcaagcattgtagtgctgggaaagatgcattcacatttctggcccctaaacggtgaattctctggtgcttattttatttgactgtcttctgaatgactttgtgttactgtggaaagagtcttgggcctgatcccttctttgacactgcctgttttagtcttatcatttgagaaagtgggtttttttttcaaccttagtgtttttatctatcgaatggagcttaacaaaacytatgcctgctgctgacttaaacccctataagaagataggggggctgggtgtggtggctcacgcctgtaatcccagcactttgggaggccgaggtgggtggatcacgaggtcaggagatccagaccatcctggctaacatggtgaaaccccgtctctactaaaaataccaaaaattagccgggcatggtggcagacgcctgtagtcccagctactcaggaggctgaggcaggagaatggcatgaacccgcaaggcagagcttgcagtgagccaagatcacaccactgcactccagcctggg

SEQ ID NO: 122933 - DNA, 601 bp, Human
agccatttgccctcactgcatcattgttgccttccggctcttttgggtccaggcactgaacacaagggggcgccagacagccacccaaacacagacaagaccttcagcagtccagctttgtcctcattttccagaagtttccgggccgtatccacccaaacctaggtgtttaggctgggacctctatatctgaaagcaaggtttcttagaggtggaggttcttcacctctacaaatgtgaagcaggtttaaaaaaaatgccattctggggtggcatgaattgggtattgtgcctttttttwaaaaaaagaaaacgacgctgtaagttgtgtgggacattgctcttaattattatgaaggactgactcgcatccttagaaacccaaaccctcaggaagccacctgagaggttatttaccgttatcagcaagcattgtagtgctgggaaagatgcattcacatttctggcccctaaacggtgaattctctggtgcttattttatttgactgtcttctgaatgactttgtgttactgtggaaagagtcttgggcctgatcccttctttgacactgcctgttttagtcttatcatttgagaaagt

SEQ ID NO: 122934 - DNA, 601 bp, Human
cttgggcagagaaggcctgagctctgtctgtggacttctggcctgaatgacccccaaggttccttctttctctaataggccagagcagcagggacctggtgcagggtcctcacaggcatagatagcactgggttccaggactgacacaggggctacaggccactgtgggaatctatccacgtcatggatgtgtgtacacgttcccttagctgctttcctgacttggcctctgctctctggccccagcctgtgtttcattctgagcccatctatccagtcaaatccatttgtattgagtgcyaactatgtgccacgcactgcacaggtccctgatgatgccaaggtgaataaggcagacatgatccctattcttccctcatggggtttattacagtgaggtcctagaccagcaaacagccagttaacatattttgtgaccacttttgggactggtgacatgcagagagttatgggaaccactggaggggaacttgacttggctcaaggaaacacagaagggttcctgaggaggtctaagctgagactgaagataaacaggtactagccaagtgagggagagaggggagaaaactgttccagg

SEQ ID NO: 122935 - DNA, 601 bp, Human
ctggaatctgtgactgcatcagctcagaagcaggcctttgctgctcctggtctcttctgaatctttgggtcagtggttctcaaccctggctgcagagaattagagtcacttgctgggggcggatgggctggggagttatatgccaaaacttgcgcctatttccctaaagttcggatttaattggtctgccctggggcataaacagtattgctatttaaaaatcaggcttcccctggtgactgtaatgtgctaccagggctatgaagcactgatctggggtcttggggaattatggtttgaraagcacaaactcagatatcactcttttaggggttagaccttgggagctcatctgtgtgtcccctccctagtggcctaatttccctaggtctcggtaggaggaggaccttgggggaagattctcttgccttagcaggagagaagcctatagctaatgagacatggagcaaaagagaagaagggagagggagaaactaaaagaaggataaatggacaaagaaagaaggaagggcaagaaaacagtagaaaaatagtggctgggtagaggcccagaaggaccaccataactgttcaggtctca

SEQ ID NO: 122936 - DNA, 601 bp, Human
atctgttacttccatccaggactcatctcttctgggacaccacaacccatcacaggaatcccctctccctagcccagcaaaggatcatgcctttccctaactacttcaggaggggagccagggcttttcacggttcaaagaacagtccaggtccctttaccttgtccaaccagggctcctcctaaatccacctaagggtcagagcagggggacaggcacacgtacacagagctgactggaagctgtggcacagaggcatttttaatggaagtggctttgcagactggaatctgtgactgcrtcagctcagaagcaggcctttgctgctcctggtctcttctgaatctttgggtcagtggttctcaaccctggctgcagagaattagagtcacttgctgggggcggatgggctggggagttatatgccaaaacttgcgcctatttccctaaagttcggatttaattggtctgccctggggcataaacagtattgctatttaaaaatcaggcttcccctggtgactgtaatgtgctaccagggctatgaagcactgatctggggtcttggggaattatggtttgagaagcacaaactcagata

SEQ ID NO: 122937 - DNA, 601 bp, Human
tccacccttcccctccctctatcctccaactagttgctttggcagatcaaccgcctgtgtcagcatatcctcctcttcttgttgtagaaactctctgctctcatctgcatgaaaaagaatctagctctttaaaactccattcatctgttacttccatccaggactcatctcttctgggacaccacaacccatcacaggaatcccctctccctagcccagcaaaggatcatgcctttccctaactacttcaggaggggagccagggcttttcacggttcaaagaacagtccaggtccctttrccttgtccaaccagggctcctcctaaatccacctaagggtcagagcagggggacaggcacacgtacacagagctgactggaagctgtggcacagaggcatttttaatggaagtggctttgcagactggaatctgtgactgcatcagctcagaagcaggcctttgctgctcctggtctcttctgaatctttgggtcagtggttctcaaccctggctgcagagaattagagtcacttgctgggggcggatgggctggggagttatatgccaaaacttgcgcctatttccctaaagttcggat

SEQ ID NO: 122938 - DNA, 601 bp, Human
ttctttggccacctagaaagctagccgaggtcactggaccctctgctctgtcttgctggttcacctttgctccctgccctgtccaagcctgaggcatatccctcacccccctggtcactggttttctatcaggttttagcaggttcaagttgaagcttctcctcatggactctggaatcctgaccttgcttggatccccagccaggtccaacttgttaagctgagcctcctcttctggggcctccacccttcccctccctctatcctccaactagttgctttggcagatcaaccgcctgtrtcagcatatcctcctcttcttgttgtagaaactctctgctctcatctgcatgaaaaagaatctagctctttaaaactccattcatctgttacttccatccaggactcatctcttctgggacaccacaacccatcacaggaatcccctctccctagcccagcaaaggatcatgcctttccctaactacttcaggaggggagccagggcttttcacggttcaaagaacagtccaggtccctttaccttgtccaaccagggctcctcctaaatccacctaagggtcagagcagggggacaggc

SEQ ID NO: 122939 - DNA, 601 bp, Human
atctgcaacagccattgtatggggcacaaaagatttcccttctaagaaaggaaatcttggtgtgcctgatgtgtgaatgacaggggcacagcagtttgctctatccagcttcttttggctaaagcacgactgaggttttttttgttttttttttttgttttttgagacagggtctcaatctgtcacccaggctagaatgcaatgggacaagcttggctcacttcaaactctgcctcccaggttcaggtgattctcctgcctcagcctcccgagtagctgggattacaagcgtctgccaccwcacccggctaatttttgcatttttagtagagacaggtttcactcagttggcctggctggtcttgagcccctgacctcaagtgatccgcccaccttggcctcccaaagtgctgggattacaggcatcagccaccatgcccagccaatgactgactattttctttggccacctagaaagctagccgaggtcactggaccctctgctctgtcttgctggttcacctttgctccctgccctgtccaagcctgaggcatatccctcacccccctggtcactggttttctatcaggttttagcagg

SEQ ID NO: 122940 - DNA, 601 bp, Human
tgaggcagtgagtgaatcattgagggactaaacgaatgaatgcttgaatgtgggctgggttaggggtctgatggcttagaaaaggatcaattcatgaagattcttttattgaatgaaagcagatgtggtgtttgaggaaggaaactgtagatagcacactatggctgggggccagggggagggtgccccatagcatggggcaagggaggaggcagggaggtatgatatctgcctggagccaggtgtgctccctgcctgattgttcagcatcaggccccttcccggcctctgctccacccargccaggcctttcttgtctctttcctgatttccccaaagcccaggggccccagcctgacaccagaggctgctttctctcttacctattaatggagctgacactgggcacagtgtcattgtcacagacgccctcagccaggagccggtctcggatctcccaggcaaacatggtagggttctggcgtttgtagtccccaatcttctccaccaccttgggggtggccaccttgggcttggagccccctatcactccaggccggatgctgccagtctcgtagtacctactccaatagagaatccc

SEQ ID NO: 122941 - DNA, 601 bp, Human
tatctactggttttcttttctttctttctttttttttttgagatagagtcttgctcttgtcgcccaggctggagtccagtggcgtgatctcagctcactgcaacctctgcctcccatgttcaagtggttttcctgcttcagtctcccaagtagctaggattacaggcactcgccaccacacccagttaatttttgcatttttagaagagatggggtttcaccatgttggccaggttggtctcgaacgcctgatctcaggtgatccacctgccttggcctcccaaagtgctgggattacagkcatgagccactgcacctggcctatctactggttttcttttgatcctattagccacagggcctttgcataactgtctgagctcttttcacctagttctcttattgttttttactcaagggaagactttcatgaacttcataaaccaaataatcctgtgctaccttgcatatcttcatgttccttttcttagcaggacttacagctgcatttttacaatattttttgtaggtagttgattaatatctgtgttctcattagactgtaagctccgcaaagatgggctttgtgtgtcccagggcc

SEQ ID NO: 122942 - DNA, 601 bp, Human
cttggccaactgagggacaggacatgtgacagtcacatgcagagcccctacaaagtcccatatcataagtggaagggtttctgtccccatcaaagcctgagcaaactgctctcgtgcaccgcccgctgccctcctgtcccagcactcactgtcatccattttcctcttgtcgctgccaggctgagcgatgcccaggagcccattgatggagtaggtggagcccagggaatccgactggggtgactccgggggagttacagctgagctggggactgcagtgggggagagggagagggtcagkggtgggagtgacacccctcacagccctgggtgactctggggtagttacagttgagctggggactgcaggggctgggggagagggagaggagcaaggggtgggacaccccttacagccctggggtgactctggggggactgcggtggtgggaagagggagagggtcagggagtgagagtgacacccctcacagtccctgctgacactgtgcaggaggcagcaagccgaaccatggactgagccctggaggggctcaggtccttcctccagggggcctcctggtgggagggattcttggagt

SEQ ID NO: 122943 - DNA, 601 bp, Human
cgaaggtgctttcggggtccgctgctgctgctctgtgagtcaatgcttagtcggcagctatcctgatcacctggtaccccccgggaaggaagaaagcttttaggggacctatctattcatgctctaggccaaagtagaggactgactccaagctgactcactgtggagggagaaaaagggccagccacgtgggcccaggagccttggccaactgagggacaggacatgtgacagtcacatgcagagcccctacaaagtcccatatcataagtggaagggtttctgtccccatcaaagcctsagcaaactgctctcgtgcaccgcccgctgccctcctgtcccagcactcactgtcatccattttcctcttgtcgctgccaggctgagcgatgcccaggagcccattgatggagtaggtggagcccagggaatccgactggggtgactccgggggagttacagctgagctggggactgcagtgggggagagggagagggtcaggggtgggagtgacacccctcacagccctgggtgactctggggtagttacagttgagctggggactgcaggggctgggggagagggagaggagcaagggg

SEQ ID NO: 122944 - DNA, 601 bp, Human
gtgagaagctactgagagcagcatgtgggacatgcagaagggcaagaggcaggagagatgattcatgtcggaggggcaggggaggactgacggagagggtgatgtttggctgagtcatgaaggctagtggtatttttccatgcagagaagtgggaggaaaggcattctgtgtggagggcacacagtgtgcaagggcagagaggtgtgagcgagggtggtgagctcggggccatgagtaatgcaagagcatggggtgtgcaggatgagtggccaaaggtggggctaggaaatagtggctgaggtcattatgtgaaggctttgtgctactgcttcagagttgtggaacgtgatgttgcaatctgggaaagacgctgatggcaagggatagcatcatcaggttgtgctgccatccctgaaaggcccaggctcaaaggttttgggtgaaggaagccaggagggttagaaagggaggaagatgccagggcatctggtaaaataaagcatgtgtcaggcttggagttgcataaggcaggtgccctgagcccattgatgcaacttccagctgctttgatggagcacaggctcatttggagaatagacc

SEQ ID NO: 122945 - DNA, 601 bp, Human
gacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcacyataccattactgtctattataaggggggcacaatggtaggtgctgggaataaaaacgatgtttaacgtttcatgaggcttccctgtccttaaggagtccgcgtgtctttgtacctgtctgtctgctagattattaagtgacactgtgagaagctactgagagcagcatgtgggacatgcagaagggcaagaggcaggagagatgattcatgtcggaggggcaggggaggactgacggagagggtgatgtttggctgagtcatgaaggctagtggtatttttccatgcagagaagtgggag

SEQ ID NO: 122946 - DNA, 601 bp, Human
gacgtaagcattacatgaaattttgtatacttatacataatgtgcttagcaccgaatacttggtgacagcagatgcccaatgagagttatcacagatattatttcagaatcgtgaagagtcagaagccaccaaattcttgatttctgtcaataaactgatattcatattctgttgattttttttgatgcatttgtaaaatagggaaacaagagctgtatgacttctagctatgtctggtcatgaaatagcaaccaggaataaggccacatgatgtttctgatgaacacttccccctgccctttttttttttttttcagatggagcctcgctctgtcacccaggctggagtgcagtggcacaatctcgggtcactgcaacctccgccccccagcttcaagcgattctcctgtctcagcctcccgagtagctaggattacaggtgcacgccaccaggcctggctaatttttatatttttagtagagatgggattttgccttgttggccaggctggtctcaaactcctgacctcaggtgacccatccaccttggcctcccaaagtgctgggactacaggtgtgagccaccatgcctggtccccc

SEQ ID NO: 122947 - DNA, 601 bp, Human
caaaatatctactcagaatcctatagctatttcaaaatccaagtaacttagaaaaaaaggaaaaagaaaacctatatagtcaaatcttttggtgattttgtattcaatgactgaaacttcccagtgattattgggctttttagctggaattgaacttgaatcggggcagagcagcacaatgcttcagaacttcagcgactctgagccctggttctgcaatgacctgccaagtagctttagtctacttgactgctctgaaccttaattttctcacctgtatgggaatcatagactctacttyatgaggctgacgtaagcattacatgaaattttgtatacttatacataatgtgcttagcaccgaatacttggtgacagcagatgcccaatgagagttatcacagatattatttcagaatcgtgaagagtcagaagccaccaaattcttgatttctgtcaataaactgatattcatattctgttgattttttttgatgcatttgtaaaatagggaaacaagagctgtatgacttctagctatgtctggtcatgaaatagcaaccaggaataaggccacatgatgtttctgatgaacacttcc

SEQ ID NO: 122948 - DNA, 601 bp, Human
gcttagggcctttttttttttttttttttgtagacggagttttgctcttgttgcccaagctggagtgcaatggtgcgatcttcgcttactgcaacctctgcttcctgggttcaagtgattcccctgcctcagcctcccgagtagcagggattacaggtgcgtgctaccatgccaggctaattttttgtatctttagtagagacaggagtttcaccatgttggccaggctagtcttaaactcctgacctcatgatctgcctggcttgacctcccaaagtgttgggattacaggcatgagccrttgcacctggccagggtgtgtcttattgaaattgaacaaaatacctaatttctagagcgtataagagaagtttaaaatgctttatggatgtgttgttttgacagcaaaatatctactcagaatcctatagctatttcaaaatccaagtaacttagaaaaaaaggaaaaagaaaacctatatagtcaaatcttttggtgattttgtattcaatgactgaaacttcccagtgattattgggctttttagctggaattgaacttgaatcggggcagagcagcacaatgcttcagaacttcagc

SEQ ID NO: 122949 - DNA, 601 bp, Human
tacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggcctttttttttttttttttttgtagayggagttttgctcttgttgcccaagctggagtgcaatggtgcgatcttcgcttactgcaacctctgcttcctgggttcaagtgattcccctgcctcagcctcccgagtagcagggattacaggtgcgtgctaccatgccaggctaattttttgtatctttagtagagacaggagtttcaccatgttggccaggctagtcttaaactcctgacctcatgatctgcctggcttgacctcccaaagtgttgggattacaggcatgagccgttgcacctggccagggtgtgtcttattgaaattg

SEQ ID NO: 122950 - DNA, 601 bp, Human
ggctccgggcgttgtacctgccaccacggggtaggtctggtgagtcgagaggttgcgccccagtggcgtgttggaaggggtcagggtggccttcccgtcgtccagggtgctgttgagcaagggcagcgggtagaggccctggggagcaaagagaagtcagcgcacagagacgatccaacaagccgaccttcctgcagaccctgagcctgtgtcttaggacttggcagccctcatctccccaggagaggtcctcatctcccccttcttcctttacgttctcaactccactcggcacgtttcrttcatgctcattgtcctcccgcatccctggaattcaaggccagctggtggcatgggtgcccagacgtgggatagagagtctcagccagaggaccacaccctggttggatggctggtcggcttcctggtttcaccacactgttgggacccacagaatgcaggacggtgccaaggactggagcagtctccaaccggactgttcagggtccttgcatctgttaatttattcttccccagataggaaacccaggcacaaaggtttaagaaacttgtcccacttccagatgggccaaagatagga

SEQ ID NO: 122951 - DNA, 601 bp, Human
agccagccaagctcttcagtcccccgccctccacctgccagggaggctccgggcgttgtacctgccaccacggggtaggtctggtgagtcgagaggttgcgccccagtggcgtgttggaaggggtcagggtggccttcccgtcgtccagggtgctgttgagcaagggcagcgggtagaggccctggggagcaaagagaagtcagcgcacagagacgatccaacaagccgaccttcctgcagaccctgagcctgtgtcttaggacttggcagccctcatctccccaggagaggtcctcatckcccccttcttcctttacgttctcaactccactcggcacgtttcgttcatgctcattgtcctcccgcatccctggaattcaaggccagctggtggcatgggtgcccagacgtgggatagagagtctcagccagaggaccacaccctggttggatggctggtcggcttcctggtttcaccacactgttgggacccacagaatgcaggacggtgccaaggactggagcagtctccaaccggactgttcagggtccttgcatctgttaatttattcttccccagataggaaacccaggcacaaa

SEQ ID NO: 122952 - DNA, 601 bp, Human
ttctgccaggaggagccagctccccttgaggtctgactcatgcagtgcaggcccaggcctcaaccagctacagatggtgctcctgcccagagaccttggcagggaccttctcctccctgggccaggttcctcatcagcataagaggtttgatctagaggctccctcaggtgcttccagatttacttatttttatttatttgtttttttcttttttgagatggagtcttgctctgtcacccaggctggagtgccatggcgccacctcagctcactgcaacctatgcctcctgggttcaagcrattctcctgcctcggcctccccagtagctgggattacaggtgtctgccaccacaccccctaattttttgaattttagtagagatggggtttcatcatcttggccaggctggtcttgaactcttgaccttgtgatccacctgcctcggcctcccaaactgctggaattacaggggtgagccacctcgcccggtcggtgcttccagctttaaatattttgaggcagttgaggttcctgatgggaggtcccccactcctctcaagttgttgaatcactgaatttatcatgtttaacagatgtc

SEQ ID NO: 122953 - DNA, 601 bp, Human
aagagattcctccaatgctgaactgagagctagctggcttccttccctggtcctgggcccccactgggcccacatctaaaatagtcctatccctgtggaagcccttgaggtatctgaagaccatatgggtctctgcttcccactttcactgcatctcaggccctctccaacccaagccaagcgcttgactctcagccattcctcaggccctggctggatgagcgaaggtccttctgccaggaggagccagctccccttgaggtctgactcatgcagtgcaggcccaggcctcaaccagctrcagatggtgctcctgcccagagaccttggcagggaccttctcctccctgggccaggttcctcatcagcataagaggtttgatctagaggctccctcaggtgcttccagatttacttatttttatttatttgtttttttcttttttgagatggagtcttgctctgtcacccaggctggagtgccatggcgccacctcagctcactgcaacctatgcctcctgggttcaagcgattctcctgcctcggcctccccagtagctgggattacaggtgtctgccaccacaccccctaattttttg

SEQ ID NO: 122954 - DNA, 601 bp, Human
cagcattacttaggaataatgtggcctcaacttccttctctttctttattatttttttcttttttgagacggagtttcgctcttgttgcccaggctggagtgcaatggcacgatctcggctcaccgcaacctccgcctcctgggtttaagcaattctcctgcctcagcctcccgagtagctgggattacaggcatgtgccaccacgcctggctaattttgtatttttagtagagatggggtttctccatgttggtcaggctggtctcgaactcccgacctcaggtgatccacccaccttgrcctcccaaagtgctgggattacaggtgtgagccattgggcccaggttccttctctttctttcaaattcacctcttcttgggaaggtctgcagcctcctgcgctcctggaaccattcccttcctaaccttccccaccgccccccgtcatgtcctcccagctctctcaccatggctcagccacgtgttaggtattgagatccagtcttgaccagaggcctcaggtggacagtctgtaaggagctccaggccaacaccctgagctcagcatggacaccagccatcccctcccttgtgcctgag

SEQ ID NO: 122955 - DNA, 601 bp, Human
gatgagctgagactcagaaggatagtcaccttggaaatcacactatcagagccaccaggcggaaataagtgacccagagaaaaacgctatgaagtagtgaaggagttgcaggaggcggcagcgagggtccttgggagtcactcagaggcatgtggaagattcacgcgggttaaagctgagctgattatggaatgaaaactcactgtgtcctctctcctctctcctggtctgcagcattacttaggaataatgtggcctcaacttccttctctttctttattatttttttcttttttgagayggagtttcgctcttgttgcccaggctggagtgcaatggcacgatctcggctcaccgcaacctccgcctcctgggtttaagcaattctcctgcctcagcctcccgagtagctgggattacaggcatgtgccaccacgcctggctaattttgtatttttagtagagatggggtttctccatgttggtcaggctggtctcgaactcccgacctcaggtgatccacccaccttggcctcccaaagtgctgggattacaggtgtgagccattgggcccaggttccttctctttctttcaaattca

SEQ ID NO: 122956 - DNA, 601 bp, Human
gttaggggcactcttgctattccccaaaccttgctgtttcttctttcttggctgactggggatgagctgagactcagaaggatagtcaccttggaaatcacactatcagagccaccaggcggaaataagtgacccagagaaaaacgctatgaagtagtgaaggagttgcaggaggcggcagcgagggtccttgggagtcactcagaggcatgtggaagattcacgcgggttaaagctgagctgattatggaatgaaaactcactgtgtcctctctcctctctcctggtctgcagcattacytaggaataatgtggcctcaacttccttctctttctttattatttttttcttttttgagacggagtttcgctcttgttgcccaggctggagtgcaatggcacgatctcggctcaccgcaacctccgcctcctgggtttaagcaattctcctgcctcagcctcccgagtagctgggattacaggcatgtgccaccacgcctggctaattttgtatttttagtagagatggggtttctccatgttggtcaggctggtctcgaactcccgacctcaggtgatccacccaccttggcctcccaaa

SEQ ID NO: 122957 - DNA, 601 bp, Human
actggggcttccaaagggaactggcagcaatgttaggggcactcttgctattccccaaaccttgctgtttcttctttcttggctgactggggatgagctgagactcagaaggatagtcaccttggaaatcacactatcagagccaccaggcggaaataagtgacccagagaaaaacgctatgaagtagtgaaggagttgcaggaggcggcagcgagggtccttgggagtcactcagaggcatgtggaagattcacgcgggttaaagctgagctgattatggaatgaaaactcactgtgtcytctctcctctctcctggtctgcagcattacttaggaataatgtggcctcaacttccttctctttctttattatttttttcttttttgagacggagtttcgctcttgttgcccaggctggagtgcaatggcacgatctcggctcaccgcaacctccgcctcctgggtttaagcaattctcctgcctcagcctcccgagtagctgggattacaggcatgtgccaccacgcctggctaattttgtatttttagtagagatggggtttctccatgttggtcaggctggtctcgaactcccgacc

SEQ ID NO: 122958 - DNA, 601 bp, Human
tggtaagactttcttcagcatggctctcacccagactatggcacaataaactctcccaacagccctacaaaactctttgctccaattgcttaaatgcatagtttcttccaaaaagccaagaagcttgcaagccttcttagaaacaaaaccacagaagctgtggggtggaaactccatcacggcctaaccatgccctcttacctacttctctgtttttaagactcttcatcataaaacgatcctcgctatgaattccatctcctctacacccaaatttctttccaacgtggtcctattttargaagttgacagaaagcataggcccatgttgactggccgtggagttctctaagaaaactctagctccccctacaccttgaaatattggtaaatattctaaatattggtagaggccagaatcataaagctattgcctggaggaattcagagggtagaggtgatttcagactattttattttccccctttgaagtctgccctccatgtaaccccttttcaattccttatctcgttctgatagcaaggagaatttatggcaactcagaaatctctttggcagaactaaatataattttgtacaa

SEQ ID NO: 122959 - DNA, 601 bp, Human
ccaaattcatctcctctatggcactgcttgtccaactatccacccatcagtcccccccaggtccttcatacctcagccccttcaaggggtgcctggtcatgacagaagggaaggaaggccccatgaaagcctgtaagttgccaatactgcagtgactacctcctccttatctctctttctggagattccccaaagacagtgttcattcactaaatacttactgagtaaatactatattctagacacttttctaagcacttgggtatatagcagaaagccaggatgctaaattagcaaggcygggcactaaatcaagaagggacataggctgggataggcatttggagccaagcccaaggggtcaatgaacaaaaaccaggcacacacaacttcttcccttcctctagagggcagggcctgggaatcagagggcctggagtccttatactgcttctgtggctagttttctgagtgcccttagataagcctagtatgtgccccaagggtcagtttcttcatatgcaaaatggaaaaaaaaacatagctgtaggcaccttattacaatttctatgaggttatctgcataattcagagccagggt

SEQ ID NO: 122960 - DNA, 601 bp, Human
gagagagatgtgaagcatatatttcatcatcatcatcgtcatcgtcatcatcatcatcatcatcatcaatacccttcagattcagattttacagaacgggtaaactgggattcatcagagttaaatcactgggagaccagcactgcttgagggtagggttcatcttccactcacagtgttttggggcccttagagtgctctccatttatgctcactgattcactggaagaagtggtggagcttggatttgaacacagacctgtctcagcccctcccttttcatcatggagggtaatgtagyaggcctgggaagaaggaggccgagctggggcaagttaaatagggagtcaggactgcactgggacatcgtctccaggcatttacaaggagatgccctctttggtccatccttcaatgccctttgggaagtctatgaatagggcacagtatgcctcttgctccttgtgtcccaccttgctccaatacttcctctttgcagtgctccccttcctgccggccctctccttacctgccaccatgcctgcgatggcagaggaggcatagctgccctgtccgctggtggggatgtggggtgggtatc

SEQ ID NO: 122961 - DNA, 601 bp, Human
actcccattatcttcatttgtccagaccttgtcatcttgaatcatcattggatgatgactggcagacaaagaaacccaaatgactggcaggcaggttccagaacagtccaaatgaggatggagagctactccaggctcatttcatcctctatagtactcttagagtacctagaacccgggtcctatccatgcaggcttgagagagagatgtgaagcatatatttcatcatcatcatcgtcatcgtcatcatcatcatcatcatcatcaatacccttcagattcagattttacagaacgggyaaactgggattcatcagagttaaatcactgggagaccagcactgcttgagggtagggttcatcttccactcacagtgttttggggcccttagagtgctctccatttatgctcactgattcactggaagaagtggtggagcttggatttgaacacagacctgtctcagcccctcccttttcatcatggagggtaatgtagcaggcctgggaagaaggaggccgagctggggcaagttaaatagggagtcaggactgcactgggacatcgtctccaggcatttacaaggagatgccctcttt

SEQ ID NO: 122962 - DNA, 601 bp, Human
tccatcccaaagtcttccctacatggctcctaaaaaattgagacttgcccaaggaaactcccattatcttcatttgtccagaccttgtcatcttgaatcatcattggatgatgactggcagacaaagaaacccaaatgactggcaggcaggttccagaacagtccaaatgaggatggagagctactccaggctcatttcatcctctatagtactcttagagtacctagaacccgggtcctatccatgcaggcttgagagagagatgtgaagcatatatttcatcatcatcatcgtcatcgacatcatcatcatcatcatcatcaatacccttcagattcagattttacagaacgggtaaactgggattcatcagagttaaatcactgggagaccagcactgcttgagggtagggttcatcttccactcacagtgttttggggcccttagagtgctctccatttatgctcactgattcactggaagaagtggtggagcttggatttgaacacagacctgtctcagcccctcccttttcatcatggagggtaatgtagcaggcctgggaagaaggaggccgagctggggcaagttaaataggg

SEQ ID NO: 122963 - DNA, 601 bp, Human
agggtgcccagagtgggtggctggcaaagattaactcctgccggcaaggaagggaagcaggcctaggtaaatacgccaagtctctggggtcacagccagagaggctggcctagggctggcatgggggtcacagatgccttgtgttcagagctctttccagaaactccaggtcccaggcctttttgaccagtgacaatggctcaattatgtctcatccatcccaaagtcttccctacatggctcctaaaaaattgagacttgcccaaggaaactcccattatcttcatttgtccagaccttrtcatcttgaatcatcattggatgatgactggcagacaaagaaacccaaatgactggcaggcaggttccagaacagtccaaatgaggatggagagctactccaggctcatttcatcctctatagtactcttagagtacctagaacccgggtcctatccatgcaggcttgagagagagatgtgaagcatatatttcatcatcatcatcgtcatcgtcatcatcatcatcatcatcatcaatacccttcagattcagattttacagaacgggtaaactgggattcatcagagttaaatcactg

SEQ ID NO: 122964 - DNA, 601 bp, Human
ctgattttcatggaactcactgggagcccaactgtgtagggcaaggtccctcctttgtggatttcacttgcagtcagtgtcctagttgtgctattttttttctttttcacagaacccactcaggattctttctggaaacaacctgggggactttgatgagaggctcaagccttctagctacctcacaggtcagactctgggccccaggaaccccttgccctgggcctgccctcagggaatgattcataattaagagaaaagccttgtgctttatgtttcttcctcctcctctaagcaggcrgcaggggaaggtggaggggttggaaggggaatggggggaaccgactggagactgggattttgattgagaggccccattatccacactcttaaaaaaataaccgaatcttttccttttttatcttgaccaatctcatttcacgctccagaagaggaagggagggagggagggagtccggggccaggagggacagaggagtcagtattctgtattttcaacgctgcattaagcacatcgccacggtaaccaggcagcaacaagtgccagctcagcaggttcccagggagcacagagcatttc

SEQ ID NO: 122965 - DNA, 601 bp, Human
agtggaaagatagatgactggatggatccatgtgtctggagctgctggttctgctctagaactggttgagaatcattgactgttaatggagtcaaaacaaaaaataaaataaaataaaataaaataaaaaaataaaataaaataaaatataaaataaaataaaataaaataaaataaaatagaaacagaaggtgaatagacaagggaaatctgtcctagcccttttcctgtgctcctctcttgcagcttgtgtctttatttctggtatggtaggaggcagtatggtgtagaggaaagagcyttagacttgaaattgaaaaatccgtgtttgcataactcagccacttagtatgattatgaccctgagcacaccactttgcttttgcttcagtttccttatccataaaactgggatagtattagcctcttagtcttatggtcagggtaaaattagaaataaagttatacatatttgaatggctagacatgcaaaagtacataataagtgatcacttccttcctttcacaattgattgatgaatgtctttggcatgccttgctttaagcatttatcatgtacctaacatgaatgcagtaggtg

SEQ ID NO: 122966 - DNA, 601 bp, Human
ccgtctccaaaaaaaaaaaaaaaaaaagaaagatggatggaaagatggaaggatcggtggaaaggtggaggatgacgggatggatgatgaaagatagaaggatagatgggaaaatgcatggatgcgtggaaaaatgtatgggaagatgaatgagtggaaagatagatgactggatggatccatgtgtctggagctgctggttctgctctagaactggttgagaatcattgactgttaatggagtcaaaacaaaaaataaaataaaataaaataaaataaaaaaataaaataaaataaaatataaaataaaataaaataaaataaaataaaatagaaacagaaggtgaatagacaagggaaatctgtcctagcccttttcctgtgctcctctcttgcagcttgtgtctttatttctggtatggtaggaggcagtatggtgtagaggaaagagctttagacttgaaattgaaaaatccgtgtttgcataactcagccacttagtatgattatgaccctgagcacaccactttgcttttgcttcagtttccttatccataaaactgggatagtattagcctcttagtcttatggtcagggtaaa

SEQ ID NO: 122967 - DNA, 601 bp, Human
aagactccgtctccaaaaaaaaaaaaaaaaaaagaaagatggatggaaagatggaaggatcggtggaaaggtggaggatgacgggatggatgatgaaagatagaaggatagatgggaaaatgcatggatgcgtggaaaaatgtatgggaagatgaatgagtggaaagatagatgactggatggatccatgtgtctggagctgctggttctgctctagaactggttgagaatcattgactgttaatggagtcaaaacaaaaaataaaataaaataaaataaaataaaaaaataaaataaaaaaaaatataaaataaaataaaataaaataaaataaaatagaaacagaaggtgaatagacaagggaaatctgtcctagcccttttcctgtgctcctctcttgcagcttgtgtctttatttctggtatggtaggaggcagtatggtgtagaggaaagagctttagacttgaaattgaaaaatccgtgtttgcataactcagccacttagtatgattatgaccctgagcacaccactttgcttttgcttcagtttccttatccataaaactgggatagtattagcctcttagtcttatggtcag

SEQ ID NO: 122968 - DNA, 601 bp, Human
cctgggcaacagagcaagactccgtctccaaaaaaaaaaaaaaaaaaagaaagatggatggaaagatggaaggatcggtggaaaggtggaggatgacgggatggatgatgaaagatagaaggatagatgggaaaatgcatggatgcgtggaaaaatgtatgggaagatgaatgagtggaaagatagatgactggatggatccatgtgtctggagctgctggttctgctctagaactggttgagaatcattgactgttaatggagtcaaaacaaaaaataaaataaaataaaataaaataawaaaataaaataaaataaaatataaaataaaataaaataaaataaaataaaatagaaacagaaggtgaatagacaagggaaatctgtcctagcccttttcctgtgctcctctcttgcagcttgtgtctttatttctggtatggtaggaggcagtatggtgtagaggaaagagctttagacttgaaattgaaaaatccgtgtttgcataactcagccacttagtatgattatgaccctgagcacaccactttgcttttgcttcagtttccttatccataaaactgggatagtattagcctct

SEQ ID NO: 122969 - DNA, 601 bp, Human
cagcctgggcaacagagcaagactccgtctccaaaaaaaaaaaaaaaaaaagaaagatggatggaaagatggaaggatcggtggaaaggtggaggatgacgggatggatgatgaaagatagaaggatagatgggaaaatgcatggatgcgtggaaaaatgtatgggaagatgaatgagtggaaagatagatgactggatggatccatgtgtctggagctgctggttctgctctagaactggttgagaatcattgactgttaatggagtcaaaacaaaaaataaaataaaataaaataaaawaaaaaaataaaataaaataaaatataaaataaaataaaataaaataaaataaaatagaaacagaaggtgaatagacaagggaaatctgtcctagcccttttcctgtgctcctctcttgcagcttgtgtctttatttctggtatggtaggaggcagtatggtgtagaggaaagagctttagacttgaaattgaaaaatccgtgtttgcataactcagccacttagtatgattatgaccctgagcacaccactttgcttttgcttcagtttccttatccataaaactgggatagtattagcc

SEQ ID NO: 122970 - DNA, 601 bp, Human
accaggcacagtgactcacacctgtaatcccaacactttgggaggccaaggcgggcagattgcctgaggccaggagttcgagaccagcctggccaacatggtgaaactccgtctctaccaaaaatataaaaattagccaggtgtggtggtgggtccctgtagtgacagctagtggggaggctgaggcaggagaatcgcttgaacccgggaggcagaggttgcagtgagctaagatcacaccactacactccagcctgggcaacagagcaagactccgtctccaaaaaaaaaaaaaaaaaargaaagatggatggaaagatggaaggatcggtggaaaggtggaggatgacgggatggatgatgaaagatagaaggatagatgggaaaatgcatggatgcgtggaaaaatgtatgggaagatgaatgagtggaaagatagatgactggatggatccatgtgtctggagctgctggttctgctctagaactggttgagaatcattgactgttaatggagtcaaaacaaaaaataaaataaaataaaataaaataaaaaaataaaataaaataaaatataaaataaaataaaataaaataaaat

SEQ ID NO: 122971 - DNA, 601 bp, Human
gaatatggatggaaaaataaaaggattgatggaaagatggatggatggaaagatggatgatagataactgaaaagacagatgaattaaaagatggatggagggaccaggcacagtgactcacacctgtaatcccaacactttgggaggccaaggcgggcagattgcctgaggccaggagttcgagaccagcctggccaacatggtgaaactccgtctctaccaaaaatataaaaattagccaggtgtggtggtgggtccctgtagtgacagctagtggggaggctgaggcaggagaatcgmttgaacccgggaggcagaggttgcagtgagctaagatcacaccactacactccagcctgggcaacagagcaagactccgtctccaaaaaaaaaaaaaaaaaaagaaagatggatggaaagatggaaggatcggtggaaaggtggaggatgacgggatggatgatgaaagatagaaggatagatgggaaaatgcatggatgcgtggaaaaatgtatgggaagatgaatgagtggaaagatagatgactggatggatccatgtgtctggagctgctggttctgctctagaactggttgagaa

SEQ ID NO: 122972 - DNA, 601 bp, Human
acaaatgattcttgtttcctctattttctcatcccaacagccaatctaccagcaaggtttgctggctttgcaaccaaaatatattttcagggtctctttttccctccttcactgctaattccctaactcaagccactgtcatctcttgcaagaactactgcaactgtcccctaactggtctttgtgctttctctcttgactatgtacaattcattttcctagaaatcagagtagccttttaaaactcgacccagccactacaattttgtgctaccatgctaaactagttcctgccttaggycctttgcccttgctgttctttggtccagggatggtctgccccagtttatcacttgaatggtcactttgaacaccttctcagagaggcctcccctgacagcccaatctaaagtagttatctcctctccctgtggctctttattacatcatcccattttattgtcttcacagacaataaattattatgttcattcattgacttatttattgtccatttgtcttcaccattaggttataagctccaggaataaaggaatctgacttattcactgctgtatccccagcatcctatacagtagac

SEQ ID NO: 122973 - DNA, 601 bp, Human
tctcaatcataacacggcccaaaaaactcttgatttccacttgccatctactacatcacttcccctcctggtctgccatatatatacttgccaccatcatccatgccccaaacctacaaatgattcttgtttcctctattttctcatcccaacagccaatctaccagcaaggtttgctggctttgcaaccaaaatatattttcagggtctctttttccctccttcactgctaattccctaactcaagccactgtcatctcttgcaagaactactgcaactgtcccctaactggtctttgtrctttctctcttgactatgtacaattcattttcctagaaatcagagtagccttttaaaactcgacccagccactacaattttgtgctaccatgctaaactagttcctgccttaggtcctttgcccttgctgttctttggtccagggatggtctgccccagtttatcacttgaatggtcactttgaacaccttctcagagaggcctcccctgacagcccaatctaaagtagttatctcctctccctgtggctctttattacatcatcccattttattgtcttcacagacaataaattattat

SEQ ID NO: 122974 - DNA, 601 bp, Human
atcttttattttcaagactaccccatgaggtactcatggatactaccaatttatagaaaaggaaactggagtgcagcatgattaagcagtttgcctcaaatcacactgttgttaaatgtcagagtagaactcgaccttagggctcttgactccaaattgcagataatccctttattcacttatgcgataattccatttacaaagctagattcctgccaaccctgagactcaatgaatgtccacccagcctttcagaaactcacctacgattgggagctatgtggttctgagtctccttccscagactctttggaggggttgctcgaaactccctgactctggagctgacctgtctagagtcaaatccttacttcccatttcctggttatgtaaacttggacaagtcacttagcctctctgagtgagtgacttacaggtgaaccttggtttccttatctgtaaaatgggccaaataattatccctatctcatttggtttaatgagaattaaatgacaaaatatgtattaaatgcttagcaccatgcttcaaatatacagggagtgctcaataaatctaagcttttattattttcccattaaa

SEQ ID NO: 122975 - DNA, 601 bp, Human
ccccagagggcacacaccctcaggaagctgtgtcctgggacttggagtagtttgttgttccatcctgagtctgccgctttaagcaaactcaacgtataaatttacacaaagtaaatcagatcacctccttctgttaatggattcttgagttttccaaaggaattatttaccgaagaaattacttaagaattcccttacataacaaaaacaaagtcaaactgatcaccacagctactaccggtgcttggtaaagagcttaaagtttgtaaagcactttcccatacattatgatcttttattytcaagactaccccatgaggtactcatggatactaccaatttatagaaaaggaaactggagtgcagcatgattaagcagtttgcctcaaatcacactgttgttaaatgtcagagtagaactcgaccttagggctcttgactccaaattgcagataatccctttattcacttatgcgataattccatttacaaagctagattcctgccaaccctgagactcaatgaatgtccacccagcctttcagaaactcacctacgattgggagctatgtggttctgagtctccttccccagactcttt

SEQ ID NO: 122976 - DNA, 601 bp, Human
ccagcagaggcctgggcagccccagggacttactcagcaagctggagttggggaagcgccaggcctcgctgtaggaggagtagggggtgtggccataggcattgccagagtattcacttcctgttggaggcacacaggggagaggcctgtgaggtgaagggcatcaatgcagggctggggtgtgggaaggtctgcagggctggcaatgggcaagctcaggaatggtgggggagacagttggagccacggcagggacaatggagctcagaaggtccctctgtcatcccttttggaacccatygatctggaaaatttggggcagtgtccttttccgtaggtactggaggcactggcttgacatactacagccctcccaggaggcccagaaggtagatgttataactacccccattttccagatgaagaaactgagcctctgggatctgcggaagctcccagagctggagggtttggtggagctgggaaactgtgctgtgagtgtagggcccagggactaactgctccttctgctgcctggaccttctggagaagggctcttctgggagggccccacagcaggggtatggggttaggggccaaa

SEQ ID NO: 122977 - DNA, 601 bp, Human; identical to SEQ ID NO: 122883

SEQ ID NO: 122978 - DNA, 601 bp, Human; identical to SEQ ID NO: 122884

SEQ ID NO: 122979 - DNA, 601 bp, Human; identical to SEQ ID NO: 122885

SEQ ID NO: 122980 - DNA, 601 bp, Human; identical to SEQ ID NO: 122886

SEQ ID NO: 122981 - DNA, 601 bp, Human; identical to SEQ ID NO: 122887

SEQ ID NO: 122982 - DNA, 601 bp, Human; identical to SEQ ID NO: 122888

SEQ ID NO: 122983 - DNA, 601 bp, Human; identical to SEQ ID NO: 122889

SEQ ID NO: 122984 - DNA, 601 bp, Human; identical to SEQ ID NO: 122890

SEQ ID NO: 122985 - DNA, 601 bp, Human; identical to SEQ ID NO: 122891

SEQ ID NO: 122986 - DNA, 601 bp, Human; identical to SEQ ID NO: 122892

SEQ ID NO: 122987 - DNA, 601 bp, Human; identical to SEQ ID NO: 122893

SEQ ID NO: 122988 - DNA, 601 bp, Human; identical to SEQ ID NO: 122894

SEQ ID NO: 122989 - DNA, 601 bp, Human; identical to SEQ ID NO: 122895

SEQ ID NO: 122990 - DNA, 601 bp, Human; identical to SEQ ID NO: 122896

SEQ ID NO: 122991 - DNA, 601 bp, Human; identical to SEQ ID NO: 122897

SEQ ID NO: 122992 - DNA, 601 bp, Human; identical to SEQ ID NO: 122898

SEQ ID NO: 122993 - DNA, 601 bp, Human; identical to SEQ ID NO: 122899

SEQ ID NO: 122994 - DNA, 601 bp, Human; identical to SEQ ID NO: 122900

SEQ ID NO: 122995 - DNA, 601 bp, Human; identical to SEQ ID NO: 122901

SEQ ID NO: 122996 - DNA, 601 bp, Human; identical to SEQ ID NO: 122902

SEQ ID NO: 122997 - DNA, 601 bp, Human; identical to SEQ ID NO: 122903

SEQ ID NO: 122998 - DNA, 601 bp, Human; identical to SEQ ID NO: 122904

SEQ ID NO: 122999 - DNA, 601 bp, Human; identical to SEQ ID NO: 122905

SEQ ID NO: 123000 - DNA, 601 bp, Human; identical to SEQ ID NO: 122906

SEQ ID NO: 123001 - DNA, 601 bp, Human; identical to SEQ ID NO: 122907

SEQ ID NO: 123002 - DNA, 601 bp, Human; identical to SEQ ID NO: 122908

SEQ ID NO: 123003 - DNA, 601 bp, Human; identical to SEQ ID NO: 122909

SEQ ID NO: 123004 - DNA, 601 bp, Human; identical to SEQ ID NO: 122910

SEQ ID NO: 123005 - DNA, 601 bp, Human; identical to SEQ ID NO: 122911

SEQ ID NO: 123006 - DNA, 601 bp, Human; identical to SEQ ID NO: 122912

SEQ ID NO: 123007 - DNA, 601 bp, Human; identical to SEQ ID NO: 122913

SEQ ID NO: 123008 - DNA, 601 bp, Human; identical to SEQ ID NO: 122914

SEQ ID NO: 123009 - DNA, 601 bp, Human; identical to SEQ ID NO: 122915

SEQ ID NO: 123010 - DNA, 601 bp, Human; identical to SEQ ID NO: 122916

SEQ ID NO: 123011 - DNA, 601 bp, Human; identical to SEQ ID NO: 122917

SEQ ID NO: 123012 - DNA, 601 bp, Human; identical to SEQ ID NO: 122918

SEQ ID NO: 123013 - DNA, 601 bp, Human; identical to SEQ ID NO: 122919

SEQ ID NO: 123014 - DNA, 601 bp, Human; identical to SEQ ID NO: 122920

SEQ ID NO: 123015 - DNA, 601 bp, Human; identical to SEQ ID NO: 122921

SEQ ID NO: 123016 - DNA, 601 bp, Human; identical to SEQ ID NO: 122922

SEQ ID NO: 123017 - DNA, 601 bp, Human; identical to SEQ ID NO: 122923

SEQ ID NO: 123018 - DNA, 601 bp, Human; identical to SEQ ID NO: 122924

SEQ ID NO: 123019 - DNA, 601 bp, Human; identical to SEQ ID NO: 122925

SEQ ID NO: 123020 - DNA, 601 bp, Human; identical to SEQ ID NO: 122926

SEQ ID NO: 123021 - DNA, 601 bp, Human; identical to SEQ ID NO: 122927

SEQ ID NO: 123022 - DNA, 601 bp, Human; identical to SEQ ID NO: 122928

SEQ ID NO: 123023 - DNA, 601 bp, Human; identical to SEQ ID NO: 122929

SEQ ID NO: 123024 - DNA, 601 bp, Human; identical to SEQ ID NO: 122930

SEQ ID NO: 123025 - DNA, 601 bp, Human; identical to SEQ ID NO: 122931

SEQ ID NO: 123026 - DNA, 601 bp, Human; identical to SEQ ID NO: 122932

SEQ ID NO: 123027 - DNA, 601 bp, Human; identical to SEQ ID NO: 122933

SEQ ID NO: 123028 - DNA, 601 bp, Human; identical to SEQ ID NO: 122934

SEQ ID NO: 123029 - DNA, 601 bp, Human; identical to SEQ ID NO: 122935

SEQ ID NO: 123030 - DNA, 601 bp, Human; identical to SEQ ID NO: 122936

SEQ ID NO: 123031 - DNA, 601 bp, Human; identical to SEQ ID NO: 122937

SEQ ID NO: 123032 - DNA, 601 bp, Human; identical to SEQ ID NO: 122938

SEQ ID NO: 123033 - DNA, 601 bp, Human; identical to SEQ ID NO: 122939

SEQ ID NO: 123034 - DNA, 601 bp, Human; identical to SEQ ID NO: 122940

SEQ ID NO: 123035 - DNA, 601 bp, Human; identical to SEQ ID NO: 122941

SEQ ID NO: 123036 - DNA, 601 bp, Human; identical to SEQ ID NO: 122942

SEQ ID NO: 123037 - DNA, 601 bp, Human; identical to SEQ ID NO: 122943

SEQ ID NO: 123038 - DNA, 601 bp, Human; identical to SEQ ID NO: 122944

SEQ ID NO: 123039 - DNA, 601 bp, Human; identical to SEQ ID NO: 122945

SEQ ID NO: 123040 - DNA, 601 bp, Human; identical to SEQ ID NO: 122946

SEQ ID NO: 123041 - DNA, 601 bp, Human; identical to SEQ ID NO: 122947

SEQ ID NO: 123042 - DNA, 601 bp, Human; identical to SEQ ID NO: 122948

SEQ ID NO: 123043 - DNA, 601 bp, Human; identical to SEQ ID NO: 122949

SEQ ID NO: 123044 - DNA, 601 bp, Human; identical to SEQ ID NO: 122950

SEQ ID NO: 123045 - DNA, 601 bp, Human; identical to SEQ ID NO: 122951

SEQ ID NO: 123046 - DNA, 601 bp, Human; identical to SEQ ID NO: 122952

SEQ ID NO: 123047 - DNA, 601 bp, Human; identical to SEQ ID NO: 122953

SEQ ID NO: 123048 - DNA, 601 bp, Human; identical to SEQ ID NO: 122954

SEQ ID NO: 123049 - DNA, 601 bp, Human; identical to SEQ ID NO: 122955

SEQ ID NO: 123050 - DNA, 601 bp, Human; identical to SEQ ID NO: 122956

SEQ ID NO: 123051 - DNA, 601 bp, Human; identical to SEQ ID NO: 122957

SEQ ID NO: 123052 - DNA, 601 bp, Human; identical to SEQ ID NO: 122958

SEQ ID NO: 123053 - DNA, 601 bp, Human; identical to SEQ ID NO: 122959

SEQ ID NO: 123054 - DNA, 601 bp, Human; identical to SEQ ID NO: 122960

SEQ ID NO: 123055 - DNA, 601 bp, Human; identical to SEQ ID NO: 122961

SEQ ID NO: 123056 - DNA, 601 bp, Human; identical to SEQ ID NO: 122962

SEQ ID NO: 123057 - DNA, 601 bp, Human; identical to SEQ ID NO: 122963

SEQ ID NO: 123058 - DNA, 601 bp, Human; identical to SEQ ID NO: 122964

SEQ ID NO: 123059 - DNA, 601 bp, Human; identical to SEQ ID NO: 122965

SEQ ID NO: 123060 - DNA, 601 bp, Human; identical to SEQ ID NO: 122966

SEQ ID NO: 123061 - DNA, 601 bp, Human; identical to SEQ ID NO: 122967

SEQ ID NO: 123062 - DNA, 601 bp, Human; identical to SEQ ID NO: 122968

SEQ ID NO: 123063 - DNA, 601 bp, Human; identical to SEQ ID NO: 122969

SEQ ID NO: 123064 - DNA, 601 bp, Human; identical to SEQ ID NO: 122970

SEQ ID NO: 123065 - DNA, 601 bp, Human; identical to SEQ ID NO: 122971

SEQ ID NO: 123066 - DNA, 601 bp, Human; identical to SEQ ID NO: 122972

SEQ ID NO: 123067 - DNA, 601 bp, Human; identical to SEQ ID NO: 122973

SEQ ID NO: 123068 - DNA, 601 bp, Human; identical to SEQ ID NO: 122974

SEQ ID NO: 123069 - DNA, 601 bp, Human; identical to SEQ ID NO: 122975

SEQ ID NO: 123070 - DNA, 601 bp, Human; identical to SEQ ID NO: 122976

SEQ ID NO: 123071 - DNA, 601 bp, Human; identical to SEQ ID NO: 122883

SEQ ID NO: 123072 - DNA, 601 bp, Human; identical to SEQ ID NO: 122884

SEQ ID NO: 123073 - DNA, 601 bp, Human; identical to SEQ ID NO: 122885

SEQ ID NO: 123074 - DNA, 601 bp, Human; identical to SEQ ID NO: 122886

SEQ ID NO: 123075 - DNA, 601 bp, Human; identical to SEQ ID NO: 122887

SEQ ID NO: 123076 - DNA, 601 bp, Human; identical to SEQ ID NO: 122888

SEQ ID NO: 123077 - DNA, 601 bp, Human; identical to SEQ ID NO: 122889

SEQ ID NO: 123078 - DNA, 601 bp, Human; identical to SEQ ID NO: 122890

SEQ ID NO: 123079 - DNA, 601 bp, Human; identical to SEQ ID NO: 122891

SEQ ID NO: 123080 - DNA, 601 bp, Human; identical to SEQ ID NO: 122892

SEQ ID NO: 123081 - DNA, 601 bp, Human; identical to SEQ ID NO: 122893

SEQ ID NO: 123082 - DNA, 601 bp, Human; identical to SEQ ID NO: 122894

SEQ ID NO: 123083 - DNA, 601 bp, Human; identical to SEQ ID NO: 122895

SEQ ID NO: 123084 - DNA, 601 bp, Human; identical to SEQ ID NO: 122896

SEQ ID NO: 123085 - DNA, 601 bp, Human; identical to SEQ ID NO: 122897

SEQ ID NO: 123086 - DNA, 601 bp, Human; identical to SEQ ID NO: 122898

SEQ ID NO: 123087 - DNA, 601 bp, Human; identical to SEQ ID NO: 122899

SEQ ID NO: 123088 - DNA, 601 bp, Human; identical to SEQ ID NO: 122900

SEQ ID NO: 123089 - DNA, 601 bp, Human; identical to SEQ ID NO: 122901

SEQ ID NO: 123090 - DNA, 601 bp, Human; identical to SEQ ID NO: 122902

SEQ ID NO: 123091 - DNA, 601 bp, Human; identical to SEQ ID NO: 122903

SEQ ID NO: 123092 - DNA, 601 bp, Human; identical to SEQ ID NO: 122904

SEQ ID NO: 123093 - DNA, 601 bp, Human; identical to SEQ ID NO: 122905

SEQ ID NO: 123094 - DNA, 601 bp, Human; identical to SEQ ID NO: 122906

SEQ ID NO: 123095 - DNA, 601 bp, Human; identical to SEQ ID NO: 122907

SEQ ID NO: 123096 - DNA, 601 bp, Human; identical to SEQ ID NO: 122908

SEQ ID NO: 123097 - DNA, 601 bp, Human; identical to SEQ ID NO: 122909

SEQ ID NO: 123098 - DNA, 601 bp, Human; identical to SEQ ID NO: 122910

SEQ ID NO: 123099 - DNA, 601 bp, Human; identical to SEQ ID NO: 122911

SEQ ID NO: 123100 - DNA, 601 bp, Human; identical to SEQ ID NO: 122912

SEQ ID NO: 123101 - DNA, 601 bp, Human; identical to SEQ ID NO: 122913

SEQ ID NO: 123102 - DNA, 601 bp, Human; identical to SEQ ID NO: 122914

SEQ ID NO: 123103 - DNA, 601 bp, Human; identical to SEQ ID NO: 122915

SEQ ID NO: 123104 - DNA, 601 bp, Human; identical to SEQ ID NO: 122916

SEQ ID NO: 123105 - DNA, 601 bp, Human; identical to SEQ ID NO: 122917

SEQ ID NO: 123106 - DNA, 601 bp, Human; identical to SEQ ID NO: 122918

SEQ ID NO: 123107 - DNA, 601 bp, Human; identical to SEQ ID NO: 122919

SEQ ID NO: 123108 - DNA, 601 bp, Human; identical to SEQ ID NO: 122920

SEQ ID NO: 123109 - DNA, 601 bp, Human; identical to SEQ ID NO: 122921

SEQ ID NO: 123110 - DNA, 601 bp, Human; identical to SEQ ID NO: 122922

SEQ ID NO: 123111 - DNA, 601 bp, Human; identical to SEQ ID NO: 122923

SEQ ID NO: 123112 - DNA, 601 bp, Human; identical to SEQ ID NO: 122924

SEQ ID NO: 123113 - DNA, 601 bp, Human; identical to SEQ ID NO: 122925

SEQ ID NO: 123114 - DNA, 601 bp, Human; identical to SEQ ID NO: 122926

SEQ ID NO: 123115 - DNA, 601 bp, Human; identical to SEQ ID NO: 122927

SEQ ID NO: 123116 - DNA, 601 bp, Human; identical to SEQ ID NO: 122928

SEQ ID NO: 123117 - DNA, 601 bp, Human; identical to SEQ ID NO: 122929

SEQ ID NO: 123118 - DNA, 601 bp, Human; identical to SEQ ID NO: 122930

SEQ ID NO: 123119 - DNA, 601 bp, Human; identical to SEQ ID NO: 122931

SEQ ID NO: 123120 - DNA, 601 bp, Human; identical to SEQ ID NO: 122932

SEQ ID NO: 123121 - DNA, 601 bp, Human; identical to SEQ ID NO: 122933

SEQ ID NO: 123122 - DNA, 601 bp, Human; identical to SEQ ID NO: 122934

SEQ ID NO: 123123 - DNA, 601 bp, Human; identical to SEQ ID NO: 122935

SEQ ID NO: 123124 - DNA, 601 bp, Human; identical to SEQ ID NO: 122936

SEQ ID NO: 123125 - DNA, 601 bp, Human; identical to SEQ ID NO: 122937

SEQ ID NO: 123126 - DNA, 601 bp, Human; identical to SEQ ID NO: 122938

SEQ ID NO: 123127 - DNA, 601 bp, Human; identical to SEQ ID NO: 122939

SEQ ID NO: 123128 - DNA, 601 bp, Human; identical to SEQ ID NO: 122940

SEQ ID NO: 123129 - DNA, 601 bp, Human; identical to SEQ ID NO: 122941

SEQ ID NO: 123130 - DNA, 601 bp, Human; identical to SEQ ID NO: 122942

SEQ ID NO: 123131 - DNA, 601 bp, Human; identical to SEQ ID NO: 122943

SEQ ID NO: 123132 - DNA, 601 bp, Human; identical to SEQ ID NO: 122944

SEQ ID NO: 123133 - DNA, 601 bp, Human; identical to SEQ ID NO: 122945

SEQ ID NO: 123134 - DNA, 601 bp, Human; identical to SEQ ID NO: 122946

SEQ ID NO: 123135 - DNA, 601 bp, Human; identical to SEQ ID NO: 122947

SEQ ID NO: 123136 - DNA, 601 bp, Human; identical to SEQ ID NO: 122948

SEQ ID NO: 123137 - DNA, 601 bp, Human; identical to SEQ ID NO: 122949

SEQ ID NO: 123138 - DNA, 601 bp, Human; identical to SEQ ID NO: 122950

SEQ ID NO: 123139 - DNA, 601 bp, Human; identical to SEQ ID NO: 122951

SEQ ID NO: 123140 - DNA, 601 bp, Human; identical to SEQ ID NO: 122952

SEQ ID NO: 123141 - DNA, 601 bp, Human; identical to SEQ ID NO: 122953

SEQ ID NO: 123142 - DNA, 601 bp, Human; identical to SEQ ID NO: 122954

SEQ ID NO: 123143 - DNA, 601 bp, Human; identical to SEQ ID NO: 122955

SEQ ID NO: 123144 - DNA, 601 bp, Human; identical to SEQ ID NO: 122956

SEQ ID NO: 123145 - DNA, 601 bp, Human; identical to SEQ ID NO: 122957

SEQ ID NO: 123146 - DNA, 601 bp, Human; identical to SEQ ID NO: 122958

SEQ ID NO: 123147 - DNA, 601 bp, Human; identical to SEQ ID NO: 122959

SEQ ID NO: 123148 - DNA, 601 bp, Human; identical to SEQ ID NO: 122960

SEQ ID NO: 123149 - DNA, 601 bp, Human; identical to SEQ ID NO: 122961

SEQ ID NO: 123150 - DNA, 601 bp, Human; identical to SEQ ID NO: 122962

SEQ ID NO: 123151 - DNA, 601 bp, Human; identical to SEQ ID NO: 122963

SEQ ID NO: 123152 - DNA, 601 bp, Human; identical to SEQ ID NO: 122964

SEQ ID NO: 123153 - DNA, 601 bp, Human; identical to SEQ ID NO: 122965

SEQ ID NO: 123154 - DNA, 601 bp, Human; identical to SEQ ID NO: 122966

SEQ ID NO: 123155 - DNA, 601 bp, Human; identical to SEQ ID NO: 122967

SEQ ID NO: 123156 - DNA, 601 bp, Human; identical to SEQ ID NO: 122968

SEQ ID NO: 123157 - DNA, 601 bp, Human; identical to SEQ ID NO: 122969

SEQ ID NO: 123158 - DNA, 601 bp, Human; identical to SEQ ID NO: 122970

SEQ ID NO: 123159 - DNA, 601 bp, Human; identical to SEQ ID NO: 122971

SEQ ID NO: 123160 - DNA, 601 bp, Human; identical to SEQ ID NO: 122972

SEQ ID NO: 123161 - DNA, 601 bp, Human; identical to SEQ ID NO: 122973

SEQ ID NO: 123162 - DNA, 601 bp, Human; identical to SEQ ID NO: 122974

SEQ ID NO: 123163 - DNA, 601 bp, Human; identical to SEQ ID NO: 122975

SEQ ID NO: 123164 - DNA, 601 bp, Human; identical to SEQ ID NO: 122976

SEQ ID NO: 123165 - DNA, 601 bp, Human; identical to SEQ ID NO: 122883

SEQ ID NO: 123166 - DNA, 601 bp, Human; identical to SEQ ID NO: 122884

SEQ ID NO: 123167 - DNA, 601 bp, Human; identical to SEQ ID NO: 122885

SEQ ID NO: 123168 - DNA, 601 bp, Human; identical to SEQ ID NO: 122886

SEQ ID NO: 123169 - DNA, 601 bp, Human; identical to SEQ ID NO: 122887

SEQ ID NO: 123170 - DNA, 601 bp, Human; identical to SEQ ID NO: 122888

SEQ ID NO: 123171 - DNA, 601 bp, Human; identical to SEQ ID NO: 122889

SEQ ID NO: 123172 - DNA, 601 bp, Human; identical to SEQ ID NO: 122890

SEQ ID NO: 123173 - DNA, 601 bp, Human; identical to SEQ ID NO: 122891

SEQ ID NO: 123174 - DNA, 601 bp, Human; identical to SEQ ID NO: 122892

SEQ ID NO: 123175 - DNA, 601 bp, Human; identical to SEQ ID NO: 122893

SEQ ID NO: 123176 - DNA, 601 bp, Human; identical to SEQ ID NO: 122894

SEQ ID NO: 123177 - DNA, 601 bp, Human; identical to SEQ ID NO: 122895

SEQ ID NO: 123178 - DNA, 601 bp, Human; identical to SEQ ID NO: 122896

SEQ ID NO: 123179 - DNA, 601 bp, Human; identical to SEQ ID NO: 122897

SEQ ID NO: 123180 - DNA, 601 bp, Human; identical to SEQ ID NO: 122898

SEQ ID NO: 123181 - DNA, 601 bp, Human; identical to SEQ ID NO: 122899

SEQ ID NO: 123182 - DNA, 601 bp, Human; identical to SEQ ID NO: 122900

SEQ ID NO: 123183 - DNA, 601 bp, Human; identical to SEQ ID NO: 122901

SEQ ID NO: 123184 - DNA, 601 bp, Human; identical to SEQ ID NO: 122902

SEQ ID NO: 123185 - DNA, 601 bp, Human; identical to SEQ ID NO: 122903

SEQ ID NO: 123186 - DNA, 601 bp, Human; identical to SEQ ID NO: 122904

SEQ ID NO: 123187 - DNA, 601 bp, Human; identical to SEQ ID NO: 122905

SEQ ID NO: 123188 - DNA, 601 bp, Human; identical to SEQ ID NO: 122906

SEQ ID NO: 123189 - DNA, 601 bp, Human; identical to SEQ ID NO: 122907

SEQ ID NO: 123190 - DNA, 601 bp, Human; identical to SEQ ID NO: 122908

SEQ ID NO: 123191 - DNA, 601 bp, Human; identical to SEQ ID NO: 122909

SEQ ID NO: 123192 - DNA, 601 bp, Human; identical to SEQ ID NO: 122910

SEQ ID NO: 123193 - DNA, 601 bp, Human; identical to SEQ ID NO: 122911

SEQ ID NO: 123194 - DNA, 601 bp, Human; identical to SEQ ID NO: 122912

SEQ ID NO: 123195 - DNA, 601 bp, Human; identical to SEQ ID NO: 122913

SEQ ID NO: 123196 - DNA, 601 bp, Human; identical to SEQ ID NO: 122914

SEQ ID NO: 123197 - DNA, 601 bp, Human; identical to SEQ ID NO: 122915

SEQ ID NO: 123198 - DNA, 601 bp, Human; identical to SEQ ID NO: 122916

SEQ ID NO: 123199 - DNA, 601 bp, Human; identical to SEQ ID NO: 122917

SEQ ID NO: 123200 - DNA, 601 bp, Human; identical to SEQ ID NO: 122918

SEQ ID NO: 123201 - DNA, 601 bp, Human; identical to SEQ ID NO: 122919

SEQ ID NO: 123202 - DNA, 601 bp, Human; identical to SEQ ID NO: 122920

SEQ ID NO: 123203 - DNA, 601 bp, Human; identical to SEQ ID NO: 122921

SEQ ID NO: 123204 - DNA, 601 bp, Human; identical to SEQ ID NO: 122922

SEQ ID NO: 123205 - DNA, 601 bp, Human; identical to SEQ ID NO: 122923

SEQ ID NO: 123206 - DNA, 601 bp, Human; identical to SEQ ID NO: 122924

SEQ ID NO: 123207 - DNA, 601 bp, Human; identical to SEQ ID NO: 122925

SEQ ID NO: 123208 - DNA, 601 bp, Human; identical to SEQ ID NO: 122926

SEQ ID NO: 123209 - DNA, 601 bp, Human; identical to SEQ ID NO: 122927

SEQ ID NO: 123210 - DNA, 601 bp, Human; identical to SEQ ID NO: 122928

SEQ ID NO: 123211 - DNA, 601 bp, Human; identical to SEQ ID NO: 122929

SEQ ID NO: 123212 - DNA, 601 bp, Human; identical to SEQ ID NO: 122930

SEQ ID NO: 123213 - DNA, 601 bp, Human; identical to SEQ ID NO: 122931

SEQ ID NO: 123214 - DNA, 601 bp, Human; identical to SEQ ID NO: 122932

SEQ ID NO: 123215 - DNA, 601 bp, Human; identical to SEQ ID NO: 122933

SEQ ID NO: 123216 - DNA, 601 bp, Human; identical to SEQ ID NO: 122934

SEQ ID NO: 123217 - DNA, 601 bp, Human; identical to SEQ ID NO: 122935

SEQ ID NO: 123218 - DNA, 601 bp, Human; identical to SEQ ID NO: 122936

SEQ ID NO: 123219 - DNA, 601 bp, Human; identical to SEQ ID NO: 122937

SEQ ID NO: 123220 - DNA, 601 bp, Human; identical to SEQ ID NO: 122938

SEQ ID NO: 123221 - DNA, 601 bp, Human; identical to SEQ ID NO: 122939

SEQ ID NO: 123222 - DNA, 601 bp, Human; identical to SEQ ID NO: 122940

SEQ ID NO: 123223 - DNA, 601 bp, Human; identical to SEQ ID NO: 122941

SEQ ID NO: 123224 - DNA, 601 bp, Human; identical to SEQ ID NO: 122942

SEQ ID NO: 123225 - DNA, 601 bp, Human; identical to SEQ ID NO: 122943

SEQ ID NO: 123226 - DNA, 601 bp, Human; identical to SEQ ID NO: 122944

SEQ ID NO: 123227 - DNA, 601 bp, Human; identical to SEQ ID NO: 122945

SEQ ID NO: 123228 - DNA, 601 bp, Human; identical to SEQ ID NO: 122946

SEQ ID NO: 123229 - DNA, 601 bp, Human; identical to SEQ ID NO: 122947

SEQ ID NO: 123230 - DNA, 601 bp, Human; identical to SEQ ID NO: 122948

SEQ ID NO: 123231 - DNA, 601 bp, Human; identical to SEQ ID NO: 122949

SEQ ID NO: 123232 - DNA, 601 bp, Human; identical to SEQ ID NO: 122950

SEQ ID NO: 123233 - DNA, 601 bp, Human; identical to SEQ ID NO: 122951

SEQ ID NO: 123234 - DNA, 601 bp, Human; identical to SEQ ID NO: 122952

SEQ ID NO: 123235 - DNA, 601 bp, Human; identical to SEQ ID NO: 122953

SEQ ID NO: 123236 - DNA, 601 bp, Human; identical to SEQ ID NO: 122954

SEQ ID NO: 123237 - DNA, 601 bp, Human; identical to SEQ ID NO: 122955

SEQ ID NO: 123238 - DNA, 601 bp, Human; identical to SEQ ID NO: 122956

SEQ ID NO: 123239 - DNA, 601 bp, Human; identical to SEQ ID NO: 122957

SEQ ID NO: 123240 - DNA, 601 bp, Human; identical to SEQ ID NO: 122958

SEQ ID NO: 123241 - DNA, 601 bp, Human; identical to SEQ ID NO: 122959

SEQ ID NO: 123242 - DNA, 601 bp, Human; identical to SEQ ID NO: 122960

SEQ ID NO: 123243 - DNA, 601 bp, Human; identical to SEQ ID NO: 122961

SEQ ID NO: 123244 - DNA, 601 bp, Human; identical to SEQ ID NO: 122962

SEQ ID NO: 123245 - DNA, 601 bp, Human; identical to SEQ ID NO: 122963

SEQ ID NO: 123246 - DNA, 601 bp, Human; identical to SEQ ID NO: 122964

SEQ ID NO: 123247 - DNA, 601 bp, Human; identical to SEQ ID NO: 122965

SEQ ID NO: 123248 - DNA, 601 bp, Human; identical to SEQ ID NO: 122966

SEQ ID NO: 123249 - DNA, 601 bp, Human; identical to SEQ ID NO: 122967

SEQ ID NO: 123250 - DNA, 601 bp, Human; identical to SEQ ID NO: 122968

SEQ ID NO: 123251 - DNA, 601 bp, Human; identical to SEQ ID NO: 122969

SEQ ID NO: 123252 - DNA, 601 bp, Human; identical to SEQ ID NO: 122970

SEQ ID NO: 123253 - DNA, 601 bp, Human; identical to SEQ ID NO: 122971

SEQ ID NO: 123254 - DNA, 601 bp, Human; identical to SEQ ID NO: 122972

SEQ ID NO: 123255 - DNA, 601 bp, Human; identical to SEQ ID NO: 122973

SEQ ID NO: 123256 - DNA, 601 bp, Human; identical to SEQ ID NO: 122974

SEQ ID NO: 123257 - DNA, 601 bp, Human; identical to SEQ ID NO: 122975

SEQ ID NO: 123258 - DNA, 601 bp, Human; identical to SEQ ID NO: 122976

SEQ ID NO: 123259 - DNA, 601 bp, Human; identical to SEQ ID NO: 122883

SEQ ID NO: 123260 - DNA, 601 bp, Human; identical to SEQ ID NO: 122884

SEQ ID NO: 123261 - DNA, 601 bp, Human; identical to SEQ ID NO: 122885

SEQ ID NO: 123262 - DNA, 601 bp, Human; identical to SEQ ID NO: 122886

SEQ ID NO: 123263 - DNA, 601 bp, Human; identical to SEQ ID NO: 122887

SEQ ID NO: 123264 - DNA, 601 bp, Human; identical to SEQ ID NO: 122888

SEQ ID NO: 123265 - DNA, 601 bp, Human; identical to SEQ ID NO: 122889

SEQ ID NO: 123266 - DNA, 601 bp, Human; identical to SEQ ID NO: 122890

SEQ ID NO: 123267 - DNA, 601 bp, Human; identical to SEQ ID NO: 122891

SEQ ID NO: 123268 - DNA, 601 bp, Human; identical to SEQ ID NO: 122892

SEQ ID NO: 123269 - DNA, 601 bp, Human; identical to SEQ ID NO: 122893

SEQ ID NO: 123270 - DNA, 601 bp, Human; identical to SEQ ID NO: 122894

SEQ ID NO: 123271 - DNA, 601 bp, Human; identical to SEQ ID NO: 122895

SEQ ID NO: 123272 - DNA, 601 bp, Human; identical to SEQ ID NO: 122896

SEQ ID NO: 123273 - DNA, 601 bp, Human; identical to SEQ ID NO: 122897

SEQ ID NO: 123274 - DNA, 601 bp, Human; identical to SEQ ID NO: 122898

SEQ ID NO: 123275 - DNA, 601 bp, Human; identical to SEQ ID NO: 122899

SEQ ID NO: 123276 - DNA, 601 bp, Human; identical to SEQ ID NO: 122900

SEQ ID NO: 123277 - DNA, 601 bp, Human; identical to SEQ ID NO: 122901

SEQ ID NO: 123278 - DNA, 601 bp, Human; identical to SEQ ID NO: 122902

SEQ ID NO: 123279 - DNA, 601 bp, Human; identical to SEQ ID NO: 122903

SEQ ID NO: 123280 - DNA, 601 bp, Human; identical to SEQ ID NO: 122904

SEQ ID NO: 123281 - DNA, 601 bp, Human; identical to SEQ ID NO: 122905

SEQ ID NO: 123282 - DNA, 601 bp, Human; identical to SEQ ID NO: 122906

SEQ ID NO: 123283 - DNA, 601 bp, Human; identical to SEQ ID NO: 122907

SEQ ID NO: 123284 - DNA, 601 bp, Human; identical to SEQ ID NO: 122908

SEQ ID NO: 123285 - DNA, 601 bp, Human; identical to SEQ ID NO: 122909

SEQ ID NO: 123286 - DNA, 601 bp, Human; identical to SEQ ID NO: 122910

SEQ ID NO: 123287 - DNA, 601 bp, Human; identical to SEQ ID NO: 122911

SEQ ID NO: 123288 - DNA, 601 bp, Human; identical to SEQ ID NO: 122912

SEQ ID NO: 123289 - DNA, 601 bp, Human; identical to SEQ ID NO: 122913

SEQ ID NO: 123290 - DNA, 601 bp, Human; identical to SEQ ID NO: 122914

SEQ ID NO: 123291 - DNA, 601 bp, Human; identical to SEQ ID NO: 122915

SEQ ID NO: 123292 - DNA, 601 bp, Human; identical to SEQ ID NO: 122916

SEQ ID NO: 123293 - DNA, 601 bp, Human; identical to SEQ ID NO: 122917

SEQ ID NO: 123294 - DNA, 601 bp, Human; identical to SEQ ID NO: 122918

SEQ ID NO: 123295 - DNA, 601 bp, Human; identical to SEQ ID NO: 122919

SEQ ID NO: 123296 - DNA, 601 bp, Human; identical to SEQ ID NO: 122920

SEQ ID NO: 123297 - DNA, 601 bp, Human; identical to SEQ ID NO: 122921

SEQ ID NO: 123298 - DNA, 601 bp, Human; identical to SEQ ID NO: 122922

SEQ ID NO: 123299 - DNA, 601 bp, Human; identical to SEQ ID NO: 122923

SEQ ID NO: 123300 - DNA, 601 bp, Human; identical to SEQ ID NO: 122924

SEQ ID NO: 123301 - DNA, 601 bp, Human; identical to SEQ ID NO: 122925

SEQ ID NO: 123302 - DNA, 601 bp, Human; identical to SEQ ID NO: 122926

SEQ ID NO: 123303 - DNA, 601 bp, Human; identical to SEQ ID NO: 122927

SEQ ID NO: 123304 - DNA, 601 bp, Human; identical to SEQ ID NO: 122928

SEQ ID NO: 123305 - DNA, 601 bp, Human; identical to SEQ ID NO: 122929

SEQ ID NO: 123306 - DNA, 601 bp, Human; identical to SEQ ID NO: 122930

SEQ ID NO: 123307 - DNA, 601 bp, Human; identical to SEQ ID NO: 122931

SEQ ID NO: 123308 - DNA, 601 bp, Human; identical to SEQ ID NO: 122932

SEQ ID NO: 123309 - DNA, 601 bp, Human; identical to SEQ ID NO: 122933

SEQ ID NO: 123310 - DNA, 601 bp, Human; identical to SEQ ID NO: 122934

SEQ ID NO: 123311 - DNA, 601 bp, Human; identical to SEQ ID NO: 122935

SEQ ID NO: 123312 - DNA, 601 bp, Human; identical to SEQ ID NO: 122936

SEQ ID NO: 123313 - DNA, 601 bp, Human; identical to SEQ ID NO: 122937

SEQ ID NO: 123314 - DNA, 601 bp, Human; identical to SEQ ID NO: 122938

SEQ ID NO: 123315 - DNA, 601 bp, Human; identical to SEQ ID NO: 122939

SEQ ID NO: 123316 - DNA, 601 bp, Human; identical to SEQ ID NO: 122940

SEQ ID NO: 123317 - DNA, 601 bp, Human; identical to SEQ ID NO: 122941

SEQ ID NO: 123318 - DNA, 601 bp, Human; identical to SEQ ID NO: 122942

SEQ ID NO: 123319 - DNA, 601 bp, Human; identical to SEQ ID NO: 122943

SEQ ID NO: 123320 - DNA, 601 bp, Human; identical to SEQ ID NO: 122944

SEQ ID NO: 123321 - DNA, 601 bp, Human; identical to SEQ ID NO: 122945

SEQ ID NO: 123322 - DNA, 601 bp, Human; identical to SEQ ID NO: 122946

SEQ ID NO: 123323 - DNA, 601 bp, Human; identical to SEQ ID NO: 122947

SEQ ID NO: 123324 - DNA, 601 bp, Human; identical to SEQ ID NO: 122948

SEQ ID NO: 123325 - DNA, 601 bp, Human; identical to SEQ ID NO: 122949

SEQ ID NO: 123326 - DNA, 601 bp, Human; identical to SEQ ID NO: 122950

SEQ ID NO: 123327 - DNA, 601 bp, Human; identical to SEQ ID NO: 122951

SEQ ID NO: 123328 - DNA, 601 bp, Human; identical to SEQ ID NO: 122952

SEQ ID NO: 123329 - DNA, 601 bp, Human; identical to SEQ ID NO: 122953

SEQ ID NO: 123330 - DNA, 601 bp, Human; identical to SEQ ID NO: 122954

SEQ ID NO: 123331 - DNA, 601 bp, Human; identical to SEQ ID NO: 122955

SEQ ID NO: 123332 - DNA, 601 bp, Human; identical to SEQ ID NO: 122956

SEQ ID NO: 123333 - DNA, 601 bp, Human; identical to SEQ ID NO: 122957

SEQ ID NO: 123334 - DNA, 601 bp, Human; identical to SEQ ID NO: 122958

SEQ ID NO: 123335 - DNA, 601 bp, Human; identical to SEQ ID NO: 122959

SEQ ID NO: 123336 - DNA, 601 bp, Human; identical to SEQ ID NO: 122960

SEQ ID NO: 123337 - DNA, 601 bp, Human; identical to SEQ ID NO: 122961

SEQ ID NO: 123338 - DNA, 601 bp, Human; identical to SEQ ID NO: 122962

SEQ ID NO: 123339 - DNA, 601 bp, Human; identical to SEQ ID NO: 122963

SEQ ID NO: 123340 - DNA, 601 bp, Human; identical to SEQ ID NO: 122964

SEQ ID NO: 123341 - DNA, 601 bp, Human; identical to SEQ ID NO: 122965

SEQ ID NO: 123342 - DNA, 601 bp, Human; identical to SEQ ID NO: 122966

SEQ ID NO: 123343 - DNA, 601 bp, Human; identical to SEQ ID NO: 122967

SEQ ID NO: 123344 - DNA, 601 bp, Human; identical to SEQ ID NO: 122968

SEQ ID NO: 123345 - DNA, 601 bp, Human; identical to SEQ ID NO: 122969

SEQ ID NO: 123346 - DNA, 601 bp, Human; identical to SEQ ID NO: 122970

SEQ ID NO: 123347 - DNA, 601 bp, Human; identical to SEQ ID NO: 122971

SEQ ID NO: 123348 - DNA, 601 bp, Human; identical to SEQ ID NO: 122972

SEQ ID NO: 123349 - DNA, 601 bp, Human; identical to SEQ ID NO: 122973

SEQ ID NO: 123350 - DNA, 601 bp, Human; identical to SEQ ID NO: 122974

SEQ ID NO: 123351 - DNA, 601 bp, Human; identical to SEQ ID NO: 122975

SEQ ID NO: 123352 - DNA, 601 bp, Human; identical to SEQ ID NO: 122976

SEQ ID NO: 123353 - DNA, 601 bp, Human; identical to SEQ ID NO: 122935

SEQ ID NO: 123354 - DNA, 601 bp, Human; identical to SEQ ID NO: 122936

SEQ ID NO: 123355 - DNA, 601 bp, Human; identical to SEQ ID NO: 122937

SEQ ID NO: 123356 - DNA, 601 bp, Human; identical to SEQ ID NO: 122938

SEQ ID NO: 123357 - DNA, 601 bp, Human; identical to SEQ ID NO: 122939

SEQ ID NO: 123358 - DNA, 601 bp, Human; identical to SEQ ID NO: 122940

SEQ ID NO: 123359 - DNA, 601 bp, Human; identical to SEQ ID NO: 122941

SEQ ID NO: 123360 - DNA, 601 bp, Human; identical to SEQ ID NO: 122942

SEQ ID NO: 123361 - DNA, 601 bp, Human; identical to SEQ ID NO: 122943

SEQ ID NO: 123362 - DNA, 601 bp, Human; identical to SEQ ID NO: 122944

SEQ ID NO: 123363 - DNA, 601 bp, Human; identical to SEQ ID NO: 122945

SEQ ID NO: 123364 - DNA, 601 bp, Human; identical to SEQ ID NO: 122946

SEQ ID NO: 123365 - DNA, 601 bp, Human; identical to SEQ ID NO: 122947

SEQ ID NO: 123366 - DNA, 601 bp, Human; identical to SEQ ID NO: 122948

SEQ ID NO: 123367 - DNA, 601 bp, Human; identical to SEQ ID NO: 122949

SEQ ID NO: 123368 - DNA, 601 bp, Human; identical to SEQ ID NO: 122950

SEQ ID NO: 123369 - DNA, 601 bp, Human; identical to SEQ ID NO: 122951

SEQ ID NO: 123370 - DNA, 601 bp, Human; identical to SEQ ID NO: 122952

SEQ ID NO: 123371 - DNA, 601 bp, Human; identical to SEQ ID NO: 122953

SEQ ID NO: 123372 - DNA, 601 bp, Human; identical to SEQ ID NO: 122954

SEQ ID NO: 123373 - DNA, 601 bp, Human; identical to SEQ ID NO: 122955

SEQ ID NO: 123374 - DNA, 601 bp, Human; identical to SEQ ID NO: 122956

SEQ ID NO: 123375 - DNA, 601 bp, Human; identical to SEQ ID NO: 122957

SEQ ID NO: 123376 - DNA, 601 bp, Human; identical to SEQ ID NO: 122958

SEQ ID NO: 123377 - DNA, 601 bp, Human; identical to SEQ ID NO: 122959

SEQ ID NO: 123378 - DNA, 601 bp, Human; identical to SEQ ID NO: 122960

SEQ ID NO: 123379 - DNA, 601 bp, Human; identical to SEQ ID NO: 122961

SEQ ID NO: 123380 - DNA, 601 bp, Human; identical to SEQ ID NO: 122962

SEQ ID NO: 123381 - DNA, 601 bp, Human; identical to SEQ ID NO: 122963

SEQ ID NO: 123382 - DNA, 601 bp, Human; identical to SEQ ID NO: 122964

SEQ ID NO: 123383 - DNA, 601 bp, Human; identical to SEQ ID NO: 122965

SEQ ID NO: 123384 - DNA, 601 bp, Human; identical to SEQ ID NO: 122966

SEQ ID NO: 123385 - DNA, 601 bp, Human; identical to SEQ ID NO: 122967

SEQ ID NO: 123386 - DNA, 601 bp, Human; identical to SEQ ID NO: 122968

SEQ ID NO: 123387 - DNA, 601 bp, Human; identical to SEQ ID NO: 122969

SEQ ID NO: 123388 - DNA, 601 bp, Human; identical to SEQ ID NO: 122970

SEQ ID NO: 123389 - DNA, 601 bp, Human; identical to SEQ ID NO: 122971

SEQ ID NO: 123390 - DNA, 601 bp, Human; identical to SEQ ID NO: 122972

SEQ ID NO: 123391 - DNA, 601 bp, Human; identical to SEQ ID NO: 122973

SEQ ID NO: 123392 - DNA, 601 bp, Human; identical to SEQ ID NO: 122974

SEQ ID NO: 123393 - DNA, 601 bp, Human; identical to SEQ ID NO: 122975

SEQ ID NO: 123394 - DNA, 601 bp, Human; identical to SEQ ID NO: 122976

SEQ ID NO: 123395 - DNA, 601 bp, Human; identical to SEQ ID NO: 122935

SEQ ID NO: 123396 - DNA, 601 bp, Human; identical to SEQ ID NO: 122936

SEQ ID NO: 123397 - DNA, 601 bp, Human; identical to SEQ ID NO: 122937

SEQ ID NO: 123398 - DNA, 601 bp, Human; identical to SEQ ID NO: 122938

SEQ ID NO: 123399 - DNA, 601 bp, Human; identical to SEQ ID NO: 122939

SEQ ID NO: 123400 - DNA, 601 bp, Human; identical to SEQ ID NO: 122940

SEQ ID NO: 123401 - DNA, 601 bp, Human; identical to SEQ ID NO: 122941

SEQ ID NO: 123402 - DNA, 601 bp, Human; identical to SEQ ID NO: 122942

SEQ ID NO: 123403 - DNA, 601 bp, Human; identical to SEQ ID NO: 122943

SEQ ID NO: 123404 - DNA, 601 bp, Human; identical to SEQ ID NO: 122944

SEQ ID NO: 123405 - DNA, 601 bp, Human; identical to SEQ ID NO: 122945

SEQ ID NO: 123406 - DNA, 601 bp, Human; identical to SEQ ID NO: 122946

SEQ ID NO: 123407 - DNA, 601 bp, Human; identical to SEQ ID NO: 122947

SEQ ID NO: 123408 - DNA, 601 bp, Human; identical to SEQ ID NO: 122948

SEQ ID NO: 123409 - DNA, 601 bp, Human; identical to SEQ ID NO: 122949

SEQ ID NO: 123410 - DNA, 601 bp, Human; identical to SEQ ID NO: 122950

SEQ ID NO: 123411 - DNA, 601 bp, Human; identical to SEQ ID NO: 122951

SEQ ID NO: 123412 - DNA, 601 bp, Human; identical to SEQ ID NO: 122952

SEQ ID NO: 123413 - DNA, 601 bp, Human; identical to SEQ ID NO: 122953

SEQ ID NO: 123414 - DNA, 601 bp, Human; identical to SEQ ID NO: 122954

SEQ ID NO: 123415 - DNA, 601 bp, Human; identical to SEQ ID NO: 122955

SEQ ID NO: 123416 - DNA, 601 bp, Human; identical to SEQ ID NO: 122956

SEQ ID NO: 123417 - DNA, 601 bp, Human; identical to SEQ ID NO: 122957

SEQ ID NO: 123418 - DNA, 601 bp, Human; identical to SEQ ID NO: 122958

SEQ ID NO: 123419 - DNA, 601 bp, Human; identical to SEQ ID NO: 122959

SEQ ID NO: 123420 - DNA, 601 bp, Human; identical to SEQ ID NO: 122960

SEQ ID NO: 123421 - DNA, 601 bp, Human; identical to SEQ ID NO: 122961

SEQ ID NO: 123422 - DNA, 601 bp, Human; identical to SEQ ID NO: 122962

SEQ ID NO: 123423 - DNA, 601 bp, Human; identical to SEQ ID NO: 122963

SEQ ID NO: 123424 - DNA, 601 bp, Human; identical to SEQ ID NO: 122964

SEQ ID NO: 123425 - DNA, 601 bp, Human; identical to SEQ ID NO: 122965

SEQ ID NO: 123426 - DNA, 601 bp, Human; identical to SEQ ID NO: 122966

SEQ ID NO: 123427 - DNA, 601 bp, Human; identical to SEQ ID NO: 122967

SEQ ID NO: 123428 - DNA, 601 bp, Human; identical to SEQ ID NO: 122968

SEQ ID NO: 123429 - DNA, 601 bp, Human; identical to SEQ ID NO: 122969

SEQ ID NO: 123430 - DNA, 601 bp, Human; identical to SEQ ID NO: 122970

SEQ ID NO: 123431 - DNA, 601 bp, Human; identical to SEQ ID NO: 122971

SEQ ID NO: 123432 - DNA, 601 bp, Human; identical to SEQ ID NO: 122972

SEQ ID NO: 123433 - DNA, 601 bp, Human; identical to SEQ ID NO: 122973

SEQ ID NO: 123434 - DNA, 601 bp, Human; identical to SEQ ID NO: 122974

SEQ ID NO: 123435 - DNA, 601 bp, Human; identical to SEQ ID NO: 122975

SEQ ID NO: 123436 - DNA, 601 bp, Human; identical to SEQ ID NO: 122976

SEQ ID NO: 123437 - DNA, 601 bp, Human; identical to SEQ ID NO: 122935

SEQ ID NO: 123438 - DNA, 601 bp, Human; identical to SEQ ID NO: 122936

SEQ ID NO: 123439 - DNA, 601 bp, Human; identical to SEQ ID NO: 122937

SEQ ID NO: 123440 - DNA, 601 bp, Human; identical to SEQ ID NO: 122938

SEQ ID NO: 123441 - DNA, 601 bp, Human; identical to SEQ ID NO: 122939

SEQ ID NO: 123442 - DNA, 601 bp, Human; identical to SEQ ID NO: 122940

SEQ ID NO: 123443 - DNA, 601 bp, Human; identical to SEQ ID NO: 122941

SEQ ID NO: 123444 - DNA, 601 bp, Human; identical to SEQ ID NO: 122942

SEQ ID NO: 123445 - DNA, 601 bp, Human; identical to SEQ ID NO: 122943

SEQ ID NO: 123446 - DNA, 601 bp, Human; identical to SEQ ID NO: 122944

SEQ ID NO: 123447 - DNA, 601 bp, Human; identical to SEQ ID NO: 122945

SEQ ID NO: 123448 - DNA, 601 bp, Human; identical to SEQ ID NO: 122946

SEQ ID NO: 123449 - DNA, 601 bp, Human; identical to SEQ ID NO: 122947

SEQ ID NO: 123450 - DNA, 601 bp, Human; identical to SEQ ID NO: 122948

SEQ ID NO: 123451 - DNA, 601 bp, Human; identical to SEQ ID NO: 122949

SEQ ID NO: 123452 - DNA, 601 bp, Human; identical to SEQ ID NO: 122950

SEQ ID NO: 123453 - DNA, 601 bp, Human; identical to SEQ ID NO: 122951

SEQ ID NO: 123454 - DNA, 601 bp, Human; identical to SEQ ID NO: 122952

SEQ ID NO: 123455 - DNA, 601 bp, Human; identical to SEQ ID NO: 122953

SEQ ID NO: 123456 - DNA, 601 bp, Human; identical to SEQ ID NO: 122954

SEQ ID NO: 123457 - DNA, 601 bp, Human; identical to SEQ ID NO: 122955

SEQ ID NO: 123458 - DNA, 601 bp, Human; identical to SEQ ID NO: 122956

SEQ ID NO: 123459 - DNA, 601 bp, Human; identical to SEQ ID NO: 122957

SEQ ID NO: 123460 - DNA, 601 bp, Human; identical to SEQ ID NO: 122958

SEQ ID NO: 123461 - DNA, 601 bp, Human; identical to SEQ ID NO: 122959

SEQ ID NO: 123462 - DNA, 601 bp, Human; identical to SEQ ID NO: 122960

SEQ ID NO: 123463 - DNA, 601 bp, Human; identical to SEQ ID NO: 122961

SEQ ID NO: 123464 - DNA, 601 bp, Human; identical to SEQ ID NO: 122962

SEQ ID NO: 123465 - DNA, 601 bp, Human; identical to SEQ ID NO: 122963

SEQ ID NO: 123466 - DNA, 601 bp, Human; identical to SEQ ID NO: 122964

SEQ ID NO: 123467 - DNA, 601 bp, Human; identical to SEQ ID NO: 122965

SEQ ID NO: 123468 - DNA, 601 bp, Human; identical to SEQ ID NO: 122966

SEQ ID NO: 123469 - DNA, 601 bp, Human; identical to SEQ ID NO: 122967

SEQ ID NO: 123470 - DNA, 601 bp, Human; identical to SEQ ID NO: 122968

SEQ ID NO: 123471 - DNA, 601 bp, Human; identical to SEQ ID NO: 122969

SEQ ID NO: 123472 - DNA, 601 bp, Human; identical to SEQ ID NO: 122970

SEQ ID NO: 123473 - DNA, 601 bp, Human; identical to SEQ ID NO: 122971

SEQ ID NO: 123474 - DNA, 601 bp, Human; identical to SEQ ID NO: 122972

SEQ ID NO: 123475 - DNA, 601 bp, Human; identical to SEQ ID NO: 122973

SEQ ID NO: 123476 - DNA, 601 bp, Human; identical to SEQ ID NO: 122974

SEQ ID NO: 123477 - DNA, 601 bp, Human; identical to SEQ ID NO: 122975

SEQ ID NO: 123478 - DNA, 601 bp, Human; identical to SEQ ID NO: 122976

SEQ ID NO: 123479 - DNA, 601 bp, Human; identical to SEQ ID NO: 122935

SEQ ID NO: 123480 - DNA, 601 bp, Human; identical to SEQ ID NO: 122936

SEQ ID NO: 123481 - DNA, 601 bp, Human; identical to SEQ ID NO: 122937

SEQ ID NO: 123482 - DNA, 601 bp, Human; identical to SEQ ID NO: 122938

SEQ ID NO: 123483 - DNA, 601 bp, Human; identical to SEQ ID NO: 122939

SEQ ID NO: 123484 - DNA, 601 bp, Human; identical to SEQ ID NO: 122940

SEQ ID NO: 123485 - DNA, 601 bp, Human; identical to SEQ ID NO: 122941

SEQ ID NO: 123486 - DNA, 601 bp, Human; identical to SEQ ID NO: 122942

SEQ ID NO: 123487 - DNA, 601 bp, Human; identical to SEQ ID NO: 122943

SEQ ID NO: 123488 - DNA, 601 bp, Human; identical to SEQ ID NO: 122944

SEQ ID NO: 123489 - DNA, 601 bp, Human; identical to SEQ ID NO: 122945

SEQ ID NO: 123490 - DNA, 601 bp, Human; identical to SEQ ID NO: 122946

SEQ ID NO: 123491 - DNA, 601 bp, Human; identical to SEQ ID NO: 122947

SEQ ID NO: 123492 - DNA, 601 bp, Human; identical to SEQ ID NO: 122948

SEQ ID NO: 123493 - DNA, 601 bp, Human; identical to SEQ ID NO: 122949

SEQ ID NO: 123494 - DNA, 601 bp, Human; identical to SEQ ID NO: 122950

SEQ ID NO: 123495 - DNA, 601 bp, Human; identical to SEQ ID NO: 122951

SEQ ID NO: 123496 - DNA, 601 bp, Human; identical to SEQ ID NO: 122952

SEQ ID NO: 123497 - DNA, 601 bp, Human; identical to SEQ ID NO: 122953

SEQ ID NO: 123498 - DNA, 601 bp, Human; identical to SEQ ID NO: 122954

SEQ ID NO: 123499 - DNA, 601 bp, Human; identical to SEQ ID NO: 122955

SEQ ID NO: 123500 - DNA, 601 bp, Human; identical to SEQ ID NO: 122956

SEQ ID NO: 123501 - DNA, 601 bp, Human; identical to SEQ ID NO: 122957

SEQ ID NO: 123502 - DNA, 601 bp, Human; identical to SEQ ID NO: 122958

SEQ ID NO: 123503 - DNA, 601 bp, Human; identical to SEQ ID NO: 122959

SEQ ID NO: 123504 - DNA, 601 bp, Human; identical to SEQ ID NO: 122960

SEQ ID NO: 123505 - DNA, 601 bp, Human; identical to SEQ ID NO: 122961

SEQ ID NO: 123506 - DNA, 601 bp, Human; identical to SEQ ID NO: 122962

SEQ ID NO: 123507 - DNA, 601 bp, Human; identical to SEQ ID NO: 122963

SEQ ID NO: 123508 - DNA, 601 bp, Human; identical to SEQ ID NO: 122964

SEQ ID NO: 123509 - DNA, 601 bp, Human; identical to SEQ ID NO: 122965

SEQ ID NO: 123510 - DNA, 601 bp, Human; identical to SEQ ID NO: 122966

SEQ ID NO: 123511 - DNA, 601 bp, Human; identical to SEQ ID NO: 122967

SEQ ID NO: 123512 - DNA, 601 bp, Human; identical to SEQ ID NO: 122968

SEQ ID NO: 123513 - DNA, 601 bp, Human; identical to SEQ ID NO: 122969

SEQ ID NO: 123514 - DNA, 601 bp, Human; identical to SEQ ID NO: 122970

SEQ ID NO: 123515 - DNA, 601 bp, Human; identical to SEQ ID NO: 122971

SEQ ID NO: 123516 - DNA, 601 bp, Human; identical to SEQ ID NO: 122972

SEQ ID NO: 123517 - DNA, 601 bp, Human; identical to SEQ ID NO: 122973

SEQ ID NO: 123518 - DNA, 601 bp, Human; identical to SEQ ID NO: 122974

SEQ ID NO: 123519 - DNA, 601 bp, Human; identical to SEQ ID NO: 122975

SEQ ID NO: 123520 - DNA, 601 bp, Human; identical to SEQ ID NO: 122976

SEQ ID NO: 123521 - DNA, 601 bp, Human; identical to SEQ ID NO: 122935

SEQ ID NO: 123522 - DNA, 601 bp, Human; identical to SEQ ID NO: 122936

SEQ ID NO: 123523 - DNA, 601 bp, Human; identical to SEQ ID NO: 122937

SEQ ID NO: 123524 - DNA, 601 bp, Human; identical to SEQ ID NO: 122938

SEQ ID NO: 123525 - DNA, 601 bp, Human; identical to SEQ ID NO: 122939

SEQ ID NO: 123526 - DNA, 601 bp, Human; identical to SEQ ID NO: 122940

SEQ ID NO: 123527 - DNA, 601 bp, Human; identical to SEQ ID NO: 122941

SEQ ID NO: 123528 - DNA, 601 bp, Human; identical to SEQ ID NO: 122942

SEQ ID NO: 123529 - DNA, 601 bp, Human; identical to SEQ ID NO: 122943

SEQ ID NO: 123530 - DNA, 601 bp, Human; identical to SEQ ID NO: 122944

SEQ ID NO: 123531 - DNA, 601 bp, Human; identical to SEQ ID NO: 122945

SEQ ID NO: 123532 - DNA, 601 bp, Human; identical to SEQ ID NO: 122946

SEQ ID NO: 123533 - DNA, 601 bp, Human; identical to SEQ ID NO: 122947

SEQ ID NO: 123534 - DNA, 601 bp, Human; identical to SEQ ID NO: 122948

SEQ ID NO: 123535 - DNA, 601 bp, Human; identical to SEQ ID NO: 122949

SEQ ID NO: 123536 - DNA, 601 bp, Human; identical to SEQ ID NO: 122950

SEQ ID NO: 123537 - DNA, 601 bp, Human; identical to SEQ ID NO: 122951

SEQ ID NO: 123538 - DNA, 601 bp, Human; identical to SEQ ID NO: 122952

SEQ ID NO: 123539 - DNA, 601 bp, Human; identical to SEQ ID NO: 122953

SEQ ID NO: 123540 - DNA, 601 bp, Human; identical to SEQ ID NO: 122954

SEQ ID NO: 123541 - DNA, 601 bp, Human; identical to SEQ ID NO: 122955

SEQ ID NO: 123542 - DNA, 601 bp, Human; identical to SEQ ID NO: 122956

SEQ ID NO: 123543 - DNA, 601 bp, Human; identical to SEQ ID NO: 122957

SEQ ID NO: 123544 - DNA, 601 bp, Human; identical to SEQ ID NO: 122958

SEQ ID NO: 123545 - DNA, 601 bp, Human; identical to SEQ ID NO: 122959

SEQ ID NO: 123546 - DNA, 601 bp, Human; identical to SEQ ID NO: 122960

SEQ ID NO: 123547 - DNA, 601 bp, Human; identical to SEQ ID NO: 122961

SEQ ID NO: 123548 - DNA, 601 bp, Human; identical to SEQ ID NO: 122962

SEQ ID NO: 123549 - DNA, 601 bp, Human; identical to SEQ ID NO: 122963

SEQ ID NO: 123550 - DNA, 601 bp, Human; identical to SEQ ID NO: 122964

SEQ ID NO: 123551 - DNA, 601 bp, Human; identical to SEQ ID NO: 122965

SEQ ID NO: 123552 - DNA, 601 bp, Human; identical to SEQ ID NO: 122966

SEQ ID NO: 123553 - DNA, 601 bp, Human; identical to SEQ ID NO: 122967

SEQ ID NO: 123554 - DNA, 601 bp, Human; identical to SEQ ID NO: 122968

SEQ ID NO: 123555 - DNA, 601 bp, Human; identical to SEQ ID NO: 122969

SEQ ID NO: 123556 - DNA, 601 bp, Human; identical to SEQ ID NO: 122970

SEQ ID NO: 123557 - DNA, 601 bp, Human; identical to SEQ ID NO: 122971

SEQ ID NO: 123558 - DNA, 601 bp, Human; identical to SEQ ID NO: 122972

SEQ ID NO: 123559 - DNA, 601 bp, Human; identical to SEQ ID NO: 122973

SEQ ID NO: 123560 - DNA, 601 bp, Human; identical to SEQ ID NO: 122974

SEQ ID NO: 123561 - DNA, 601 bp, Human; identical to SEQ ID NO: 122975

SEQ ID NO: 123562 - DNA, 601 bp, Human; identical to SEQ ID NO: 122976

SEQ ID NO: 123563 - DNA, 601 bp, Human; identical to SEQ ID NO: 122935

SEQ ID NO: 123564 - DNA, 601 bp, Human; identical to SEQ ID NO: 122936

SEQ ID NO: 123565 - DNA, 601 bp, Human; identical to SEQ ID NO: 122937

SEQ ID NO: 123566 - DNA, 601 bp, Human; identical to SEQ ID NO: 122938

SEQ ID NO: 123567 - DNA, 601 bp, Human; identical to SEQ ID NO: 122939

SEQ ID NO: 123568 - DNA, 601 bp, Human; identical to SEQ ID NO: 122940

SEQ ID NO: 123569 - DNA, 601 bp, Human; identical to SEQ ID NO: 122941

SEQ ID NO: 123570 - DNA, 601 bp, Human; identical to SEQ ID NO: 122942

SEQ ID NO: 123571 - DNA, 601 bp, Human; identical to SEQ ID NO: 122943

SEQ ID NO: 123572 - DNA, 601 bp, Human; identical to SEQ ID NO: 122944

SEQ ID NO: 123573 - DNA, 601 bp, Human; identical to SEQ ID NO: 122945

SEQ ID NO: 123574 - DNA, 601 bp, Human; identical to SEQ ID NO: 122946

SEQ ID NO: 123575 - DNA, 601 bp, Human; identical to SEQ ID NO: 122947

SEQ ID NO: 123576 - DNA, 601 bp, Human; identical to SEQ ID NO: 122948

SEQ ID NO: 123577 - DNA, 601 bp, Human; identical to SEQ ID NO: 122949

SEQ ID NO: 123578 - DNA, 601 bp, Human; identical to SEQ ID NO: 122950

SEQ ID NO: 123579 - DNA, 601 bp, Human; identical to SEQ ID NO: 122951

SEQ ID NO: 123580 - DNA, 601 bp, Human; identical to SEQ ID NO: 122952

SEQ ID NO: 123581 - DNA, 601 bp, Human; identical to SEQ ID NO: 122953

SEQ ID NO: 123582 - DNA, 601 bp, Human; identical to SEQ ID NO: 122954

SEQ ID NO: 123583 - DNA, 601 bp, Human; identical to SEQ ID NO: 122955

SEQ ID NO: 123584 - DNA, 601 bp, Human; identical to SEQ ID NO: 122956

SEQ ID NO: 123585 - DNA, 601 bp, Human; identical to SEQ ID NO: 122957

SEQ ID NO: 123586 - DNA, 601 bp, Human; identical to SEQ ID NO: 122958

SEQ ID NO: 123587 - DNA, 601 bp, Human; identical to SEQ ID NO: 122959

SEQ ID NO: 123588 - DNA, 601 bp, Human; identical to SEQ ID NO: 122960

SEQ ID NO: 123589 - DNA, 601 bp, Human; identical to SEQ ID NO: 122961

SEQ ID NO: 123590 - DNA, 601 bp, Human; identical to SEQ ID NO: 122962

SEQ ID NO: 123591 - DNA, 601 bp, Human; identical to SEQ ID NO: 122963

SEQ ID NO: 123592 - DNA, 601 bp, Human; identical to SEQ ID NO: 122964

SEQ ID NO: 123593 - DNA, 601 bp, Human; identical to SEQ ID NO: 122965

SEQ ID NO: 123594 - DNA, 601 bp, Human; identical to SEQ ID NO: 122966

SEQ ID NO: 123595 - DNA, 601 bp, Human; identical to SEQ ID NO: 122967

SEQ ID NO: 123596 - DNA, 601 bp, Human; identical to SEQ ID NO: 122968

SEQ ID NO: 123597 - DNA, 601 bp, Human; identical to SEQ ID NO: 122969

SEQ ID NO: 123598 - DNA, 601 bp, Human; identical to SEQ ID NO: 122970

SEQ ID NO: 123599 - DNA, 601 bp, Human; identical to SEQ ID NO: 122971

SEQ ID NO: 123600 - DNA, 601 bp, Human; identical to SEQ ID NO: 122972

SEQ ID NO: 123601 - DNA, 601 bp, Human; identical to SEQ ID NO: 122973

SEQ ID NO: 123602 - DNA, 601 bp, Human; identical to SEQ ID NO: 122974

SEQ ID NO: 123603 - DNA, 601 bp, Human; identical to SEQ ID NO: 122975

SEQ ID NO: 123604 - DNA, 601 bp, Human; identical to SEQ ID NO: 122976

SEQ ID NO: 123605 - DNA, 601 bp, Human; identical to SEQ ID NO: 122935

SEQ ID NO: 123606 - DNA, 601 bp, Human; identical to SEQ ID NO: 122936

SEQ ID NO: 123607 - DNA, 601 bp, Human; identical to SEQ ID NO: 122937

SEQ ID NO: 123608 - DNA, 601 bp, Human; identical to SEQ ID NO: 122938

SEQ ID NO: 123609 - DNA, 601 bp, Human; identical to SEQ ID NO: 122939

SEQ ID NO: 123610 - DNA, 601 bp, Human; identical to SEQ ID NO: 122940

SEQ ID NO: 123611 - DNA, 601 bp, Human; identical to SEQ ID NO: 122941

SEQ ID NO: 123612 - DNA, 601 bp, Human; identical to SEQ ID NO: 122942

SEQ ID NO: 123613 - DNA, 601 bp, Human; identical to SEQ ID NO: 122943

SEQ ID NO: 123614 - DNA, 601 bp, Human; identical to SEQ ID NO: 122944

SEQ ID NO: 123615 - DNA, 601 bp, Human; identical to SEQ ID NO: 122945

SEQ ID NO: 123616 - DNA, 601 bp, Human; identical to SEQ ID NO: 122946

SEQ ID NO: 123617 - DNA, 601 bp, Human; identical to SEQ ID NO: 122947

SEQ ID NO: 123618 - DNA, 601 bp, Human; identical to SEQ ID NO: 122948

SEQ ID NO: 123619 - DNA, 601 bp, Human; identical to SEQ ID NO: 122949

SEQ ID NO: 123620 - DNA, 601 bp, Human; identical to SEQ ID NO: 122950

SEQ ID NO: 123621 - DNA, 601 bp, Human; identical to SEQ ID NO: 122951

SEQ ID NO: 123622 - DNA, 601 bp, Human; identical to SEQ ID NO: 122952

SEQ ID NO: 123623 - DNA, 601 bp, Human; identical to SEQ ID NO: 122953

SEQ ID NO: 123624 - DNA, 601 bp, Human; identical to SEQ ID NO: 122954

SEQ ID NO: 123625 - DNA, 601 bp, Human; identical to SEQ ID NO: 122955

SEQ ID NO: 123626 - DNA, 601 bp, Human; identical to SEQ ID NO: 122956

SEQ ID NO: 123627 - DNA, 601 bp, Human; identical to SEQ ID NO: 122957

SEQ ID NO: 123628 - DNA, 601 bp, Human; identical to SEQ ID NO: 122958

SEQ ID NO: 123629 - DNA, 601 bp, Human; identical to SEQ ID NO: 122959

SEQ ID NO: 123630 - DNA, 601 bp, Human; identical to SEQ ID NO: 122960

SEQ ID NO: 123631 - DNA, 601 bp, Human; identical to SEQ ID NO: 122961

SEQ ID NO: 123632 - DNA, 601 bp, Human; identical to SEQ ID NO: 122962

SEQ ID NO: 123633 - DNA, 601 bp, Human; identical to SEQ ID NO: 122963

SEQ ID NO: 123634 - DNA, 601 bp, Human; identical to SEQ ID NO: 122964

SEQ ID NO: 123635 - DNA, 601 bp, Human; identical to SEQ ID NO: 122965

SEQ ID NO: 123636 - DNA, 601 bp, Human; identical to SEQ ID NO: 122966

SEQ ID NO: 123637 - DNA, 601 bp, Human; identical to SEQ ID NO: 122967

SEQ ID NO: 123638 - DNA, 601 bp, Human; identical to SEQ ID NO: 122968

SEQ ID NO: 123639 - DNA, 601 bp, Human; identical to SEQ ID NO: 122969

SEQ ID NO: 123640 - DNA, 601 bp, Human; identical to SEQ ID NO: 122970

SEQ ID NO: 123641 - DNA, 601 bp, Human; identical to SEQ ID NO: 122971

SEQ ID NO: 123642 - DNA, 601 bp, Human; identical to SEQ ID NO: 122972

SEQ ID NO: 123643 - DNA, 601 bp, Human; identical to SEQ ID NO: 122973

SEQ ID NO: 123644 - DNA, 601 bp, Human; identical to SEQ ID NO: 122974

SEQ ID NO: 123645 - DNA, 601 bp, Human; identical to SEQ ID NO: 122975

SEQ ID NO: 123646 - DNA, 601 bp, Human; identical to SEQ ID NO: 122976

SEQ ID NO: 123647 - DNA, 601 bp, Human; identical to SEQ ID NO: 122935

SEQ ID NO: 123648 - DNA, 601 bp, Human; identical to SEQ ID NO: 122936

SEQ ID NO: 123649 - DNA, 601 bp, Human; identical to SEQ ID NO: 122937

SEQ ID NO: 123650 - DNA, 601 bp, Human; identical to SEQ ID NO: 122938

SEQ ID NO: 123651 - DNA, 601 bp, Human; identical to SEQ ID NO: 122939

SEQ ID NO: 123652 - DNA, 601 bp, Human; identical to SEQ ID NO: 122940

SEQ ID NO: 123653 - DNA, 601 bp, Human; identical to SEQ ID NO: 122941

SEQ ID NO: 123654 - DNA, 601 bp, Human; identical to SEQ ID NO: 122942

SEQ ID NO: 123655 - DNA, 601 bp, Human; identical to SEQ ID NO: 122943

SEQ ID NO: 123656 - DNA, 601 bp, Human; identical to SEQ ID NO: 122944

SEQ ID NO: 123657 - DNA, 601 bp, Human; identical to SEQ ID NO: 122945

SEQ ID NO: 123658 - DNA, 601 bp, Human; identical to SEQ ID NO: 122946

SEQ ID NO: 123659 - DNA, 601 bp, Human; identical to SEQ ID NO: 122947

SEQ ID NO: 123660 - DNA, 601 bp, Human; identical to SEQ ID NO: 122948

SEQ ID NO: 123661 - DNA, 601 bp, Human; identical to SEQ ID NO: 122949

SEQ ID NO: 123662 - DNA, 601 bp, Human; identical to SEQ ID NO: 122950

SEQ ID NO: 123663 - DNA, 601 bp, Human; identical to SEQ ID NO: 122951

SEQ ID NO: 123664 - DNA, 601 bp, Human; identical to SEQ ID NO: 122952

SEQ ID NO: 123665 - DNA, 601 bp, Human; identical to SEQ ID NO: 122953

SEQ ID NO: 123666 - DNA, 601 bp, Human; identical to SEQ ID NO: 122954

SEQ ID NO: 123667 - DNA, 601 bp, Human; identical to SEQ ID NO: 122955

SEQ ID NO: 123668 - DNA, 601 bp, Human; identical to SEQ ID NO: 122956

SEQ ID NO: 123669 - DNA, 601 bp, Human; identical to SEQ ID NO: 122957

SEQ ID NO: 123670 - DNA, 601 bp, Human; identical to SEQ ID NO: 122958

SEQ ID NO: 123671 - DNA, 601 bp, Human; identical to SEQ ID NO: 122959

SEQ ID NO: 123672 - DNA, 601 bp, Human; identical to SEQ ID NO: 122960

SEQ ID NO: 123673 - DNA, 601 bp, Human; identical to SEQ ID NO: 122961

SEQ ID NO: 123674 - DNA, 601 bp, Human; identical to SEQ ID NO: 122962

SEQ ID NO: 123675 - DNA, 601 bp, Human; identical to SEQ ID NO: 122963

SEQ ID NO: 123676 - DNA, 601 bp, Human; identical to SEQ ID NO: 122964

SEQ ID NO: 123677 - DNA, 601 bp, Human; identical to SEQ ID NO: 122965

SEQ ID NO: 123678 - DNA, 601 bp, Human; identical to SEQ ID NO: 122966

SEQ ID NO: 123679 - DNA, 601 bp, Human; identical to SEQ ID NO: 122967

SEQ ID NO: 123680 - DNA, 601 bp, Human; identical to SEQ ID NO: 122968

SEQ ID NO: 123681 - DNA, 601 bp, Human; identical to SEQ ID NO: 122969

SEQ ID NO: 123682 - DNA, 601 bp, Human; identical to SEQ ID NO: 122970

SEQ ID NO: 123683 - DNA, 601 bp, Human; identical to SEQ ID NO: 122971

SEQ ID NO: 123684 - DNA, 601 bp, Human; identical to SEQ ID NO: 122972

SEQ ID NO: 123685 - DNA, 601 bp, Human; identical to SEQ ID NO: 122973

SEQ ID NO: 123686 - DNA, 601 bp, Human; identical to SEQ ID NO: 122974

SEQ ID NO: 123687 - DNA, 601 bp, Human; identical to SEQ ID NO: 122975

SEQ ID NO: 123688 - DNA, 601 bp, Human; identical to SEQ ID NO: 122976

SEQ ID NO: 123689 - DNA, 601 bp, Human; identical to SEQ ID NO: 122935

SEQ ID NO: 123690 - DNA, 601 bp, Human; identical to SEQ ID NO: 122936

SEQ ID NO: 123691 - DNA, 601 bp, Human; identical to SEQ ID NO: 122937

SEQ ID NO: 123692 - DNA, 601 bp, Human; identical to SEQ ID NO: 122938

SEQ ID NO: 123693 - DNA, 601 bp, Human; identical to SEQ ID NO: 122939

SEQ ID NO: 123694 - DNA, 601 bp, Human; identical to SEQ ID NO: 122940

SEQ ID NO: 123695 - DNA, 601 bp, Human; identical to SEQ ID NO: 122941

SEQ ID NO: 123696 - DNA, 601 bp, Human; identical to SEQ ID NO: 122942

SEQ ID NO: 123697 - DNA, 601 bp, Human; identical to SEQ ID NO: 122943

SEQ ID NO: 123698 - DNA, 601 bp, Human; identical to SEQ ID NO: 122944

SEQ ID NO: 123699 - DNA, 601 bp, Human; identical to SEQ ID NO: 122945

SEQ ID NO: 123700 - DNA, 601 bp, Human; identical to SEQ ID NO: 122946

SEQ ID NO: 123701 - DNA, 601 bp, Human; identical to SEQ ID NO: 122947

SEQ ID NO: 123702 - DNA, 601 bp, Human; identical to SEQ ID NO: 122948

SEQ ID NO: 123703 - DNA, 601 bp, Human; identical to SEQ ID NO: 122949

SEQ ID NO: 123704 - DNA, 601 bp, Human; identical to SEQ ID NO: 122950

SEQ ID NO: 123705 - DNA, 601 bp, Human; identical to SEQ ID NO: 122951

SEQ ID NO: 123706 - DNA, 601 bp, Human; identical to SEQ ID NO: 122952

SEQ ID NO: 123707 - DNA, 601 bp, Human; identical to SEQ ID NO: 122953

SEQ ID NO: 123708 - DNA, 601 bp, Human; identical to SEQ ID NO: 122954

SEQ ID NO: 123709 - DNA, 601 bp, Human; identical to SEQ ID NO: 122955

SEQ ID NO: 123710 - DNA, 601 bp, Human; identical to SEQ ID NO: 122956

SEQ ID NO: 123711 - DNA, 601 bp, Human; identical to SEQ ID NO: 122957

SEQ ID NO: 123712 - DNA, 601 bp, Human; identical to SEQ ID NO: 122958

SEQ ID NO: 123713 - DNA, 601 bp, Human; identical to SEQ ID NO: 122959

SEQ ID NO: 123714 - DNA, 601 bp, Human; identical to SEQ ID NO: 122960

SEQ ID NO: 123715 - DNA, 601 bp, Human; identical to SEQ ID NO: 122961

SEQ ID NO: 123716 - DNA, 601 bp, Human; identical to SEQ ID NO: 122962

SEQ ID NO: 123717 - DNA, 601 bp, Human; identical to SEQ ID NO: 122963

SEQ ID NO: 123718 - DNA, 601 bp, Human; identical to SEQ ID NO: 122964

SEQ ID NO: 123719 - DNA, 601 bp, Human; identical to SEQ ID NO: 122965

SEQ ID NO: 123720 - DNA, 601 bp, Human; identical to SEQ ID NO: 122966

SEQ ID NO: 123721 - DNA, 601 bp, Human; identical to SEQ ID NO: 122967

SEQ ID NO: 123722 - DNA, 601 bp, Human; identical to SEQ ID NO: 122968

SEQ ID NO: 123723 - DNA, 601 bp, Human; identical to SEQ ID NO: 122969

SEQ ID NO: 123724 - DNA, 601 bp, Human; identical to SEQ ID NO: 122970

SEQ ID NO: 123725 - DNA, 601 bp, Human; identical to SEQ ID NO: 122971

SEQ ID NO: 123726 - DNA, 601 bp, Human; identical to SEQ ID NO: 122972

SEQ ID NO: 123727 - DNA, 601 bp, Human; identical to SEQ ID NO: 122973

SEQ ID NO: 123728 - DNA, 601 bp, Human; identical to SEQ ID NO: 122974

SEQ ID NO: 123729 - DNA, 601 bp, Human; identical to SEQ ID NO: 122975

SEQ ID NO: 123730 - DNA, 601 bp, Human; identical to SEQ ID NO: 122976

SEQ ID NO: 123731 - DNA, 601 bp, Human; identical to SEQ ID NO: 122935

SEQ ID NO: 123732 - DNA, 601 bp, Human; identical to SEQ ID NO: 122936

SEQ ID NO: 123733 - DNA, 601 bp, Human; identical to SEQ ID NO: 122937

SEQ ID NO: 123734 - DNA, 601 bp, Human; identical to SEQ ID NO: 122938

SEQ ID NO: 123735 - DNA, 601 bp, Human; identical to SEQ ID NO: 122939

SEQ ID NO: 123736 - DNA, 601 bp, Human; identical to SEQ ID NO: 122940

SEQ ID NO: 123737 - DNA, 601 bp, Human; identical to SEQ ID NO: 122941

SEQ ID NO: 123738 - DNA, 601 bp, Human; identical to SEQ ID NO: 122942

SEQ ID NO: 123739 - DNA, 601 bp, Human; identical to SEQ ID NO: 122943

SEQ ID NO: 123740 - DNA, 601 bp, Human; identical to SEQ ID NO: 122944

SEQ ID NO: 123741 - DNA, 601 bp, Human; identical to SEQ ID NO: 122945

SEQ ID NO: 123742 - DNA, 601 bp, Human; identical to SEQ ID NO: 122946

SEQ ID NO: 123743 - DNA, 601 bp, Human; identical to SEQ ID NO: 122947

SEQ ID NO: 123744 - DNA, 601 bp, Human; identical to SEQ ID NO: 122948

SEQ ID NO: 123745 - DNA, 601 bp, Human; identical to SEQ ID NO: 122949

SEQ ID NO: 123746 - DNA, 601 bp, Human; identical to SEQ ID NO: 122950

SEQ ID NO: 123747 - DNA, 601 bp, Human; identical to SEQ ID NO: 122951

SEQ ID NO: 123748 - DNA, 601 bp, Human; identical to SEQ ID NO: 122952

SEQ ID NO: 123749 - DNA, 601 bp, Human; identical to SEQ ID NO: 122953

SEQ ID NO: 123750 - DNA, 601 bp, Human; identical to SEQ ID NO: 122954

SEQ ID NO: 123751 - DNA, 601 bp, Human; identical to SEQ ID NO: 122955

SEQ ID NO: 123752 - DNA, 601 bp, Human; identical to SEQ ID NO: 122956

SEQ ID NO: 123753 - DNA, 601 bp, Human; identical to SEQ ID NO: 122957

SEQ ID NO: 123754 - DNA, 601 bp, Human; identical to SEQ ID NO: 122958

SEQ ID NO: 123755 - DNA, 601 bp, Human; identical to SEQ ID NO: 122959

SEQ ID NO: 123756 - DNA, 601 bp, Human; identical to SEQ ID NO: 122960

SEQ ID NO: 123757 - DNA, 601 bp, Human; identical to SEQ ID NO: 122961

SEQ ID NO: 123758 - DNA, 601 bp, Human; identical to SEQ ID NO: 122962

SEQ ID NO: 123759 - DNA, 601 bp, Human; identical to SEQ ID NO: 122963

SEQ ID NO: 123760 - DNA, 601 bp, Human; identical to SEQ ID NO: 122964

SEQ ID NO: 123761 - DNA, 601 bp, Human; identical to SEQ ID NO: 122965

SEQ ID NO: 123762 - DNA, 601 bp, Human; identical to SEQ ID NO: 122966

SEQ ID NO: 123763 - DNA, 601 bp, Human; identical to SEQ ID NO: 122967

SEQ ID NO: 123764 - DNA, 601 bp, Human; identical to SEQ ID NO: 122968

SEQ ID NO: 123765 - DNA, 601 bp, Human; identical to SEQ ID NO: 122969

SEQ ID NO: 123766 - DNA, 601 bp, Human; identical to SEQ ID NO: 122970

SEQ ID NO: 123767 - DNA, 601 bp, Human; identical to SEQ ID NO: 122971

SEQ ID NO: 123768 - DNA, 601 bp, Human; identical to SEQ ID NO: 122972

SEQ ID NO: 123769 - DNA, 601 bp, Human; identical to SEQ ID NO: 122973

SEQ ID NO: 123770 - DNA, 601 bp, Human; identical to SEQ ID NO: 122974

SEQ ID NO: 123771 - DNA, 601 bp, Human; identical to SEQ ID NO: 122975

SEQ ID NO: 123772 - DNA, 601 bp, Human; identical to SEQ ID NO: 122976

SEQ ID NO: 123773 - DNA, 601 bp, Human; identical to SEQ ID NO: 36653

SEQ ID NO: 123774 - DNA, 601 bp, Human; identical to SEQ ID NO: 36654

SEQ ID NO: 123775 - DNA, 601 bp, Human; identical to SEQ ID NO: 36655

SEQ ID NO: 123776 - DNA, 601 bp, Human; identical to SEQ ID NO: 36656

SEQ ID NO: 123777 - DNA, 601 bp, Human; identical to SEQ ID NO: 36657

SEQ ID NO: 123778 - DNA, 601 bp, Human; identical to SEQ ID NO: 36658

SEQ ID NO: 123779 - DNA, 601 bp, Human; identical to SEQ ID NO: 36659

SEQ ID NO: 123780 - DNA, 601 bp, Human; identical to SEQ ID NO: 36660

SEQ ID NO: 123781 - DNA, 601 bp, Human; identical to SEQ ID NO: 36661

SEQ ID NO: 123782 - DNA, 601 bp, Human; identical to SEQ ID NO: 36662

SEQ ID NO: 123783 - DNA, 601 bp, Human; identical to SEQ ID NO: 36663

SEQ ID NO: 123784 - DNA, 601 bp, Human; identical to SEQ ID NO: 36664

SEQ ID NO: 123785 - DNA, 601 bp, Human; identical to SEQ ID NO: 34775

SEQ ID NO: 123786 - DNA, 601 bp, Human
ccttttgagaatttccctgcccagctttcaaggcctcctgtaatctgctctcatgctacaaaatcaactgtattttccacttgaatccaaatttcataactaatgctacaaattgctaccccagttgatccatatatatcattttaaatataagtaacttaaaaattttcagaattttacaattagtgtaaatttgtgacccattcaaaactgaaggcaacaaatcagtgtgttgcgagtgactgataacctactgaaacactttttttctccccagttggctgaatgtaaatcataatargccaatcagtcaccagtctggcattaagcccaaggaagaggctattctttgtccactccttgggtgttaaaatagcaaatagctgtgaatctagaggactgactctacactatcacaaaaagcccagctttcttttcactcaatcttgacagtaggtgaattaatggatttcttcttcttccacgttaataggcaactaagattctttaagttccagggtacgtgtgcaggatgtacagatttgttacataggtaaacataagtcatggtggtttgctgcacctatcaacctatcaccta

SEQ ID NO: 123787 - DNA, 601 bp, Human
tataatagatgctagagtactcatttaggtaaccagtatggaatacacctagagtttttacatttcatccattaaaaccagttttcatatttagcttagccaccataaatacaccatacatacctctgcatttgcctggtatgcatttgactatgtaataggtagtagtggaggttaggaagggaacatggaaatacatgcatagaatgaattggaagatgaaacaattttattttctttgtagggacagtctatattggccaggctggtctccaactcctggactcaagtaatcctccastctcagcctcctaaagtactgggattacttacaggtgtgagccaccagtacctagccaaagttagttttaatgtgagagtcaaggactacagtggcatgctgaggtaacaactgcaggagcatcgaggtaacagcaaaaatcttttactccaattgggtcaatccagttaaccatgtaagaaactcctcacctagggtcagtatgttacttctgtatttctgcaagcacaatccactgacataaaagtctaataattagactttattgtaagtctaatgtatcttgtacatgataaaatg

SEQ ID NO: 123788 - DNA, 601 bp, Human
agaatgaattggaagatgaaacaattttattttctttgtagggacagtctatattggccaggctggtctccaactcctggactcaagtaatcctccagtctcagcctcctaaagtactgggattacttacaggtgtgagccaccagtacctagccaaagttagttttaatgtgagagtcaaggactacagtggcatgctgaggtaacaactgcaggagcatcgaggtaacagcaaaaatcttttactccaattgggtcaatccagttaaccatgtaagaaactcctcacctagggtcagtwtgttacttctgtatttctgcaagcacaatccactgacataaaagtctaataattagactttattgtaagtctaatgtatcttgtacatgataaaatgtatgaactttggatcaatatggcaagctgaagacacctgtcatgtggggggactattttgtttgggtttttttcccccttcctcatgttacctggtctaagaaggaaagttttttggttttgtttttgctatgattgtctaacttttcctaatcaagttgtacttgggtttttttataccaatgattaactttggttttgtat

SEQ ID NO: 123789 - DNA, 601 bp, Human
atcgaggtaacagcaaaaatcttttactccaattgggtcaatccagttaaccatgtaagaaactcctcacctagggtcagtatgttacttctgtatttctgcaagcacaatccactgacataaaagtctaataattagactttattgtaagtctaatgtatcttgtacatgataaaatgtatgaactttggatcaatatggcaagctgaagacacctgtcatgtggggggactattttgtttgggtttttttcccccttcctcatgttacctggtctaagaaggaaagttttttggttttstttttgctatgattgtctaacttttcctaatcaagttgtacttgggtttttttataccaatgattaactttggttttgtattttaaaaagcaagggattttcttaaaaaattccatccagagtttggttttgcccctgctgatgctttcatcaggtaaagttacaactgacaaaacatgactttattgaaataagcattctgaaagggcatcatgttccttgcaaaggaaatgggaaaatgcattatctaatatcttcatattgctaccttaatagcttcaccagttattactcagagtt

SEQ ID NO: 123790 - DNA, 601 bp, Human
tatttctgcaagcacaatccactgacataaaagtctaataattagactttattgtaagtctaatgtatcttgtacatgataaaatgtatgaactttggatcaatatggcaagctgaagacacctgtcatgtggggggactattttgtttgggtttttttcccccttcctcatgttacctggtctaagaaggaaagttttttggttttgtttttgctatgattgtctaacttttcctaatcaagttgtacttgggtttttttataccaatgattaactttggttttgtattttaaaaagcawgggattttcttaaaaaattccatccagagtttggttttgcccctgctgatgctttcatcaggtaaagttacaactgacaaaacatgactttattgaaataagcattctgaaagggcatcatgttccttgcaaaggaaatgggaaaatgcattatctaatatcttcatattgctaccttaatagcttcaccagttattactcagagttttaaaatgagtttattaaagaaggttcttaggaaggcaacaacttttgtccttaaaaaaaagttatggtttttcatgctgtataataaaggtg

SEQ ID NO: 123791 - DNA, 601 bp, Human
tgtacatgataaaatgtatgaactttggatcaatatggcaagctgaagacacctgtcatgtggggggactattttgtttgggtttttttcccccttcctcatgttacctggtctaagaaggaaagttttttggttttgtttttgctatgattgtctaacttttcctaatcaagttgtacttgggtttttttataccaatgattaactttggttttgtattttaaaaagcaagggattttcttaaaaaattccatccagagtttggttttgcccctgctgatgctttcatcaggtaaagttccaactgacaaaacatgactttattgaaataagcattctgaaagggcatcatgttccttgcaaaggaaatgggaaaatgcattatctaatatcttcatattgctaccttaatagcttcaccagttattactcagagttttaaaatgagtttattaaagaaggttcttaggaaggcaacaacttttgtccttaaaaaaaagttatggtttttcatgctgtataataaaggtgatgtaagaggctacagagttacaagtttctttctactggaattctctggtatagcacagtgtagtcattt

SEQ ID NO: 123792 - DNA, 601 bp, Human; identical to SEQ ID NO: 30353

SEQ ID NO: 123793 - DNA, 601 bp, Human; identical to SEQ ID NO: 30352

SEQ ID NO: 123794 - DNA, 601 bp, Human; identical to SEQ ID NO: 30351

SEQ ID NO: 123795 - DNA, 601 bp, Human; identical to SEQ ID NO: 30350

SEQ ID NO: 123796 - DNA, 601 bp, Human; identical to SEQ ID NO: 30349

SEQ ID NO: 123797 - DNA, 601 bp, Human; identical to SEQ ID NO: 30348

SEQ ID NO: 123798 - DNA, 601 bp, Human; identical to SEQ ID NO: 30347

SEQ ID NO: 123799 - DNA, 601 bp, Human; identical to SEQ ID NO: 30346

SEQ ID NO: 123800 - DNA, 601 bp, Human; identical to SEQ ID NO: 30345

SEQ ID NO: 123801 - DNA, 601 bp, Human; identical to SEQ ID NO: 30344

SEQ ID NO: 123802 - DNA, 601 bp, Human; identical to SEQ ID NO: 30343

SEQ ID NO: 123803 - DNA, 601 bp, Human; identical to SEQ ID NO: 30342

SEQ ID NO: 123804 - DNA, 601 bp, Human; identical to SEQ ID NO: 30341

SEQ ID NO: 123805 - DNA, 601 bp, Human; identical to SEQ ID NO: 30340

SEQ ID NO: 123806 - DNA, 601 bp, Human; identical to SEQ ID NO: 30339

SEQ ID NO: 123807 - DNA, 601 bp, Human; identical to SEQ ID NO: 30338

SEQ ID NO: 123808 - DNA, 601 bp, Human; identical to SEQ ID NO: 30337

SEQ ID NO: 123809 - DNA, 601 bp, Human; identical to SEQ ID NO: 30336

SEQ ID NO: 123810 - DNA, 601 bp, Human; identical to SEQ ID NO: 30335

SEQ ID NO: 123811 - DNA, 601 bp, Human; identical to SEQ ID NO: 30334

SEQ ID NO: 123812 - DNA, 601 bp, Human; identical to SEQ ID NO: 30333

SEQ ID NO: 123813 - DNA, 601 bp, Human; identical to SEQ ID NO: 30332

SEQ ID NO: 123814 - DNA, 601 bp, Human; identical to SEQ ID NO: 30331

SEQ ID NO: 123815 - DNA, 601 bp, Human; identical to SEQ ID NO: 30330

SEQ ID NO: 123816 - DNA, 601 bp, Human; identical to SEQ ID NO: 30329

SEQ ID NO: 123817 - DNA, 601 bp, Human; identical to SEQ ID NO: 30328

SEQ ID NO: 123818 - DNA, 601 bp, Human; identical to SEQ ID NO: 30327

SEQ ID NO: 123819 - DNA, 601 bp, Human; identical to SEQ ID NO: 30326

SEQ ID NO: 123820 - DNA, 601 bp, Human; identical to SEQ ID NO: 30325

SEQ ID NO: 123821 - DNA, 601 bp, Human; identical to SEQ ID NO: 30324

SEQ ID NO: 123822 - DNA, 601 bp, Human; identical to SEQ ID NO: 30323

SEQ ID NO: 123823 - DNA, 601 bp, Human; identical to SEQ ID NO: 30322

SEQ ID NO: 123824 - DNA, 601 bp, Human; identical to SEQ ID NO: 30321

SEQ ID NO: 123825 - DNA, 601 bp, Human; identical to SEQ ID NO: 30320

SEQ ID NO: 123826 - DNA, 601 bp, Human; identical to SEQ ID NO: 30319

SEQ ID NO: 123827 - DNA, 601 bp, Human; identical to SEQ ID NO: 30318

SEQ ID NO: 123828 - DNA, 601 bp, Human; identical to SEQ ID NO: 30317

SEQ ID NO: 123829 - DNA, 601 bp, Human
tgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgctkctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttc

SEQ ID NO: 123830 - DNA, 601 bp, Human
tctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtytttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctca

SEQ ID NO: 123831 - DNA, 601 bp, Human; identical to SEQ ID NO: 35377

SEQ ID NO: 123832 - DNA, 601 bp, Human
agagtacctcccgaaaaccctatgcttctatcaacaggtgattggttaaaaaaatgggggtgcatctatgcaagactcctatttacccattaaatagaaggtttacatgctaatacaaaaatactctaagctattcaagtagaaaaagcaggcagaaatggtatgtgttaaataccctcacctgtataaacacatgcacacacacacacacacatatacatgcacacacacagaggcacatgcacactttttgacaacataccaggaagtattgatattagttacctgtggagaataatayttaaaatctggggttggaaggaaacacatttcttatattttatagtatacccttttgaaatttaaaaacttgtacatattcatatgtattttcttcacccccttcctccccatgagagagctcacccagtagagtatgtcttttcaaagcatttttgtagggagttgctcaaaatctgttctgaaaaacactagttccaaaagatgcaaacaagaattaagtgaaaaaaatacatgtggtccttcccaaatatgtttgggaaacactgggttaaaccaaaataagcagttttctcaactg

SEQ ID NO: 123833 - DNA, 601 bp, Human
aacctggtctctactaaaaacacaaaaattagccaggcatggtggtgtgcacctgtaatcccagctactcaggaggctgaggcaggagaattgcttgaacctgggaggcggagattgtgccaaagcactccagcctgggcaacaaaatgagactttgtgtccaaaaaaaaaaaaaaattacccatatatatatatattttttaacttaaagtaaatcaatttttcttctgaacaacacaaaaactttaaaaaattctaactccaatcaaccactctatcttacatgtcattgttgtctaayatttaaatttttccctcattattattgttgttactggtgttttaaaataaatatttttgtttgcttatttaaaaatgcattcctatcatttactggtttatttgctaatcattactgcatacacccactactttctcttgggttctgtctccttattcttgcagttcttcctttagaaaatttttcaggaagggtgtgtgacagatgaactttctcagtctttgtctgaatgtgtctatttcatgctcaaggttgaatgataaattagctgatacattttaggttgataattatttttgc

SEQ ID NO: 123834 - DNA, 601 bp, Human
gtgcacgaaaaaagagagggatggacagatgacaagaaaaatttctttaaaagttacaggtctggccaggcgcggtggctcatgcctgtaatcccagcactttgggaggccgaggtgggcggatcaagaggtcaggagttccagaccagcctggtcaatatggtgaaaccccatctttactaaaaatacaaaaattagctgggcatgatggcatgcacctgtagtcccagctactcaggaggctgaggcaggagaatcgcttcaacccggaaggtggaggttgcagtgagctgagattgcrccactgcactctggcctgggcgatgaagtgagactccatctcaaaaaaaaaaaaaaaaaaaagataaaagaaaaaaactctactatacctgaggtgacatcctcttttcaatttttaaaaagaagtttgttttccatttcagtaatttctgctttgatcttccttatgtcctcctattgagttgatcagctttctttattcttgccttttctcctctgtgtgccctttctattaacgtatttacccttaggctgggcacaatggctgatgcctgtaatccctgcactttgggaggccgag

SEQ ID NO: 123835 - DNA, 601 bp, Human
gtgaaatcagaaagtttataagccaaattaaaggaaacgtccactttgcagggcagaatccaggacaattttggtctagtacattatttggaatgcccaggtactggcaggagagctctgagataagggtgggcagatatcactggccctttttattggtggagaagctgagctcaggctgatgtaatcatgcatcccgggaatcagcccagagcccagttgccctgccctgggcacacactcgcccttggacttccactgtgctcttcccttgagcagcacagagtgttcgcttgtccamattctcgttcctgtttgaatgtttcctgaagagagagaaaggagagcgatcaactgcattttgccagatggagagacaagtgtaacacaattaagagacttatcagcccttgaatgaaagagctgggcttggtatcttgactccagtcattccctaataccatcatttgatgagaattaactcctttcatgtgaaagcccaagcgaacttgacaaagtttacagtttaaaatacattagcagtgtcaaaagatgattttacagaacagacgtgatcgtggtggggatattttacaggaga

SEQ ID NO: 123836 - DNA, 601 bp, Human
tctagtcatttctcacagggactatgctcactcctactactctatatattctcctctctcttcaaacttttcaggattctttgatacagagctcatcttattgaagatgctgaagtgaacaacccagcaagcagctgtatttcctcctgaggtggaaggacagctttccagggctggacttttgagtagataacatactgtgtagtcggacagatgctgaattcttttctcaccctgtcaagcttccgcattagaggtctaacttttggcatctcttagaatggaaaaaaatgcaagtacytctgctaaaagtagtacccttgatctttaccttcagtgccctgaaggaaatagaaagaaactatcctggaacacagactatggaggaaataggggagtgggcagtacaggaaggaggaaggaaggacagggatggttgattgtatgtgagaaatttcagacactgcagtgttcccttcttcctgctcctaccttccaccaggactgggtgagaaatcatccctccttgctggggtcacagagtttgtctctccattttgagaggattctcaatcagacatgctggttatagacactctag

SEQ ID NO: 123837 - DNA, 601 bp, Human
cttgaagagcagcttagcgaaagaaaccctctctgagttcttgggcacgttcatcttgattgtaagtatttcctgatttcctacattcagacccaataatgcctccctagctgccaggctggtagtggagagttttgtttggtttgttttatttaagttaattgggatcagattcatcttttccaggaagaaacaagttactagaggctgtttgactatttaggggttgtgatattaagttttcaattacctattgcatttacccacaaaagttgatgggaatggaagagaaggagtgagygaagtgccttctttatttcaggtatttacttatactctaaaatggctttgtgatttaaaagtcagtcgttagtgttttcattgatcaattgatttgtaccctgcttgcttcctccaagcattggggtgactcagccacctggaataagcatcaatagtcaataaatatagttggcaaaaatatacatatggatggcaagaaacatctcagtatgacaagtacttgacaagtattgtgctgtcagatcacttgatttttaagaaattaaaaattgcactaggtagaaatagtgtaccaggc

SEQ ID NO: 123838 - DNA, 601 bp, Human
ccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtaagtatttcctgatttcctacattcagacccaataatgcctccctagctgccaggctggtagtggagagttttgtttkgtttgttttatttaagttaattgggatcagattcatcttttccaggaagaaacaagttactagaggctgtttgactatttaggggttgtgatattaagttttcaattacctattgcatttacccacaaaagttgatgggaatggaagagaaggagtgagtgaagtgccttctttatttcaggtatttacttatactctaaaatggctttgtgatttaaaagtcagtcgttagtgttttcattgatcaattgatttgtaccctgcttgcttcctccaagcattggggtgactcagccacct

SEQ ID NO: 123839 - DNA, 601 bp, Human; identical to SEQ ID NO: 39679

SEQ ID NO: 123840 - DNA, 601 bp, Human
gtgtgtgggattatttcacttacatctgtctgcttcactagactctaggctctgtgaaggacaagaaccctatgtgctcttgttaagtgcagtgcttggcacataatgagtgtgcagtaaatagttgttagatgagtgaatgggaagaccagagaacgctcttgcatgttattagctgtagtcacagtaagaaagtcctgtttctctggtccatccactgggacttggtaatggtgtggtcataggtaactcttctagacaatggtatttatgataacttcatcaggaattaaagccaaartgctgaggttttgtcctggttctgcagtagtgtggcctcaggcaggttataactttttaaagtctaaattctaaatgtcacctacagatgagaagtctccttctgcctttggcctctcaccagctgctttctccatgtcctctcctccctccctttttgcaaagctaggggagggcctgatgcagagctggcttccctgtgggaggactggaaggaaccacacagcatggatactaattccatgagtccacattggtaatcagaaactaggcctgccttgctatttagaaactaatgcta

SEQ ID NO: 123841 - DNA, 601 bp, Human
agtgcatgctaaaatctggaaacttggaaataaaaggttaactaagaacatggggccactgctgatgctatatcacaattatctgcaatagcgttaatcaatacatttatgattttcttcagcaacatttagcagccagggaagagaaagtctgagaaaaaaaaaatggatggttaggcatacccagagttgggctttggcaacatgggtgtagaagaaaatcactgggtcaatggaacctgagatgctgggaagcgcttcattaacgtgggtaatcatgaggtaataattaggtggaaaggaaggctttgagggactggaatttagaattaggaggtgtaggggaagtgaggtcagggtgtgagaggcggttatacttataaacaccaggcttctatcttgggattgcgtgagtgtaggcaaagatggttacccaaggcaaaagtagataaacacagaatagaatgttggggagaagagaagataggaaggggcagagccaagggaactattaataaaagaacagcatatgccagccctggagaatcagtatggcagtgcatccaggaaagctcatcagctttagaaccattgacagcag

SEQ ID NO: 123842 - DNA, 601 bp, Human
gttagattgggaaaaacatttaatagatttcaattacccgatattaaagaaaatgagaaaacagatattttaacacactttaaatatgcatactctaattattcaactctaggaagttatgctaagagatatagattctcaaggttgttcattgcagagttgttttaatgaacaataattggaaacaaccaattgcctatcaaaaggagtttgtttaatttatggcacatttgtacaagggaatattacacagtcattagaaagatgaagtttacattggcatagaaggctaaacagcaamttttaagtgggaaaaatatccagtaaatgtagtataaccctatttttcgagtgaagaaaagaatagatacttatatattattagatctactgaaacaaactcttcttcttttttcttttttttttttctttttgagacagtctcgctgtgacacccaggctggagtgcaatggtgcgatcgcgatctcggctcactgcaacctccgcctcctgggttcaagtgattctcctgcctcagcctcctgagtatctgggattacaggcatgcgccatcatgcccggctaatctttgtattttct

SEQ ID NO: 123843 - DNA, 601 bp, Human
taaaatattctcaaagatttactagccaaagaggacattggctcatatttgcacgtacatagaacccattgacttttaaggaacagataattcttggcctatttaaactgttccatagggcagagaaatatggaaatctatccagttcatttgttcatggctagtgttagtctgatatcaaagtctgataagtaaaacacaaactacccttttatagttttacttatgaatatccaagcaaaaaaatcaaaagtattggaaaactaaatctagcaatatatgtgcatcacaaccaagcagkagattttcaggaatgcaaggctggttcaacagtagatcatttaaaatgtaatataactaaccaatgacataagaaaaatggaagttttttaaatgaaaacttctcattaaatattcaagacatttgataaaaattcaatattcattactgttttaaaaaatctcagtaattaacaaaaaaaaagcatgataataggaaatatgaaacttactgggggaggagccaagatggccgaataggaacagctccggtctacagctcccagcgtgagcgacacagaagacgggtgatttctgcatt

SEQ ID NO: 123844 - DNA, 601 bp, Human
caaaactatttttgacaaataaaatcaagacacagctcttcaaaaataacaataaaaattatatgcttctggcaattgagaccaaggagaaaaaagagaaaaatacaaatagattatgtttgaaacgaaaaagcatgctttaaattatacactacatctgttttattaattctgagattctagattgagtagaacaaattgtggaaaaccgtaaatgactaaaatgtacctaagacctatagatgacagtaacaatagtagatattaaaatattctcaaagatttactagccaaagaggayattggctcatatttgcacgtacatagaacccattgacttttaaggaacagataattcttggcctatttaaactgttccatagggcagagaaatatggaaatctatccagttcatttgttcatggctagtgttagtctgatatcaaagtctgataagtaaaacacaaactacccttttatagttttacttatgaatatccaagcaaaaaaatcaaaagtattggaaaactaaatctagcaatatatgtgcatcacaaccaagcaggagattttcaggaatgcaaggctggttcaacagtag

SEQ ID NO: 123845 - DNA, 601 bp, Human
ttaatttagctttgattaaaattgagaccaaatttcccaaacttcagtagcagaaatttgccataagtaattttgagaatatcaaatgctggagtaacaggtcacctttgttcatctagctaacagggaagactactgatagttacaaaaatttaaattttgtctattcttattctaaatcttgtcatcagaaggttggctttctttttttactaaaaaggacaaaaactttcctgcaatactgagaggtttcttttaagtttcaaggatgttgatttgtaacatttagaatatgaatggttgttaaatgaaaagcatgtatgaaaatgtgtgttgaaaattgtatttatacacaaactctgtaaattataatggcaatacaaagttattatttattaaccatatactgattaacctgcttatcatgacttcactcatctagttgcatttaaacaaaacaaaaattagctgagcatggtggcaggcaccccagctacttgggaggctgaggcaggagaatcactagaatccgggaggcggaggttgcattgagctgagatcgtgcctgggcaacagagtgagactccgtctcaaaaataaa

SEQ ID NO: 123846 - DNA, 601 bp, Human
ctctaaaaatatgttcaacaattttgcatattttttctttatgtcaaaggagttcttcacacattcttctgcaacatgcttttttttgttcaatgttatatttgtaggattcacttatgttgtcatgtgtaattgtaagccattaactgctttaaggcatttcattataaaaatgtactgtttatccattgaaccattgattcacatgtttttttctagttattttgttattagaaatagtgtggtcgtgaatcattttatatatttctctaggtatatgtatgcaataatttttctaggktgtattcctaggtgtaaaattgctggatcattatgtacacacacctgaaaatttattagataataccaaattggcaaattgggtttggtttcattcaaaagatattttaccaatttacactgtcaccagaaatgtgttggtgttgtggtagttctacatctttactgacccttgatactgcaatttttttttttatttttttttgcttttgccaatccagttggtataaaatgtaatctcattggggatttaatttgcatttgtttaattactagcgaagcagagaatatttttcatgtt

SEQ ID NO: 123847 - DNA, 601 bp, Human
aagctatccctccccccctccccccacaaaacatagttcttacttgggaagagtttataatctatttgaagagagaaaacatatgcatgcatacacatgtacaaatacacaagaagagagaagaaactgatgtgattaagggctgtgtaattcatacagtgagtggtatatgtatttgatcgtgggagatttccctgttcaatggaattgtgagggaagggctcataagtgaattagtaagtccaattcttcaaaaggtgaggtgagtacaatttggatggaaaaagaggcggaagaagartcttccagaagagaggatacagcacaagcaaagccttgtaggcagaaatgaataaggagtgttgtagaggaatctataagtacccttcggataaaatgaagtgtttcatgctgggaatattgagatacatatttgggcaactatgaaggagcagatttatggcagaacttaaatatcagtctagaaagtttgggcattacctattacatagaggggaatcactgagtttttaaaaagggaatattggccgggcacagcgactcacgcctgtaatcccagcactttgggaggccgaggcag

SEQ ID NO: 123848 - DNA, 601 bp, Human
atagatttgtgggtctcgggacacagaaagaaggaaaagatatcatgtctgttatgcaagttactggtaaattttgtttctttgcattacatgttacctgtactaacccctttagaccataccaaaaagtataaaacatagttcttttttttctttttttttattattattatactttaagttttagggtacatgtgcacaatgtgcaggttagttacatatgtatacatgtgccatgctggtgtgctgcacccattaattcgtcatttagcattaggtatatctcctaaagctatccctccccccctccccccacaaaacatagttcttacttgggaagagtttataatctatttgaagagagaaaacatatgcatgcatacacatgtacaaatacacaagaagagagaagaaactgatgtgattaagggctgtgtaattcatacagtgagtggtatatgtatttgatcgtgggagatttccctgttcaatggaattgtgagggaagggctcataagtgaattagtaagtccaattcttcaaaaggtgaggtgagtacaatttggatggaaaaagaggcggaagaagagtcttccagaag

SEQ ID NO: 123849 - DNA, 601 bp, Human
aattgatttttgcatcctctttgctcagtggagcagttggaatggaaatttgttgagtcgcttctggaaggagagatttatgatctggcaccttcatagacatgaatggcaatataacgaattgaaagagtgatagttgctaggaccagaaggaatccccagattctcagaactataaggggagtacatgggactaatattcagcgagcagtaggctttgaggctttccactggcaaaacttgaaaagcaagcaatggactcccgtcccgattgctaagaaatttagggtaagttcaatgsctttctcaggatattgtgttcagcacccctgctagtgggggaatggaagtggaaaagtgcagggacttacagagaatggaagtcctagatgttttagtccactgttaatgtgtgggaaatgtgattcctcaacccaattcccaggtaacctggtaaataatttaggctcctgaaatactgacattgcagttgtaacactaggcaccttatgcacagttgttgccaatgccctatcatcaaggcacaggcctttgtgttttttcagttctgaagatgagttttgactggatcactcccaac

SEQ ID NO: 123850 - DNA, 601 bp, Human
ggctggacttcccctgtcccctaggccctcaccatttgccccttgcactcacctattattagagatgatctgaactttcccagtgttagctgctggcttcatatccctcttctcccatgttttctgttggatatctgttgactgattcagggtttttctcttttcaagttttgatgccttcttgcttctttctgcttcctccctgacagaagaacataagactcaagctttgtagcagttagtggcttattccacctgtttatattttgggggtggggggagatgttgtcactcagttttkttataactgttgatcatgagtttttggttttgctggctaggcactctgtgtttgtttgtttgtttgtttgtttgagacagagtctcactctgctgcccaagctggagtgcagtggtacaatctcgactcactgcaacctctgcctcccagttcaaggaattctcctgcctcagcctcccaaatatctgggattataggcatgcaccatcccacctagctaatttttgtatttttagtagagacaaggtttcaccatgttggtcaggctggtcttgaactcctgacctcaagtgatccacc

SEQ ID NO: 123851 - DNA, 601 bp, Human
gtgaaacctggctctatttatcatgttgtgctcaatatatggcactgctctgatcagtttgaatcacgcagaaaaagagattaatatacagaagtatcaagtatttggttctaaattcttcacaaactctaagatctgtattttctgagaaataaataatttagtgcttgtgtagtcaaggaagctttaagaaaataatgtggaagggcaggtagactttaaatagatgaaaaagagaggggaaggggtatcaggcaaaggaacaccaggggtctgcagaactttttttctgagtctggcagggagacctaacaaacagattgtgagcactgcttttcctacaatttctcatttcattatttccacaaaatgcatggattcttattcccactttataaaaataatgagaaaagtgagacttagcactacaattgccagagatcacagaactattaattaattgttccagatgtcattctttggagtctgtagcaaaactacctgcgttcaaatccagctcttcaacttgttttctgggtgactatgggtaaatgaattaacttccttatccttagatttataatccataaagtagagagaa

SEQ ID NO: 123852 - DNA, 601 bp, Human
cggtatgagagatggtatctcattgtggttttgattttcatttctctgatgactagtattgatgtccattttttaaatgtgttttgttgccacttgtctgtcttcttttgaaaagtgtctgtccatgtcttttgcccgtttttaaaagtaggattatttggttttttccttgttgatttatttaagttgcttatagattctggatattagacctttgttggatgcatagtttgtgaatattctctctcattctgtaggttgtctgtttactctgcctatagtttcttttgctgtgcagagstccttagtttaattaggtctcatttgtcaatttttgtttttgttgtaactgcttttggggacttaggcataaattctttgccaaggctgatattgagaagggtatttcgtaggttttcttctaggatttttataatttgaggtcttacatttaaatttttaattcattttgacttatttttcatgtatggtgaaaggtaggggtcctgattcattattctgcatatggctaaccagttatcccagcaccatttattgaatacagagtcctttccccatcactcatttttgtcagctttgt

SEQ ID NO: 123853 - DNA, 601 bp, Human
cctttggacattcagggacacatatttggaagtggattaattagtaatgggtgatctaagccatccatcaacaagtattttttttaaactgagatataattcacataccataaagttcactcttttaaaatatagaatgtagttatttttagtatattcccaaaattgtgcaactgtcaccactccttaatttccaaacattttcatcactcttaaaagaaatgtgtacacattagaatcaactcacattcctcttccctgtcccctgatctgcttcctgtctctatggatttacctattatagatatttcatatcaatggaatcatacaacatgtggctttttgtgactggtttctttcacttcgcttaatgtttttgaggttcatccatccgttattgctgaatacttttgtttgtatgactataccacattttgtttatccattttcaattgatgggcatttgggttgtttccacttttcagctattatgaataatgttcctttaaatatttgcgtacaaatttgtgtgtggatgtatactttcaattgttttgggtacagacctggatgcggaatggtcaggtcatatggcaactct

SEQ ID NO: 123854 - DNA, 601 bp, Human
atcatcttaacttattaaagaaaaatcatatggcgatctcagtagttgcacaaagtgtttaataaatgttaacatccattcatcataaaaatttagcaaatgaggaataaaaggaaattttcttaatcttaaaaagtgtatctattttttaaaaagtacctagagccaacattatacttaatggtgaaatagttaaagctttctctttaagacgattagcaaaaaaaaagatggcttctgtgggcctagcagtacactaatcaagaaaaagaaataaaatgtacaagggtttgaaagttayttattcataggtattatgtttgggcacataaaatccaaaagaacctatgattaaaatattagacttaataaggttgatagatacaaaatcaactatatttccatagattagcaacaaatagaaaattaaaaatgcttaaaatgatactattagttatctgaaaatatcaaatgactaggaataatttaagtaaaaattccataggaccacttcaggaagatttataagactttattgaaggattttaaagtagacatttaaatgagagatattttatgttcatgctttggaagacaatat

SEQ ID NO: 123855 - DNA, 601 bp, Human
catgtacgtgtgcagcaaaatacatgcatgagaaatatgataaactgaaggtaatcacaaatgagctaccactcatttcattgagaggtagagctattcccctccctttgcatctgccctggctttctgattctatattcaagaaaatgcagtgtaagtgacactgtgccagctctgggagcaagtttaaataaggcctggaaacttctgcttttgcatcttttgaagctctgagactccatttaaaatgtccagtctcctgctagaaagaccatgtgaggaacccacccagtgaagctaycaggaaacggagaggctctggaactatatagagagcatctttcttaagaaatattttaaatgtgtacaaattaaacccaaataaaatagaaggaaataaatagtaaagattggagcagacattaatgaaatagaaaataaacatacaatagagtcagcaaaaacaaaagattaatctttgaaaagattaataaaattgacaaaccattaatgcaattaattaagaaaaaagagagaagatgcaaataactaataccaggaataataaaaattttatcgctccagttgctgcaggttttaa

SEQ ID NO: 123856 - DNA, 601 bp, Human
ggaaacccaaatagctaattaacgtatgggaagagaatcagcctcattagtaatcagggaaatgaaaactgaagccacaatcaaactactacatattcacccaaaaggctgaaatgaaaaaagactgattctatcaagtgttggtaaggatgttgatcaataggaactctgaaacattattaatggtataaattaatacaacactttggagaatagtctaatttaatagagttaaataaataaataccttatcattggatatattgagtatgagcatatacacaagagaataacatgtacrtgtgcagcaaaatacatgcatgagaaatatgataaactgaaggtaatcacaaatgagctaccactcatttcattgagaggtagagctattcccctccctttgcatctgccctggctttctgattctatattcaagaaaatgcagtgtaagtgacactgtgccagctctgggagcaagtttaaataaggcctggaaacttctgcttttgcatcttttgaagctctgagactccatttaaaatgtccagtctcctgctagaaagaccatgtgaggaacccacccagtgaagctaccaggaaa

SEQ ID NO: 123857 - DNA, 601 bp, Human
gtctccaaacacagttacattctgagatagaggggttaggatttcaacacatgaactaaggtgaagggaagggcacaattcagtccagacatgtttatttagcctattttatcttgatgtgtctactgggtgggagctgtgatctttcactaatgttatataatttcctaggatcacccaaggatattgtctgtggcaggaggagatttgcatagacacctggttgaaatatggtggcctgtaaaatcctcttgtcttttcggctggattgctgagttctaggggaagataagtgaaaagyagagccagccctgaaggacacctgtgcaacttgtcattgtcctatatgcatatatgcaacatataaccaggggggacccagaaagtggatctgctggaaaataccaaaggtaatcagtatgttttctgtggttttattttatttttagggtcttgctctgttgctcaggctggagtgtagtgatgcaatcatagctcctagtaaacttgaactcctgggctcaagtgatcctcccatctcagcctcccaaatggctgggactacaggaatgcatcaccatgcccagctaatttaaaaaag

SEQ ID NO: 123858 - DNA, 601 bp, Human
acaattccagagaactaacagcagtaaataaataattatgggctgggcacggaggctcacacctgtattcccagcactttgggaggccgaggcgggcagatcatctgagatcaggagttccagaccagcccagccaacatggtgaaaccctgtctctactaaaaatacaaaaattagccaggtgtggtggtgggcacctgtaatcccaactacttgggtggctgagacaggagaatctcttgaacccaggaggtggaggttgcagtgagtggagattgcactactgcactccagcctgggygacaaagcgagactctgtctcaaataataataataaataaaattaaattaaataaagaaataattatggaatcagtatggcaatttaataccacacatttatgtgtatatgtatgtgtggatatatgtatatataagtgtttttttttcttttatagcctaattttccagtcaagatttaagggttcccattgtctgatgcttgaatacttgaagactctctttctctctttgatcatcatggtcagtaggcaaaataagtgatgacttgtactaatttgctagggcttccataacaaaa

SEQ ID NO: 123859 - DNA, 601 bp, Human
tttgctttttaaatgtggataatactagtgcctgtttctctctgtctctctcttttaggttaaataagtggatatagtagttggcacatagtaaatgcgatttaagcattagacattattattattgttgttgttattattaccacaattccagagaactaacagcagtaaataaataattatgggctgggcacggaggctcacacctgtattcccagcactttgggaggccgaggcgggcagatcatctgagatcaggagttccagaccagcccagccaacatggtgaaaccctgtctcyactaaaaatacaaaaattagccaggtgtggtggtgggcacctgtaatcccaactacttgggtggctgagacaggagaatctcttgaacccaggaggtggaggttgcagtgagtggagattgcactactgcactccagcctgggcgacaaagcgagactctgtctcaaataataataataaataaaattaaattaaataaagaaataattatggaatcagtatggcaatttaataccacacatttatgtgtatatgtatgtgtggatatatgtatatataagtgtttttttttcttttata

SEQ ID NO: 123860 - DNA, 601 bp, Human
tatgctaaaccagcggcggattatttatgcctcccctttttagaccatatagggtaagttcctgacattgtcatggtatttgtaaactgtcgtggtgctggtgggagtgcagtagcgaggacgaccagaggtcactctcgtagccatcttggttttggtgggttttggctggctcctttactgcaacctgttttaccagcaaggtctttatgacctgtgttttgtgctgacctcctatcttaacctgtgatttagaatgccttaaccgtctgggaatgcagcccagtaggtttcagccttrttttacccagctcctattcaagatggagctgttctggttcacatgcctttgacattactgcatactatttgacaccaaagatgattgtaaatactgaaggaataaccatgtatttattaacacaaatgatttagttgcataaagtattgttaattgtatgatagccttcaccacctagagcaggactctttaattgctaccaattgtctggtatacatggtagagtgcaaacatctaagggatatttaggaaagtgatgcaggccaaaaagaaaatgatttaaattttttctccacctca

SEQ ID NO: 123861 - DNA, 601 bp, Human
ttttatgtatacctaattgtgctctaaattgatagtcaaaaaagccccactaaaagggcttactagtattgagaaacctcctccaatcaagactttttaattttataatatattcttatctgcagaaaagccctgggcattctaaggaaggaaggcatgtgatagggtaacagggagtgaggcagctgttttgggacagggcacacagccaactagcatcatgatctctatcataagaggctcctcctggtcatgtcaatacagatttgattctacttttcacatggctgatgagttaccyggatctacacatttcaatctcaatgttccaaagaaagcctacacagaggagcttaagcctagagtccattcattctaatgttcagaagaccacaatttgagtagacttaaaaacctcattactgttgaaaacaaattttggctcaagtaaaagctaactttgctcagttcctgactttcacttaaaaatgttgttaatgatttgctcatatttgaaatcaaaatgttaaaacaaatttggagacacgttgttaacacatactggtggcctcaatattctaagagcacaaatgagcatgtg

SEQ ID NO: 123862 - DNA, 601 bp, Human
attgccccctcaaaaaacaaatataagaactgacatctcacatgtcaaaagtaaacaaatctctgtagatctcacagaggattaagttcttaatctcgctgctcagcaacaaggtcctctcagttacagatcacaccatgtggctcttaaagtcaattgactctgcctccaccacctctatccagttttctttttctatccctcccctacatgcaagtgtcaggtcagcctcttcaaccccatcttatgagctccacacacagcatatgctcacttctgctttaggaactttgttcatgcyctacccttatctaaatcatctaaacctttcctcattcttgaaccacattatagtatccttcaatgtttagattaaattcaacttctgctttgcatcattaatattctgtaaacttctgaataagcatcatatcctgtgtttgaaatatttatgtatatggtctgcttttttatgtgtggttctaccacatcaccagttaaactataatttggtagaaaaatatagcagaaatattgttattgatataaaatgttcatacttttggctaaagaaagcttagtatccttaatataattatgt

SEQ ID NO: 123863 - DNA, 601 bp, Human
aatataagaactgacatctcacatgtcaaaagtaaacaaatctctgtagatctcacagaggattaagttcttaatctcgctgctcagcaacaaggtcctctcagttacagatcacaccatgtggctcttaaagtcaattgactctgcctccaccacctctatccagttttctttttctatccctcccctacatgcaagtgtcaggtcagcctcttcaaccccatcttatgagctccacacacagcatatgctcacttctgctttaggaactttgttcatgccctacccttatctaaatcayctaaacctttcctcattcttgaaccacattatagtatccttcaatgtttagattaaattcaacttctgctttgcatcattaatattctgtaaacttctgaataagcatcatatcctgtgtttgaaatatttatgtatatggtctgcttttttatgtgtggttctaccacatcaccagttaaactataatttggtagaaaaatatagcagaaatattgttattgatataaaatgttcatacttttggctaaagaaagcttagtatccttaatataattatgttaaacctgcataaaacaaa

SEQ ID NO: 123864 - DNA, 601 bp, Human
tgcaagtgtcaggtcagcctcttcaaccccatcttatgagctccacacacagcatatgctcacttctgctttaggaactttgttcatgccctacccttatctaaatcatctaaacctttcctcattcttgaaccacattatagtatccttcaatgtttagattaaattcaacttctgctttgcatcattaatattctgtaaacttctgaataagcatcatatcctgtgtttgaaatatttatgtatatggtctgcttttttatgtgtggttctaccacatcaccagttaaactataatttkgtagaaaaatatagcagaaatattgttattgatataaaatgttcatacttttggctaaagaaagcttagtatccttaatataattatgttaaacctgcataaaacaaaggtgaatgtgaagttcaatacaatattaaaagcaactgaatgatgatgcactcgcagtgggcgggggagtttggaacaacaattgggagacaattttatatctttgccatctactatcttcttttttagatatggttgtgaggaaatggatcagaaagtgaatagataaggatcacttaggtccatcttcta

SEQ ID NO: 123865 - DNA, 601 bp, Human
ttcttttttagatatggttgtgaggaaatggatcagaaagtgaatagataaggatcacttaggtccatcttctaagaaagtccttttcattttcttttcatgattgtattaataactggatactttatttcttttcatgattatattaatcactggatacataggtttcccctaatgtatagggggttgaactgttccatatgtccaggtagaattggagaatccttcttaggatgtgttaaacaaaaaggtttcctcattccagagcttagtggagataatctgaccatgccagatttgrctgacaatgatgaaagaaattgtccaagaaatgagaggcttgggaaaatacacaaacccaaacctggaaaggttttgacaaggacacagtagatgatgctatcaagaagagaaaactataaacaggctgatagatggccacatgaaaagagagaacctccttgagtctgacagaatgggcaatcacctggaacatctgtgttagacaatgactgaagcttcctaaagcaggtttgactacatcttgtttgtagtaaaaataatttcatatgcatctaaaagcaaaacaaactgttacaag

SEQ ID NO: 123866 - DNA, 601 bp, Human
caaatgacctgaataggcatttatccaaaaatatatatatatggccaacaccatttatgaataatgttataacacatgaaaagatgctcaacatcactaatcatgagaaaatacaaatcaaaaccacaaagagatctcacctctagcttggatgttctgtacgctccaaatttcatgttaaagtgtgacttctgataccatctcatgccagttagaatggcaattattaaaaagtcaggaaataacagatgttagagaggatgtggagaaataggaatgcttttacactgttggcgagagygtaaattagttcaaccattgtgaaagacagtgtggcaattcctcaaggatctagaaccagatataccatttaacccagcaatcccattactgagtatatactcaaaggattataaatcattctactataaagacacatgcacacgtatgtttactgcaacactattttcaatagcaaagacttggaaccaacccaaatgcccatcaacgatagactggataaagaaaatgtggcacatacataccatggaatactatgcagccataaaaaagaatgagtttatgtgctttgcagggacat

SEQ ID NO: 123867 - DNA, 601 bp, Human
agccaggcatggtggtgggcacctgtagtcccagcttctcaggaggctgaggaaggataatcgcttgagcctgggaggcagaggttgcagtgagccaagattgggccaccgtactctagtctgggcgagagagcaagaccctgtctcaaaaaaaaaaaaaaaaaaaaaaaaaacacacacacacacacacgcacacaaaaacacttaaatgtattaatcttatcctaaattattttatgttttattttatacttatagaagccttcccatgtatcacataaaattctcatgcttaaaaaawatgtgacttccaatgctggaggtaggaaagtaaaatggcacagctgctatggaaaacaatatacaggttcctcagaaaattaaaaatagaactaccatatgatctagtaatcccacttctaggtatttatccaaattatcaaaatcgggctcttgaagatatctttgcattcccatgttaactgcagcattatttacaataaccaaaaggtggaaaaaaaatgtaaatatttcccaacagacgcatggcccaaaaaaggaaggaaatcctgtcatatgctacaccatggatgagcattga

SEQ ID NO: 123868 - DNA, 601 bp, Human
ttgagcctgggaggcagaggttgcagtgagccaagattgggccaccgtactctagtctgggcgagagagcaagaccctgtctcaaaaaaaaaaaaaaaaaaaaaaaaaacacacacacacacacacgcacacaaaaacacttaaatgtattaatcttatcctaaattattttatgttttattttatacttatagaagccttcccatgtatcacataaaattctcatgcttaaaaaatatgtgacttccaatgctggaggtaggaaagtaaaatggcacagctgctatggaaaacaatatasaggttcctcagaaaattaaaaatagaactaccatatgatctagtaatcccacttctaggtatttatccaaattatcaaaatcgggctcttgaagatatctttgcattcccatgttaactgcagcattatttacaataaccaaaaggtggaaaaaaaatgtaaatatttcccaacagacgcatggcccaaaaaaggaaggaaatcctgtcatatgctacaccatggatgagcattgagaattttatactaagtgaaataagccagtcacaggacaaatacagaatgattccacttacgagg

SEQ ID NO: 123869 - DNA, 601 bp, Human
gtctgagaagtctatgcacctcaagcttgagaccttacaatgagctcagctggggaacttatcctgaaaacggatgcctagactcctcaagacatactcctaccaccccttattggctctagatgcaaagaagaatcagatctcaacacgctccagagcaaaaagttccaaatctgaattggaaggaaataacttctactccaaaatatttgcaacattttactaattcatattagcaaaagaaagccaaagaaaccatactaataacagaaatgatgaaacagcaacaaaaataaagtggatatactttatagaatgaaattcaacaggaatttgtatttaacaaaatagcttcaaaatatataaacgaaattgtaagagatataaaaggataaatagaaaacttcaaagtctacttgttggtataaaacgcttcattcagtaactgatagaacaatttaaaaaacaattagtaaggaaatagaaaacttaagaaatgttaatcaaattaacctaatgtacacatgtaaaaacatccaacaattgcagcacagttatgaagttcaaatgtgcatgggacatataccaaaatacataatat

SEQ ID NO: 123870 - DNA, 601 bp, Human
agaagaatcagatctcaacacgctccagagcaaaaagttccaaatctgaattggaaggaaataacttctactccaaaatatttgcaacattttactaattcatattagcaaaagaaagccaaagaaaccatactaataacagaaatgatgaaacagcaacaaaaataaagtggatatactttatagaatgaaattcaacaggaatttgtatttaacaaaatagcttcaaaatatataaacgaaattgtaagagatataaaaggataaatagaaaacttcaaagtctacttgttggtataamacgcttcattcagtaactgatagaacaatttaaaaaacaattagtaaggaaatagaaaacttaagaaatgttaatcaaattaacctaatgtacacatgtaaaaacatccaacaattgcagcacagttatgaagttcaaatgtgcatgggacatataccaaaatacataatatccatgggcataatggaagtatcagcaaatcctaaaaataagaattggggccaggcatggtggctcacacctgtaatcctagcactttgagaggttgaggcaggtggatcacctgaggtcaggagttcg

SEQ ID NO: 123871 - DNA, 601 bp, Human
aaacttgtaggatgcagctaaagcagtgcttacatggaaatttctggctttcatggtatatatgagaaaggagaaagaccgaaaatattttatataaaaagtgatttttaaaaataacagagaaaatacctaattaaacctttaacagaataaaataaaaactaagaatgaaagtacaaaataattcattacacagtagggttaacaataatgtaaatttcaaaatagctagaaatattgaattttctcatcataaagaaatgataaatgtctaaggtaacagatatgctaattacaccartttcattattacacattataaacatatatcaaacatcacactatatcccataaatatgtatagtcattacatgtcaattaaaaataaattttcaacattaatagatgtttaaatttttaaaaaatatttaaaaatcaaagacaaaagctggttcttgaaagtaataataaaatttatgaatatctagcaatattgatcaatattaatagggaaaacaaaaattgtaagtattagttcctatacatattttcaaaacaatgagaatgtactaaggaacaactttatggcaataaatttgaa

SEQ ID NO: 123872 - DNA, 601 bp, Human
aaatgtctaaggtaacagatatgctaattacaccagtttcattattacacattataaacatatatcaaacatcacactatatcccataaatatgtatagtcattacatgtcaattaaaaataaattttcaacattaatagatgtttaaatttttaaaaaatatttaaaaatcaaagacaaaagctggttcttgaaagtaataataaaatttatgaatatctagcaatattgatcaatattaatagggaaaacaaaaattgtaagtattagttcctatacatattttcaaaacaatgagaakgtactaaggaacaactttatggcaataaatttgaaaatttaagcaacatgagaaaacacctttaaaaatacaatgaaaagatttttgggtggagcaagatggctgaatagaaagctccactgatcatccccactgaagaaacaccaagtttgacaactatttacacaaaggcagcaccttcataggaaccaaaaatcaggtgagcattcacagtgccccgttttgacttcttattgctgaagagggtaggaaagacaatcttgaattgctgacatgacccttcccccatcccacctggca

SEQ ID NO: 123873 - DNA, 601 bp, Human
taataaaatttatgaatatctagcaatattgatcaatattaatagggaaaacaaaaattgtaagtattagttcctatacatattttcaaaacaatgagaatgtactaaggaacaactttatggcaataaatttgaaaatttaagcaacatgagaaaacacctttaaaaatacaatgaaaagatttttgggtggagcaagatggctgaatagaaagctccactgatcatccccactgaagaaacaccaagtttgacaactatttacacaaaggcagcaccttcataggaaccaaaaatcagrtgagcattcacagtgccccgttttgacttcttattgctgaagagggtaggaaagacaatcttgaattgctgacatgacccttcccccatcccacctggcacagagaatctgcgcacttgggagagggatggtgcagagattgtgaggttttgcattgaactcagtgcttccctgtcatggcagaaagcagaactgggctgtgctcacctgacacctgcccaaagagggagcatcaacaatctgctgcctacaagaaatgtacttcacctataaagacacacagagactaaaaataaaggg

SEQ ID NO: 123874 - DNA, 601 bp, Human
catggcacatgtatacatatgtaactaacctgcacaatgtgcacatgtaccctaaaacttagagtataataaaaaaaaaaaaaaaaaaaaaaactagtagcagaattgaaaaaaaaaaaaaagagctaataccaatcctgctcaaatagttccaaaaagtagagaaagggatacttctaaactcattctacaaggccagtattacccagataccaaaaccaaagacacatcaagaaaaagagaaccacaggccaataacgctaatcaatattaatgcaaaaatcctaaaaaaaaaaaaaamaaaaaaaactagcaaaccaaattcaaaagcatattaaaaagatcattcatcatgaccaagcaggatttatcactgggatgtaaggatggttcaacatatgcaaatcaatcagcgtggtacatcatatcaacagaatgaagggcaaaaaccatgtgatcatttcaactgatgctgaaaaggcatttcatgaaattcaacatcccttcatgataaaaaaaaaaaactggtataaaaggaacatacctcaacataaaaaaagccaccatatatgacagacccacagctagcatcatgaatggg

SEQ ID NO: 123875 - DNA, 601 bp, Human
cctttccctttgttttcaattagcagcagagtgagagcttggcctgctgaccgcccccttggccagatgagcccccatggatcctagcggcccccatccctgccctcactccagagtgccctctccacccataactgcatggctgtgattagttatatagctcatttggattctacttgcctttatttctcgcatgtgtttgccttgtctcctgctcttgattgtagatggcagaagtttagaattttaagagtctcaggacagacggaatcacacctaatagcacagtgaaagcacagtrtctgactttgccttgtcattgattgagatttgagtctagaagtccctgaatttcagctgacaagaaagggatgggctggcatgagagtcactccatgcccagtgctgggctgaggacagtggctgagcccaccggtggagtcatcatcctctgtagtctccatcggcccctgcaaagctacccaggaaaaatgatgatcttaataacatcttttaatctggacaattgctatttttcaattcaacgtgaagtctgaaaggaacattatttttattaaacttaactcaaaagtatgcttgc

SEQ ID NO: 123876 - DNA, 601 bp, Human
ttaatggttacaaaaggctggttgggccaatttccttagggcatgacctctctggggaagaattctgcacccacaaatcacggatggaacaaggaagtatttttattcatgtgccccgtatcccttttttcttttgaggcgtccaccaaaggctcaggattacctctcctgcctgctcctcacctcaaaggtaaacagaccataaattctgcagtaaagcagtgcaaaggttttaaaggctgtgtttacaaccaggtttgatctctgaaaactgaactttactcaagatagagaaaaatcsgaggaagaaaggaaagggagagatagcttgcatcgcacaaatctcttttcacctcatcggcccccaacctgggagacacacattccttgtattcagaacccagcgttctcacctctcgacatctgccacgcaagttaatggcagttgggtgtttgcatgggagtgctgcccacaaaacctgttcctcatgattaatgatcagttagttaagtgtttcaggtctacaggatggcttctgtggacaagagagaagattctgagcttcagatatgtttgttctgtcaggaagtctgtccctgg

SEQ ID NO: 123877 - DNA, 601 bp, Human
tttaatggttacaaaaggctggttgggccaatttccttagggcatgacctctctggggaagaattctgcacccacaaatcacggatggaacaaggaagtatttttattcatgtgccccgtatcccttttttcttttgaggcgtccaccaaaggctcaggattacctctcctgcctgctcctcacctcaaaggtaaacagaccataaattctgcagtaaagcagtgcaaaggttttaaaggctgtgtttacaaccaggtttgatctctgaaaactgaactttactcaagatagagaaaaatscgaggaagaaaggaaagggagagatagcttgcatcgcacaaatctcttttcacctcatcggcccccaacctgggagacacacattccttgtattcagaacccagcgttctcacctctcgacatctgccacgcaagttaatggcagttgggtgtttgcatgggagtgctgcccacaaaacctgttcctcatgattaatgatcagttagttaagtgtttcaggtctacaggatggcttctgtggacaagagagaagattctgagcttcagatatgtttgttctgtcaggaagtctgtccctg

SEQ ID NO: 123878 - DNA, 601 bp, Human
ttttaattcctctccttgacccattcatttatgtgacagcttctgtgactgagatgacagctagttctgcaactgtgagtggggaattgaaatctcctgtaatttatgttgaaaaaaatcttggatgatttattcctgccaggcactctctttggcctctgaccttcaaaagtcctcacccaaaggacagtttgtgactgggttcctgtttggaaggttgtcgctgaaggtgtatgcagtgtggctggaaacagcaccccggcccttggtggctgcgcttggttccccttaaggaagctcytatgccgtgctggggcctggcctttaattcccagagggcattagtgctagcgacacctcacatcaccactgaggcacctgcctctgttgttctcatgtgcattttccaaatccccaaatctgtgcgtttccagaagtttctggaatggggaagatctcaaggacttacttgttttaatggttacaaaaggctggttgggccaatttccttagggcatgacctctctggggaagaattctgcacccacaaatcacggatggaacaaggaagtatttttattcatgtgccccgtatcccttt

SEQ ID NO: 123879 - DNA, 601 bp, Human
ttgaatactcattgaacgtctgccatatttgcagtgttgctgtgggaaatacaaaagaaatctaagtctttgttttccaagaatttgtggtctagttggatattaagatcagtacacaggaaacaatggggccaatatcagttggaatgcctttgaatgcaagaaacaaaaatctcaactgaaactcacttaaacaagtagctggtcaaatattgtaattaaacatcagaggtagaactgattttaatctagtgggtccagaagttcaaaaacattattgaagacccaggttcctttattmatttccttctgtcaatcccaaggctgcttcatcttagatcgtaagacagcagctatagacatcaggactaagactccttcttcaggtccagcgggagagagtgggcatgtatttttttttttttttttttgagatggagttttgctctgttacccgggctggaatgcagtggcgtgatctcggctcactgcaacctccgcctcctgggttcaagcaattctcatgcctcagcctcctgagtagctgggatcacaggtgtctgccaccatgcctagctaatttttatattttttgtagaga

SEQ ID NO: 123880 - DNA, 601 bp, Human
ctgagccatcaagtctggtatgagttgacacagtgctgctgtgtgctgtgattttggcaaaggctctggatccttctgaatatcttgtttgcaggatagttcctgaacccatgcagtttacaccccgtgggagaggagctgccactcaccggctggttgcttgagtaagatagtttttatttctcttgaactttgaataatttttagctgaattaaccttgagggggtcatttctttaaaattcatgaatatgttcattaaaaacaatttccaaattcaataagacattaaaaaccatcargattctacagatttgggggtttgaccagattctgcctttgaggaagtttgtttgtttatttatttgtttacttattttgagacaagttctggctctatcacccgggctgaagtgcagtggtgccatcttggctgactgcatcctccatctcctgggctccagtgatcctcctatctcagccttctgagtagctgggactacaggcatgcaccaccatgcctggctagttttgtatgttttgtagagatgggattttgccatgttgcccaggctggtcttgaattcatgagctcaagcgat

SEQ ID NO: 123881 - DNA, 601 bp, Human
tactaaaaacatctcttaaagctctgctttttgtgaggcatcgtggcagattcctttctaaggctggctttcacaattaaatgtaaatagatgcccagatgatggaactctgcaggccctcaaagccaaaatctctctgtcatgttacctaaattcccatcatctgtcctactttaatgtcaactgggatgggataactattaagatgttaatcatcatgtctcttatttgaaaatttagcagagagcagagctttgaggcactggggcacaggacaggtgtgttttgaaataggggagtggggaagagaagcagatgacacaggccagtggtattccacaacactggatgccagaaacgcagcacacaaaataaaggagaaggaagaatgaagccctcacttgctctatgaattttctctgttgttcagtttgagtgaatctgaccagatcattgccttttagaagcatatgaccaatgatacaataaaggtatcggtaaacatattgaagacattaacaaatacctatgtttaagtatttccatattggtaaatgcagtctgtggggtgctgagtgatggggaactctgtgaagttcat

SEQ ID NO: 123882 - DNA, 601 bp, Human
ttcagccttttttagtcttcatgagtattctgtaattgtctcctgttggtcccttattgtctttctgtcttgtggatatcgttcttgtgttgttaaaattccagagaaacaactggactttgaaatagtcaataaatgaggcacagaaatggaaacctcaggtattttcatagatctggaagagggtagggaagaaagacccagttagttgaaagtatccgttagacaccatgggaagcccacatgaggcatttacatggaagttctggcgtgtgggctgaggagaggtgacacttctggrttgttttggaatgctgtatctgctccagaaatgctcaaaaactgcagtggtaatgccgatttgagtctccagtagatttaggctcttcttggtacattttggtgccctagcaggagagagaggcagagagagagaaagagagagagagagagagagagagcgacagacagacactcatcatttttgtagattgccagtaggtaaacacaagtgttttattaaactatgtatcaagggctaggcaggaggatcacttgaggataatttgagaccagcttgggcaacaaagcaagaccctgt

SEQ ID NO: 123883 - DNA, 601 bp, Human
gttagccaggcatggtggcacatacctgtagtcccagctactcaggaggctgaggtgggaggttgacttgagcccaggaggtggaggctgcaatgagccaacatcaagccactatacttcagtctgggcaacagagctagatcctgtctcaaaaagcaagcaagcaaataaacaaacattttctctttattctcacaacttgtgaagcagacaaagatctgcttctgtttcacacaggaagacactgaggccaaagagtttaagtgattcagtaagttgttgagtcaggattgaaaggcarcattagatatttgtccagtgtcgtaactatctccctgatatgggaaatgatgatgatttcagccttttttagtcttcatgagtattctgtaattgtctcctgttggtcccttattgtctttctgtcttgtggatatcgttcttgtgttgttaaaattccagagaaacaactggactttgaaatagtcaataaatgaggcacagaaatggaaacctcaggtattttcatagatctggaagagggtagggaagaaagacccagttagttgaaagtatccgttagacaccatgggaagcccac

SEQ ID NO: 123884 - DNA, 601 bp, Human
gcaaatacctctgggataagcctttagtgactttgggtaatggaactggaactctcatcaattcctacgttttataatttgtagtttgggaattgaggttaaatgttagagaggatttttcttttttaatttttaatttttatattttcttagagacagggtctcactctgttgcccaggctggtcttaaatccctgggctcaagcagtcctctaccttgatctcccaaagtgctgagattacaggcatgagccactgcacctggtccaggatttttcttttctttctttctttcttttcttttttttttttttgagacagagtttcgctcttgttgcccaggctggagtacaatggcacgatctcagctcactacaacctccgccgcctgggttcaagtgattctcctgcctccgcctcccaagtagctgggattacaggcatgcaccaccatgcccggctaattttttgtatttagtagagatggggtttcacaatgttggtcaggctggtcttgaattccggacctcaggtgatccactagcctcggcctccaaagtgctgggattacaggcgtgagccaccgcgcccagccggtttt

SEQ ID NO: 123885 - DNA, 601 bp, Human
tgcatgtagatactttgaaattgttttcttaggaaaatctcagcagtagcaaatgaagacaggacttcaggaagaggggccactcttctacctctgtcctctctggagggagacacacagcactttcaagccatctcacagagggcgactggttgtgatttctcaggccctttaaatacctctcctctgctccttctgcttctgccttcatttcctcccactctccttctcagtgcctttcctcagcccaaagctgtcccttggactcctcctgaacatctgtctcccccaaaggctctcrtctgaatgatccagcttttcactcctggctcctttctgaagatctgtcctgaaatgcaggaagcggggaggggaacaacacatatttgaatcctatcagcctcttgatctggtgtcttatctaaatattatttcttgtcctacttacatcacaagcccataaggcataggccatgcctttacatgtgtcatagagaacagagaatgcagttgactcttggcaaacgtgtgttgttgttgtaagttgttaataattggaagatgtgagtagatgttctggggaggtaaaatcagagctaga

SEQ ID NO: 123886 - DNA, 601 bp, Human
ttcctcccacctatatcctatgtttatacattgccttcataatgatcatttttgatgtctgcataatattgatcatgtggacaccctgaatgtactaagcaaactcttgatttaatttttttttttttttgagatagggtctccctctgtcacccaggctggagtgcagtggcacaatcatagctcactgtaaccttgaactcctgggctcgaggatccctcttcagcctcctgagtagccatcactacaagcatgtgccctcatgcccagctaaaatctactctcttggcaaattaccastatataatacaatattattaattataatcctcatgttgtacatcagatctctttaacttatttatcctacataattgcaactttgtaccttttgaccaaaggaaatgaaatcaccaccttataaaggtatctgcattccctcattcattgcagcattattcacaatagccaagatcgggaaccaaccaaagtgtacatagacagatgagtggataaagaaattgcagtatagctatctgtctctatacacatataatggaatattattcagcctttacaaagaagatggaaattctgtca

SEQ ID NO: 123887 - DNA, 601 bp, Human
atattatccattcctcccacctatatcctatgtttatacattgccttcataatgatcatttttgatgtctgcataatattgatcatgtggacaccctgaatgtactaagcaaactcttgatttaatttttttttttttttgagatagggtctccctctgtcacccaggctggagtgcagtggcacaatcatagctcactgtaaccttgaactcctgggctcgaggatccctcttcagcctcctgagtagccatcactacaagcatgtgccctcatgcccagctaaaatctactctcttggmaaattaccagtatataatacaatattattaattataatcctcatgttgtacatcagatctctttaacttatttatcctacataattgcaactttgtaccttttgaccaaaggaaatgaaatcaccaccttataaaggtatctgcattccctcattcattgcagcattattcacaatagccaagatcgggaaccaaccaaagtgtacatagacagatgagtggataaagaaattgcagtatagctatctgtctctatacacatataatggaatattattcagcctttacaaagaagatgga

SEQ ID NO: 123888 - DNA, 601 bp, Human
actttcacagcttccattccaagccaataactcacttctgggccccacaagtgacctgtgttctacacctctatcaattttccccgaggtgacttattcattagcaaatgtgaaaaattactaattagcaccccttccatgtgaaagcagtctagactattggtgggtgttcaaaaaggaagacaacttctcccatcctcttgccttctgagatacttggatttacacaggaaggatgtctccactaatgaaactaccacagccttagagacattttaaatggaaaaagtggatataaaartaatgctaaaaaagtttgaaaaggcacactggcagcaatgaggtgaaaaaaaaggtctgaagaaaatgtaaaaaacccataaaacccataatactaccatcttcatatgatagaagcatttatatattttcatattttctagttttggtccacaaataaagacacatttatttggcattgtggcaagctcattgtaacatactcactgaatattatccattcctcccacctatatcctatgtttatacattgccttcataatgatcatttttgatgtctgcataatattgatcatgtgga

SEQ ID NO: 123889 - DNA, 601 bp, Human
tctctcaagttgctaggattataggcgtgagcaaccaagctcagctggtgctaagttttaagaaataaaataaccagaaaaattaggccaagtgaaatagttcaacttagcttagcaatggcaagctcaggtcttttccaaataatgaggaaacctggtgaaaccacagtaacctcagtgagctgtggcctttgctgacgagatgggtgatcagaatttgaggcaaatggtccaagtagctgtttatcgtcttcaactttcacagcttccattccaagccaataactcacttctgggcccyacaagtgacctgtgttctacacctctatcaattttccccgaggtgacttattcattagcaaatgtgaaaaattactaattagcaccccttccatgtgaaagcagtctagactattggtgggtgttcaaaaaggaagacaacttctcccatcctcttgccttctgagatacttggatttacacaggaaggatgtctccactaatgaaactaccacagccttagagacattttaaatggaaaaagtggatataaaaataatgctaaaaaagtttgaaaaggcacactggcagcaatgaggtg

SEQ ID NO: 123890 - DNA, 601 bp, Human
ctatgaacctaagactgccctaaaaaataaggtgtattcaaacctgaacacaccttaatgtattcaggctgtgggccttgccgaagatgggacagctagtaagataatgcctgttaaattcttttttaaaaaaatcatttggataaaagtgcttttgaaagacagggttttgtcaagtgctatgatctcatcatctggcagccccggcgggcaaggagtccaagggaaacccagggcgttgacaagtgggtgactcaggtgccggccctgctggcggtgagcaactgcggggttggaaccygtgggaggggcagggagatgtgctgagctcctttctggccagtgctgatgtcatcaaagccccagggctaaggctgtgctttccacctgccctcagaagcaccagtactcctggtttcttatttatttattttttctcttctctctggttttctgggttgtgttttcccctttgttcttaaatagttagttgggacctgtggtagctctttcaagggctctgctaacacaggacagccctggaccttggcttatagggactttatatcctcattgtcagtccctggggcagttaatatgc

SEQ ID NO: 123891 - DNA, 601 bp, Human
ttggcagaggtatgatttggcccaatccactcacttgaaagctcccactccctgtggccactcctttaaaacagagccttgctcctcaaaatatggtctgatcacctgcagcgtgggcatcccctgggagcttgttggagcagctcaggctctgtcccagacctattcaagccaaatctggatttagcaagactctcgagggatttgtattcaagtaaaagtttgaggagcactagtttagatgattctgctttagaaaaaactttccctacgcgttaatacttatcaagtgttcccttgytttatggctgaagaaggaaagcatcacactaaggatggagagaaggctgtcctggttggggagggtggagtccttgctctactgagagggtgtgcatttctgaacccttgttgcctgtttctctccttgaaaactgaatatgtcataggatgtacaacaccaagggtgagccctaacacggactatggactttggattgtaaccaacgtagcactctggtgcaggatgtggggatgcggatagtgggtggggctgtgcgtgctgggggaacaaggggtctgtgagagctccgtactttct

SEQ ID NO: 123892 - DNA, 601 bp, Human
ggagttcaagaccagcctggccaacatggcaaaaccccatctctactaaaaatacaaaaattagctgggcgtggtggcacatgcctgtaatcccagccactggggaggctgaggccggagaattgctggaacctgggaggtggaggctgcagtgagccaagatcataccactgcactccagcctgggcaacagagtgagactctgccttaataataataatactaatagtaacaaaaaggagagtaacagtagttacgctcaggtcattgagtgccagctcggaactgaactttgcattcwttgtcctcttgagtcctgcaacgtaggtttgatcatcacattgttttagatccagccattggcagaggtatgatttggcccaatccactcacttgaaagctcccactccctgtggccactcctttaaaacagagccttgctcctcaaaatatggtctgatcacctgcagcgtgggcatcccctgggagcttgttggagcagctcaggctctgtcccagacctattcaagccaaatctggatttagcaagactctcgagggatttgtattcaagtaaaagtttgaggagcactagtttaga

SEQ ID NO: 123893 - DNA, 601 bp, Human
tagttctgttttttgctctttcaggaattgccatactgttttccacaatggttgaactaatttacctcccaccaacagtgtgtaagtgtttccttttctctgcaacctcaccagtgtctgttattttttgactttttaataataaccattctgattggtgtgagataatattttgtatgtatataggtctgcacatttttccggggaaaagttcattgctttcatcagattctcaaaggcacatgtaatgcaaagtaggttaagaacaagggatcacttctgattgcttggtttgtaacamaataagaaaaataaggagatacaattcagcttctcataaagctacaattctaagaatgccttttattctgggattatgcccattcactgtctctctctttttgctattaggttttcttttatgggatgatggtctagtgaattgtaattacaaaaaaaaaatttctctcttgacaaagccggaagttggtaaaatcttcaactaagagttctttctttttttctggcttgtgaaatcccacatcctggaaaccactaatctagagggttgtctttctatctgcacgtgatttaggggtgt

SEQ ID NO: 123894 - DNA, 601 bp, Human
ggtgaaaccccatctctactaaaatacaaaaattagctgggcgtggtagcacatgcctgtagttccagctacgggggaggacaaggcaggagaatcacatgaacccaggaggcggaggttgcagtgagctgagattgcgccactgcactccagcctgggagacagagtgagactccatctcaaaaaaaaaaaaaaaaaaaaaaaagaaaagaaaagaaattgacatcatgtgtttactgactagatgcttttttttcttttaatcactgcgatgtcattcatctagtgagcgctcaatacrtgtttttttggattaaaacatattttaaaaatttatatatcattaaaaagacatttgcactacagaagctcctgggtgatgataggtagacccaccctctccattaactatcttgtagtttagaggactccagagtatattggaaagaaccaaggctttgcaataatacagacctggacttaaatcctgaattttctacttgtcagctgtgcaaccgtggtcataattcttaatttctctgagactcagtttatttatctgtagaattggagtaatgggatatctcccagagttgttaaa

SEQ ID NO: 123895 - DNA, 601 bp, Human
agtcttgctctgtcacccaggctggagtgcagtggtgggatctcggctcactgcaacctctgcctcccagattcaagtgattcccctgcctcagcctcccaagtagctgggactacaggtgtgcactagcatgcctggctaattttttttttaatttttagtagagacagggtttcaccatgttgatcagactggtctcggactcctggcctgaagtgatctgcccacctcagtgtcccaaagtgctgggattacaggcatgagccaccacatccggcctaatttgttttgttttgagackcagtcttgttaggttgcccagactggtatctaattcttcaagccattctcccacctcagcctcccaaagtgctgggattacaggcttgagccactgcaccaagctgtggtgtttgatcaagcaactaggcaccagagcctagctaggctgacacataaaattaactatcgctctccacacgcttggccactgatccttagcaactgggcctcagtccaaagttagagagcttaactgaagaggacattgtgatgatgaagcttgccgggggccatagggatctctgttagaactccctca

SEQ ID NO: 123896 - DNA, 601 bp, Human
catcttacctgaagccttctcccccttttgactccggagacatcatagataaatcagggctgtggtgaaatggaaacactgtgccttcagagtcatgcaaatgggggtttgaatcttggctccacacagcagctctgaggcttgaacaagttctggaatctctcaaggctgcagtgctcttatctcaaaaaggagggtgacataatctgcctcgtatgccagtcttcagccttgaagccttattcaacttctgctttttgagggtaggggcagagtttgtaccctggaacatgatgctagsatagtgcctttcacaagatgggcactcactaatttatctgctttccacttcccattttcagcctagagtcacaccattcattcatgctccatgtgttagggttctccagggaaacagaaccaataggatatatacatatataatccatatattggatttttgattttatatatatccttgaatatatatatatatatatatatatacatatatagagagagagagagagagagagagagagagagacagagacagagacagacagacagagagagagagacagagagacagagagagatt

SEQ ID NO: 123897 - DNA, 601 bp, Human
tattcttaggtgttcaatactttttgatgttagtttattctaatggattgtcatgttcattaagagtatagtaagcctctttcccagaaccatttaaaattctcatattttttttcggttgattctcttgtgttttctgagagaatatgcagtttctatttgtactgctggtggttcaggtgttggtggaaacacttttcatggtgttgtctgattaaggaaatctaggtacctcacactgcatttattcacttaaatcatcaattcatataactttagagatggaagagacttgactgargtccagctgaggaaactgagtctcagaaaggttgggttgtggttcgtcagtatagagctcaggtttccaggctcggggatccatgaccttggtgctgtgggctaggctgagaggtccctgaaggaaatgcaagaaccaaacattgtgagcaaaagcttggactttggcagaggctataacttctttttactctgagtaatgcttcattaatcggtttaggaattaacaagatactgagacttgggccagtatgggttttcaaagattgcatgtgtctccaaacaccacctctgagttcct

SEQ ID NO: 123898 - DNA, 601 bp, Human
gttatcagtctcattgatttgagaagttcttcgcatgttaaggaaagcagccctttgtctgaaatatacttgaaatatatatacatatattctggctttttgttttactttgtttatactttttaaaaagtcatgatgatcttttctttcataaagtaattcaatttattggtcttttcttttatgactttggagttttgtataatattaggaaggccttccccaccattaagatgatttttttaaaatcccgtgttttcttctagtatttttatggttttatttttgaggtttgcattgttttttaaatctggaacttttgttgttggttgttgtaacatgtagaatatatattcaacatttgtccaaatggcaaccttattgtcacagcatcatttcctgaaaaatccatttccctcccactgattgaaaatagaaagtcaaaattatataaattctcatatgtatatgtactcttttataaattcttatgtggatatatatttaatataaatttacatatacatttgggtctatttctatctattttgtaccaatgatatgtttatatatgtgtcaatctcatacttttttttgatta

SEQ ID NO: 123899 - DNA, 601 bp, Human
tttctttgtcacacaagtctggtgtcaaacattctgatcttgtcagtcttgattctctgagttttgttttgcatttctcttattgtgagtgaagtcgaacatattttcctatgattaggagccatgtgtaattccttttatgtgaactttttgcccatctctgtccattttctttacttattttttctattgggttatcagtctcattgatttgagaagttcttcgcatgttaaggaaagcagccctttgtctgaaatatacttgaaatatatatacatatattctggctttttgttttaytttgtttatactttttaaaaagtcatgatgatcttttctttcataaagtaattcaatttattggtcttttcttttatgactttggagttttgtataatattaggaaggccttccccaccattaagatgatttttttaaaatcccgtgttttcttctagtatttttatggttttatttttgaggtttgcattgttttttaaatctggaacttttgttgttggttgttgtaacatgtagaatatatattcaacatttgtccaaatggcaaccttattgtcacagcatcatttcctgaaaaat

SEQ ID NO: 123900 - DNA, 601 bp, Human
ccatcgctgtctgagagcagagactatgctttttctttctccgctcgcatctcagaaatacacaagtatcatttgcaacacaggtatgcctaggttgaagaaattgagtaaacatgcatatttctcgcagttagttctttctttagaacatagaagagagtgcctagctgttagctggaaagtttagaggtatcattctatttttggagtgagtcccttccccttttcttgtaacttcaagtgcagcttattatgctcttatctagctcaaaagattagggtaaagcattttgtaaagtgwaaaaaagctggtgaaatgatgaacagtggttaaaactgaacatgagagggaacaaggaataccttgtggtgtaaaatctctgtgcttagctgtgccaaagaatttttttcaggaaaacttgcacaagatcttggcagtggtgtcttgggctttatctttttaagtaagtgttcattactgcttacatcattgttgctattattattttgataagtgtgcattgccaaggatgctctgtgtcaggggttctccaactcccatgtgcacgagaatcacacacagggcttgtgaaaatcgcag

SEQ ID NO: 123901 - DNA, 601 bp, Human
aatcacttgaacctgggaggcagaggttgcagtgagccgagatcgtgccactggactccagcctgggcaacagagtaagactctgtctcaaaaaataaaataaaataaaataaaataaaaaaggtgaagaaatagaagaacacagaaggaagccatcgctgtctgagagcagagactatgctttttctttctccgctcgcatctcagaaatacacaagtatcatttgcaacacaggtatgcctaggttgaagaaattgagtaaacatgcatatttctcgcagttagttctttctttagaayatagaagagagtgcctagctgttagctggaaagtttagaggtatcattctatttttggagtgagtcccttccccttttcttgtaacttcaagtgcagcttattatgctcttatctagctcaaaagattagggtaaagcattttgtaaagtgtaaaaaagctggtgaaatgatgaacagtggttaaaactgaacatgagagggaacaaggaataccttgtggtgtaaaatctctgtgcttagctgtgccaaagaatttttttcaggaaaacttgcacaagatcttggcagtggtgtcttgg

SEQ ID NO: 123902 - DNA, 601 bp, Human
tgccagaaagtcttagtttatagggactttggataaatatattgtggttgatagttccaaattgcttctaaggaaagttaggacgttgcaggtgcgtgtctgcacctctgagactcatgtcagagcaagcacccatgctcctctgaatattctccagcatattccaagtctgcactagggaaccagcgtgacgacgggtgcttcactgctcttgccgcctggtagctgttacagggaagtgaccattacacagttgatgtcactattttggctcaagagatacttattttgcttggtggcttttttttttttttttttaaagaaagaaccttttaaaaatgactaaaatatagtgattaaagaatgtttaatgaggagaggtgcttatatttcagttatcagtggtctgtctgtcaaaataatcatctacatatcctatagctttggggcaagttgtttgctctctctggatctcagtagccaaaaaatggcgagatctggcagttggggtctagaagttcccttctatctgtgtttacatcccacagtcccatgggcagactgtatgcaaggtgatggcaggtctgtggctgagtttgag

SEQ ID NO: 123903 - DNA, 601 bp, Human
tctgtgtggctgaaccttcagcagctgcattctgagaaggccacttcgcttatgaccttctggtggggctgggatcaggcaggagaaggtgatagacatcagtaggacaggcagaagaggagtcaaagggtgttttcagttggttcaacttcaagataaaggatgccagaaagtcttagtttatagggactttggataaatatattgtggttgatagttccaaattgcttctaaggaaagttaggacgttgcaggtgcgtgtctgcacctctgagactcatgtcagagcaagcacccatgytcctctgaatattctccagcatattccaagtctgcactagggaaccagcgtgacgacgggtgcttcactgctcttgccgcctggtagctgttacagggaagtgaccattacacagttgatgtcactattttggctcaagagatacttattttgcttggtggcttttttttttttttttttaaagaaagaaccttttaaaaatgactaaaatatagtgattaaagaatgtttaatgaggagaggtgcttatatttcagttatcagtggtctgtctgtcaaaataatcatctacatatccta

SEQ ID NO: 123904 - DNA, 337 bp, Human
aataaattaacttcttgctcatgggaaatgtttttcacagtccttggaaatttgatgtaatttcagatcacagataaattggctgctttgctgggagggcaacccagcgagtcttcaatgctgtgccagattccagggtgagttcaggttggagcagtgtagtggggagaaaggtggcaggcagaagcaaatattttcagaatcaggcagtgctggcttattaagatgcttctctctctctctctctctctctctctctctctccctccctccctctctctctctctctctctctctctcyccctccctccctccctccctttctctccctctctcc

SEQ ID NO: 123905 - DNA, 353 bp, Human
ttcatttcccagtgcaaataaattaacttcttgctcatgggaaatgtttttcacagtccttggaaatttgatgtaatttcagatcacagataaattggctgctttgctgggagggcaacccagcgagtcttcaatgctgtgccagattccagggtgagttcaggttggagcagtgtagtggggagaaaggtggcaggcagaagcaaatattttcagaatcaggcagtgctggcttattaagatgcttctctctctctctctctctctctctctctctctccctccctccctctctctctcyctctctctctctctctccctccctccctccctccctttctctccctctctcc

SEQ ID NO: 123906 - DNA, 361 bp, Human
gggaaccattcatttcccagtgcaaataaattaacttcttgctcatgggaaatgtttttcacagtccttggaaatttgatgtaatttcagatcacagataaattggctgctttgctgggagggcaacccagcgagtcttcaatgctgtgccagattccagggtgagttcaggttggagcagtgtagtggggagaaaggtggcaggcagaagcaaatattttcagaatcaggcagtgctggcttattaagatgcttctctctctctctctctctctctctctctctctccctccctccctcyctctctctctctctctctctctctccctccctccctccctccctttctctccctctctcc

SEQ ID NO: 123907 - DNA, 373 bp, Human
caggaaagcaaagggaaccattcatttcccagtgcaaataaattaacttcttgctcatgggaaatgtttttcacagtccttggaaatttgatgtaatttcagatcacagataaattggctgctttgctgggagggcaacccagcgagtcttcaatgctgtgccagattccagggtgagttcaggttggagcagtgtagtggggagaaaggtggcaggcagaagcaaatattttcagaatcaggcagtgctggcttattaagatgcttctctctctctctctctctctctctctctctctctctccctccctctctctctctctctctctctctctctccctccctccctccctccctttctctccctctctcc

SEQ ID NO: 123908 - DNA, 374 bp, Human
tcaggaaagcaaagggaaccattcatttcccagtgcaaataaattaacttcttgctcatgggaaatgtttttcacagtccttggaaatttgatgtaatttcagatcacagataaattggctgctttgctgggagggcaacccagcgagtcttcaatgctgtgccagattccagggtgagttcaggttggagcagtgtagtggggagaaaggtggcaggcagaagcaaatattttcagaatcaggcagtgctggcttattaagatgcttctctctctctctctctctctctctctctctcttcctccctccctctctctctctctctctctctctctctccctccctccctccctccctttctctccctctctcc

SEQ ID NO: 123909 - DNA, 583 bp, Human
acatgacccaatcatttctcaaaagggaatgcattcaaatagatgctgcacctcagcttaaagaatccccagaccgtatatcgtggactggagaatttatgtcttctgtcacacatggctgatttgaggccatcttaaataagtgaaggctctgtctggggtctcttttcagggtcacttaatgttgtttcctggtgcttatgggagggtcaggaaagcaaagggaaccattcatttcccagtgcaaataaattaacttcttgctcatgggaaatgtttttcacagtccttggaaatttgmtgtaatttcagatcacagataaattggctgctttgctgggagggcaacccagcgagtcttcaatgctgtgccagattccagggtgagttcaggttggagcagtgtagtggggagaaaggtggcaggcagaagcaaatattttcagaatcaggcagtgctggcttattaagatgcttctctctctctctctctctctctctctctctctccctccctccctctctctctctctctctctctctctctccctccctccctccctccctttctctccctctctcc

SEQ ID NO: 123910 - DNA, 601 bp, Human
atgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtggctccctgwgtgtacagtatttttttacttcttttcatgcacttattacagtcattctatggggttcagtctgaatctttcaagagaaggaatgtcttccttagtcctggtgaatgctactctatagagggacagtgtccatagccagtgtgtgtgtgtgtgtgtgtttctgggtaattcagtaaggcccacgtgcaccctgatatcataaggtgggccagaacaatggttaagagtgttgggtatgcaggcagatcactaggcttcaattccctgcttggccgtggataagctctgtgaccttgggca

SEQ ID NO: 123911 - DNA, 601 bp, Human; identical to SEQ ID NO: 32241

SEQ ID NO: 123912 - DNA, 601 bp, Human
tagaggatgttagcattttctttataacgtggtctgcttcagacatggactgttcttgtaaagaattaaggtaaatgaggtagattttaaagcctgtatatgcataggtttattttccatgaagtcaatgttcaaaaatttcactgatcagggaatgttgaactgtgcagcttttctaaaaagtctaaaaagactttgccatcactggataagccttgttagagtgtgtgtgtgtgtgtgtgtgtgtgcgcgcgcacgcatgcgtgcgctctgcattttctctttggaaatgatcaggttrtgtgtgcatcattaatgcctattcacccacacagtgaggtttgtttcacagtcagagatcttagagcttggcactttttacaaataggatttcttcagttccccttccttttgtccagctttgcatcttgccagtggctcctgccctgagttctaaagtttcgaaggcttaagtggccagggtcaggtcagtggcactgtgtgcaatgcagggaaaggcccccacttgctgggggcaggggatagtaacgccggcttcatttctcctgccctgggtctgcccaggagcagctctggccct

SEQ ID NO: 123913 - DNA, 601 bp, Human
aaaaaaaaaaaaaaaaaaaaaaagaaagaaatcattgccatgatcatggcagatagaggatgttagcattttctttataacgtggtctgcttcagacatggactgttcttgtaaagaattaaggtaaatgaggtagattttaaagcctgtatatgcataggtttattttccatgaagtcaatgttcaaaaatttcactgatcagggaatgttgaactgtgcagcttttctaaaaagtctaaaaagactttgccatcactggataagccttgttagagtgtgtgtgtgtgtgtgtgtgtgtgcgcgcgcacgcatgcgtgcgctctgcattttctctttggaaatgatcaggttgtgtgtgcatcattaatgcctattcacccacacagtgaggtttgtttcacagtcagagatcttagagcttggcactttttacaaataggatttcttcagttccccttccttttgtccagctttgcatcttgccagtggctcctgccctgagttctaaagtttcgaaggcttaagtggccagggtcaggtcagtggcactgtgtgcaatgcagggaaaggcccccacttgctgggggcaggggatagta

SEQ ID NO: 123914 - DNA, 601 bp, Human
cctgggagacagtgagactctgtttcaaaaaaaaaaaaaaaaaaaaaaagaaagaaatcattgccatgatcatggcagatagaggatgttagcattttctttataacgtggtctgcttcagacatggactgttcttgtaaagaattaaggtaaatgaggtagattttaaagcctgtatatgcataggtttattttccatgaagtcaatgttcaaaaatttcactgatcagggaatgttgaactgtgcagcttttctaaaaagtctaaaaagactttgccatcactggataagccttgttaragtgtgtgtgtgtgtgtgtgtgtgtgcgcgcgcacgcatgcgtgcgctctgcattttctctttggaaatgatcaggttgtgtgtgcatcattaatgcctattcacccacacagtgaggtttgtttcacagtcagagatcttagagcttggcactttttacaaataggatttcttcagttccccttccttttgtccagctttgcatcttgccagtggctcctgccctgagttctaaagtttcgaaggcttaagtggccagggtcaggtcagtggcactgtgtgcaatgcagggaaaggccc

SEQ ID NO: 123915 - DNA, 601 bp, Human
gaaggaataagagctcctgaacttttagaaggaaaaaggtgattttaaaaagtacatgattatggcgaaatttttcaaaaagcttctcaaaagcaactttattcaaactgttgtctaaacagattttagttattttggtttgattttactaaattatatgatgtttcctatttggcctttttcatgtgaatgggaggaatgggtggaacagggcaaaggtgaacttgtgcttcaagaaatcattgtggccaggcacagtggctcacgcctgtaatcccagcactctgggaggcccaggcargcagatcacctgaggtcaggagttcgagaccagcctggccaacatggtgaaaccccgtctctactaaaaatacaaaaattagccaggtgtggtggtgcatgcctgtaatcccagctactcgggaggctgaggcaggagaatcacttgaactcaggagatggaggttgcactgagctgagatcgtgccactgtactccagcctgggagacagtgagactctgtttcaaaaaaaaaaaaaaaaaaaaaaagaaagaaatcattgccatgatcatggcagatagaggatgttagcattttctt

SEQ ID NO: 123916 - DNA, 601 bp, Human
ttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacggggtctcccaatgttgcccaggctggtctcaaattcctgggcttaagtaatcctccctcctcggcttcccaaagtgttgggattaaaggcmcgagccaccgtgcccagcctgcttatgcttcttgttgctggctgtggtggtggtgacagatccctctgctgtcttggcacttccctgccatttgagatgggctatttcctgggccagttcaggaaccctctccatttcagaaaataacacttgttgcggtgaagtcagatttagtcagaggcatatgctgatgtgcctgttttcgaataagaaaatcaatgcaaagttggacgtgagatgtatcattataaggaagctcactctaatagttcctttctaaataaataattcttttgtaat

SEQ ID NO: 123917 - DNA, 601 bp, Human
ccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacgrggtctcccaatgttgcccaggctggtctcaaattcctgggcttaagtaatcctccctcctcggcttcccaaagtgttgggattaaaggcacgagccaccgtgcccagcctgcttatgcttcttgttgctggctgtggtggtggtgacagatccctctgctgtcttggcacttccctgccatttgagatgggctatttcctgggccagttcaggaaccctctccatttcagaaaataacacttgttgcggtgaagtcagatttagtcagaggcatatgctgatgtgcctgttttcgaataa

SEQ ID NO: 123918 - DNA, 601 bp, Human
taagcagccaacagtcgactttctaatgtgtatggatcctggctccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagckgggactacatgcccagctaacttttgtattttttgtagagacggggtctcccaatgttgcccaggctggtctcaaattcctgggcttaagtaatcctccctcctcggcttcccaaagtgttgggattaaaggcacgagccaccgtgcccagcctgcttatgcttcttgttgctggctgtggtggtggtgacagatccctctgctgtcttggcacttccctgccatttgagatgggctatttcctgggccagttcaggaaccctctccatttcagaaaataacacttgttgcggtgaagtc

SEQ ID NO: 123919 - DNA, 601 bp, Human
gcttcccctccttctcatactcctgtgtgggctgcctttggttccttgcccaggagtccttgccctctgctattccttttctgactcttggtctaccttcctgtctcagccactcatttgttgttcatgataagcagccaacagtcgactttctaatgtgtatggatcctggctccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacggggtctcccaatgttgcccaggctggtctcaaattcctgggcttaagtaatcctccctcctcggcttcccaaagtgttgggattaaaggcacgagccaccgtgcccagcctgcttatgcttcttgtt

SEQ ID NO: 123920 - DNA, 601 bp, Human
gagagtccaagctgcttcccctccttctcatactcctgtgtgggctgcctttggttccttgcccaggagtccttgccctctgctattccttttctgactcttggtctaccttcctgtctcagccactcatttgttgttcatgataagcagccaacagtcgactttctaatgtgtatggatcctggctccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacggggtctcccaatgttgcccaggctggtctcaaattcctgggcttaagtaatcctccctcctcggcttcccaaagtgttgggattaaaggcacgagccaccgtgcccagcctgct

SEQ ID NO: 123921 - DNA, 601 bp, Human
agtagctgggattacaagcatgctccaccttgctcggctaatttttttgtgtcagtagagatgaggtttcaccatgttggtcaggctggtctcaaactcctgacctaaggtgatccacctgcctcggcctctctaaagtgctgggattgcaggcgtgggccaccgcgcctggcctagccaatttaattcttgcaataatcttatggcataggtgcctctttttatcccactttataggtgtggaaactgaggcacacaaagctgtatgtcaggcttctggtttacctctcccacatggtcygttcactcttttgcttcatccttctgtttttcagctggcttttcttctgaacaggccaggtgaccacctctcttcatccgccctgcctcccattttgaacatccttctctcgccaataacaatagcttccctttacggaatgtttaacatggcaaggcaccttgccttcgcttttacaaacgttagctcatttaattgtcgcaaccatccctgaggtgggaaatgtgaggacccaggcacagaggaggctcaggggggactgcactcagcaggggactgaatcaggacaggacttgagag

SEQ ID NO: 123922 - DNA, 601 bp, Human
cggtgtcaggtgcctgtaatctcagccactccagaggcgaatcacttgaacctgggcaacagaggttgcagtgagccgagatcatgccactgcactcaagcctgggtgacagagtgagatcctgtctttaaaaaaaacaaaaaaaaagaatttaacaacatatctattttaaatgtcataattttcataatttcaaaaacacttcaatttgaaaatcagctgactttgttaagaagggggttgaccatcagaggacctactatcctctgtaagcattatggtgttgcagaagaagaccatsaggatgactgaactgatttgtgagggaagtctaaaggctttcacacaccaacagaatcattaccacccaatatctctagggacctatttccccacttatatgatgaagatcacacctgttatctcaactttgtgggaatgtcccgataattgcaaaaatccttaatcccttaagagatcatttctgttaacccagttcatatgcctctttctgctagcaaacagcttaaagagtttatgcaaatacctagcacctatagcctttagcaaatgccgggcaaaatttaagttgattttttaa

SEQ ID NO: 123923 - DNA, 601 bp, Human
cagggcacggtgtcaggtgcctgtaatctcagccactccagaggcgaatcacttgaacctgggcaacagaggttgcagtgagccgagatcatgccactgcactcaagcctgggtgacagagtgagatcctgtctttaaaaaaaacaaaaaaaaagaatttaacaacatatctattttaaatgtcataattttcataatttcaaaaacacttcaatttgaaaatcagctgactttgttaagaagggggttgaccatcagaggacctactatcctctgtaagcattatggtgttgcagaagamgaccatcaggatgactgaactgatttgtgagggaagtctaaaggctttcacacaccaacagaatcattaccacccaatatctctagggacctatttccccacttatatgatgaagatcacacctgttatctcaactttgtgggaatgtcccgataattgcaaaaatccttaatcccttaagagatcatttctgttaacccagttcatatgcctctttctgctagcaaacagcttaaagagtttatgcaaatacctagcacctatagcctttagcaaatgccgggcaaaatttaagttgat

SEQ ID NO: 123924 - DNA, 601 bp, Human
ctcacacctgtaatcccagcactctgggagggcaaggtggatggatcatgaggtcaggagttcaagaccagcctgaccaatatggtgaaacccggtctctactaaaaatacaaaaattagcagggcacggtgtcaggtgcctgtaatctcagccactccagaggcgaatcacttgaacctgggcaacagaggttgcagtgagccgagatcatgccactgcactcaagcctgggtgacagagtgagatcctgtctttaaaaaaaacaaaaaaaaagaatttaacaacatatctattttaaatgtcataattttcataatttcaaaaacacttcaatttgaaaatcagctgactttgttaagaagggggttgaccatcagaggacctactatcctctgtaagcattatggtgttgcagaagaagaccatcaggatgactgaactgatttgtgagggaagtctaaaggctttcacacaccaacagaatcattaccacccaatatctctagggacctatttccccacttatatgatgaagatcacacctgttatctcaactttgtgggaatgtcccgataattgcaaaaatccttaatcccttaa

SEQ ID NO: 123925 - DNA, 601 bp, Human
ccaaattttgaggggaaaaaagatcatcagagacctagtttccaaaaattagtatttttttgtttgttttttagagacagagtctcactctgttgcccaggctggagtgcaatggcacaatctcggctcaccacaccctctgcctcctgggttcaagcaattctcctgcctcagcctcccaagtagctgagactacaggtgcacactaccatgccaggctaatttttgtattttcagtagagatggggtttcactatattggccaaagtggtcttgaactcctgacctcgtcatccgcccrcttcagcctcccaaagtgctgggattacacgcgtaagccaccgcgcccagcccaaaaattaatcttaagtacaaaagaagtcaccaccagaccaacatacatatggggcagcactgcttttccaaagataaatggtataatcataagaacactaaggcaaaaaccaagtgcattttgaaatgaaaattcagtattgtcagcttaactttaaagttaaattcatttgaattccttgaatatatcctaaattcttgaatattagtaattcactgtcttcattaactatctaattacctatta

SEQ ID NO: 123926 - DNA, 601 bp, Human
aactatgatcgccgctgtgttccatcctgggccatggaatgagactctgtctccaaaaaaaaaaaaacttcaaataactaccctcccaaattttgaggggaaaaaagatcatcagagacctagtttccaaaaattagtatttttttgtttgttttttagagacagagtctcactctgttgcccaggctggagtgcaatggcacaatctcggctcaccacaccctctgcctcctgggttcaagcaattctcctgcctcagcctcccaagtagctgagactacaggtgcacactaccatgccmggctaatttttgtattttcagtagagatggggtttcactatattggccaaagtggtcttgaactcctgacctcgtcatccgcccgcttcagcctcccaaagtgctgggattacacgcgtaagccaccgcgcccagcccaaaaattaatcttaagtacaaaagaagtcaccaccagaccaacatacatatggggcagcactgcttttccaaagataaatggtataatcataagaacactaaggcaaaaaccaagtgcattttgaaatgaaaattcagtattgtcagcttaactttaaagtt

SEQ ID NO: 123927 - DNA, 601 bp, Human
atttcctagacttctaagatacagaactaggtaggaatagtccctgaattagcaaaggtaattagtcaccaaaactcaaactgagcttcatttcaatttaataaatactactagaagtcttggaaaaatgggtaaatccccacaactcttgttcccaaaatgaaataaaagtttgccaaagctgaacattttaaataaataatagccaagcattgttctaagcattattcatgtcatgtcttatttgcatcccaagattctgaggcaagataatattatccccactttacaaatgacaaakaaaaaaaacacaaatataagtaacctgcccaaggttatatagcaggtaaatggcagtcagtattcaaaaacaaacttctgatctagttgctctacataaacgttggctaatggacagcaaatgcataatcaacaaatgactttatctagtgcacaaagctttcaatcaccaaatatttatttaacagctactaagtgccaggcacttaagttaatgatgacaagatagacaaggtccctgctgatccagctcttcgagtgtgggtgaaaaaaagagaaaaggggaaaaaaaaaaattcag

SEQ ID NO: 123928 - DNA, 601 bp, Human
gaactcagacctcaaataccaatgtcaaagcttgtaagagtcaagactgatgtaaaacattctaagaaaacaggaaatcattaactgaattcaatactagttttataatactgaggcagctcaaatgctacaatgtgtttcttacatggcacacacgttgaagccctaagtgtgtacatgtgcattccaattttcctaatggtatataaacaaagacaagcagttctctctcttaattcactttttgtgaataatatgaatacccacaagaacacacacaaaaattcagttgttacacaastagaactcttaaaagaaacaagtcacaggccaggcacggtggctcatgtctgtaatcccaacactttaggaggctgaggtgggaggaacatttgagcccaggagttcaagacccgcctggccaacatggtgaaaccccatttctactgaaagtacaaaaattagctgggcttgggggcgcgtccctgtaatcccagctactcaggaggctgaggcaggagaatcgcttgaacccgggaggcagaggttgcagtgagccaagatcacgccactgcactctagcctggaccacagagcaaga

SEQ ID NO: 123929 - DNA, 601 bp, Human
gtccgacaggtttggtgaacagggaccagattagtttttcgacggacatcactatactacttcccaagggtacaaccttgtgcagctgtggttctgattcattcttcaaggcattccactttaaaattacatataaaaaaatccttaatatgctaagtaaatgcaggatataattatacataatatcaaataccaaaaaattgtaagtcagtctgaaatacatcaaaatgttaacagtaggtctgactgattcattcttcaaggcattccactttaaaataacataccaaatgcttaacaygcacacaaaagcagggcataactatatacgacagaagctcctttaaaaaatgcacagacaagtttgaaaaaaacacgtcaaaatattaccaggtttaggggttatttctaaaaaataggagtaaaaaggatttgtttccttctatattgttttttaaaattttaacaagaaaagatacacattcaaggtaacttacccaccaaattccagagctgaaaggaaactgagggatcaccaaaaacctcattttaaagattagaaaattgaaattcaaaaagactgactcaggcaaggtcacct

SEQ ID NO: 123930 - DNA, 601 bp, Human
acatttagttttattcacaccacctcattttacgtgtaccttttcactacaattgttttttattcttaactttgctaagtaggtttttaaaaaaattcaccccttgctcctactcccagattcagatttacaagttgtacctttcattattaaccataatggttcaactgatgtcatacataaattcacgtatcttaatataccaaaaattaaataactatgttcttccaactgaaaagacttttacaaatgtaaattcatgttaagtacagaagatttttaaattcgcacacttttttttagttcacataattcaacatcattaagttatccaggaaatgtaaatcaaaaatcacaatatactaccgtcactcccactcagacggccaaaaaataacaaataataacaagtgttggcaaggatgtggagaaattggaaccctcctacaattgctggtgggaatgttaaacggtgcagctgatttggcaagtctgagagttttctcaaaacgttaaacgtgaaattacatctgacccaggaattttctcctagagaaatgaaaacttatgttcacaaaaaaacttggacacaaatgttcac

SEQ ID NO: 123931 - DNA, 601 bp, Human
tcattccatcaaaaactgaagattttactagacatcattaattcctgtccataatctcaaattagaaaaattaacacatttagctctaacagtataacattcctcttatgtaacaggtttcaaattccaagtaaatgacttgagttaaacctccatgaaaacgtatttctggtcagaacaaacccaattcaacacaaattctccctcctgaaaaaccagaaaaacaacagtaaagagattattttaaaagtataaactcttaaaaccaaacaaggcaaaaataaaatttggaagctaaaamgacaactaaagaagttgaatcttaagcaccctcatttacaatttaaaatccccaaagggctcaaaattggggtgaccaggaacttcaggagtaggaaaagacctcaaaaataattacaggaaaatgttttaaaacctcaaatatttatttttttttaaagatatggctctaagtctaaaagccacagaagactgatctaccacaaagttactgtataaaagataaatttttttacatgaatcatttttcttaacctcaaaaaaagcagttcttaaaaaggaccatgcaaggcaatcttaa

SEQ ID NO: 123932 - DNA, 601 bp, Human
aagtctgtcagttctataaagctagacgtaagtatgttgataattttactatgacagctgatatacatatactccccaaagcaacaggaaaatggaactgatacttatttcctctaaaatgtactaaattttaaaattattactatcattagatacatatcataaattcctgatctgctaaaattctttaagaattagggaactaatgagtacagttaatattctagttagaattttaaaaaggctctaaaataaaatttcaattaaaagacttaagagttctatttaaatatggctgggygtggtggctcatgcctataatcccagcacttgggaggcctagcagggcagatcacctgaggtcaggcgtttgaaaccagcctggccaatgtggcaaaatgccgtctctactaaaaatacaaaattagccaggcgtggtggcacacacctgtaatcccagctacttgggaggctgaggcaatagaatcgcttgaacccgggaggcggaggttgtggtgagccaagatcacaccattgcactccagcctgggcaacaagagcaaaactgcatctcaaaaaaaaaaaaaaaaaaaaaaaaaaa

SEQ ID NO: 123933 - DNA, 601 bp, Human
aagtatcttactggtaccctctctaaatcaggacattactgaccacttcttcattctggacattcccccttcccttgtttagcttgataccctcttagattttctcttgacagttcattctcagccataatttcacagagcaacctttccccctctccattatattccttcaggattctggtttctgcatcctctcaataaaccgttctcctttgacctcatctattaccctatcttcatgccagagactgcatctgtaacttacatcttctccctctttggtgccagaacaatatatatrtctcttcactccagttcccacaggtgcttcaccttccccttactcatgcctatgattccaaaccaacatcctctgcactcccaataactagcttattcaagtaaagaccttagagccaccttagattctagttccctcccccgccccctttaccatccacttctcatcaaccatcaacttaacctcttaaagtgctcttaaatcccatctctcgtctacaccacttaaaaaatctataagatccttgtccttccagtctcatgccaactccttagaaaggccttttgtagcctagtctgt

SEQ ID NO: 123934 - DNA, 601 bp, Human
taattttgcagagaaaaagtgttaaggcatttactgtcttttgtcattttaacactttcccttagctatgaaaatccctattatgttgccacattctccttgccttcaaagatttaaaaagcacagtgtaactttaccattaacatttattctctaaccccttaatctagtttctgtccttaccattcaactaaatggagttcacctgaaagtatcctagagcagcctatgtggcaagtatcttactggtaccctctctaaatcaggacattactgaccacttcttcattctggacattcycccttcccttgtttagcttgataccctcttagattttctcttgacagttcattctcagccataatttcacagagcaacctttccccctctccattatattccttcaggattctggtttctgcatcctctcaataaaccgttctcctttgacctcatctattaccctatcttcatgccagagactgcatctgtaacttacatcttctccctctttggtgccagaacaatatatatgtctcttcactccagttcccacaggtgcttcaccttccccttactcatgcctatgattccaaacca

SEQ ID NO: 123935 - DNA, 601 bp, Human
catcttcaaacttagtttataactctagtgaacaactcttaaaaaaaactaaaaatttcttagaaatgaagtcatttgtaaaaataaagctaatattcttgatgcgatatggagaacaaagtatgtgattacactgcaactaacacaatgttatttctaattcttcgttcatacagacacattttatttctaaactgagactgttacctaacagttctcctttaggagttattcttatttcccgtaagaaaggatttactacaacagagagtaaggaatccactgaccatttgcaaactckaatgccctttgataactgctagtatgattctcctggagagaatggccccaaatgagaatcagtattattgatttaagcattagaatggaacaaaggttaagaacacaaattagaaacaaaatgtaaacatgaggcagcagttggtactgatcataactgcaaaaggaggaaagagaaagaccaaaggaggagatgggctccttccccaactcccccaactatttagaattcagcattaactgtatcactaaagataaaaacaagaaggcattcaaaaacatgcataatccaatctcattg

SEQ ID NO: 123936 - DNA, 601 bp, Human
aatgttcttagtaatctttactaagaagctcaaagatatgcacaatagcttaactaagaataagtacttattgccatttttagtggttgagaaaagcaacatgcagtgtaaaagcacaaaaccaccacttggctgcgtttttcctaaaataaatagtctgcatatgataactcctctgctctccagtccccaaacacctgcttttccttatgtttaaccaagggatttgtctgaaatgggaaagcatccagctttcagcaagtgtactaaaatttgacaccatcaaataattaatgagcaktaaacataaacaactcaagcaagttcacttgattatgcttaaaatacaatgcaatttatataaagcccattagggatttgaaaaattctatttgtaggatatgagtataaaattattccaaaaccaatacatgaaaagttatgtctatataacttcttttccatgtataattttatgtatcttagaaagtgaaataactaacctcgcttcttctccactttcttaacttctggcttctttccttcatctttattctgcctatcaaatgttaacaaaaatatttcaacacattggaatttt

SEQ ID NO: 123937 - DNA, 601 bp, Human
cccttaaatttacatactcataagatcatgtgagaaaataaaagatgaagctataaatgcagtactgaagtattaaatgaagttaaacacttacaagattatcaattttgagtgaatttttaatctcagcatgtatcctttgaagtcgagaatccattgatgtttctacaaattaaaatatgtgaaaaacagtgaacagtttttccaaaaccagtatttctatatacaggctaagtataatgaattagtggacttaaaaaaaaaatgttcttagtaatctttactaagaagctcaaagatrtgcacaatagcttaactaagaataagtacttattgccatttttagtggttgagaaaagcaacatgcagtgtaaaagcacaaaaccaccacttggctgcgtttttcctaaaataaatagtctgcatatgataactcctctgctctccagtccccaaacacctgcttttccttatgtttaaccaagggatttgtctgaaatgggaaagcatccagctttcagcaagtgtactaaaatttgacaccatcaaataattaatgagcattaaacataaacaactcaagcaagttcacttgattatg

SEQ ID NO: 123938 - DNA, 601 bp, Human
ctgattattctggttgttactattaccaggaatactacagggtgttgtaattcttagcatattcatttattctaccacggaaaagcaatgtgaatcaaattttaaaatttactattttagaacaaagtgctaaaggagtatttcctaattgatatttttgtgcctaataaagggggttttcctgtaagtcgtattaataattctctaaggggacccatgtcattccccaataaagcaacaaaaacaaaaaaccaaccgactgcttttgaaatgccagcttttaccttaagcagctgccacwaagatgtttaataacaagactggaggagctgataatggtactatgattctgttttaagagtctttcatacattctgaaatgtttatgagtgaaatggtatgtcagggatttttcgtaaaacaactttcaagaggggcatagagaaagcttatgggctacaaaagcacaatgatcataaactgaactgccaaagctggatgacaaggacatgagaagttatttctatttgtataagttataaatttttcctaatacaaatgaaaagaaaataactactgttagtaataagtactagcagga

SEQ ID NO: 123939 - DNA, 601 bp, Human; identical to SEQ ID NO: 19485

SEQ ID NO: 123940 - DNA, 601 bp, Human; identical to SEQ ID NO: 19486

SEQ ID NO: 123941 - DNA, 601 bp, Human; identical to SEQ ID NO: 19487

SEQ ID NO: 123942 - DNA, 601 bp, Human; identical to SEQ ID NO: 19488

SEQ ID NO: 123943 - DNA, 601 bp, Human; identical to SEQ ID NO: 19489

SEQ ID NO: 123944 - DNA, 601 bp, Human; identical to SEQ ID NO: 19490

SEQ ID NO: 123945 - DNA, 601 bp, Human; identical to SEQ ID NO: 19491

SEQ ID NO: 123946 - DNA, 601 bp, Human; identical to SEQ ID NO: 19492

SEQ ID NO: 123947 - DNA, 601 bp, Human; identical to SEQ ID NO: 19493

SEQ ID NO: 123948 - DNA, 601 bp, Human; identical to SEQ ID NO: 19494

SEQ ID NO: 123949 - DNA, 601 bp, Human; identical to SEQ ID NO: 19495

SEQ ID NO: 123950 - DNA, 601 bp, Human; identical to SEQ ID NO: 19496

SEQ ID NO: 123951 - DNA, 601 bp, Human; identical to SEQ ID NO: 19497

SEQ ID NO: 123952 - DNA, 601 bp, Human; identical to SEQ ID NO: 19498

SEQ ID NO: 123953 - DNA, 601 bp, Human; identical to SEQ ID NO: 19499

SEQ ID NO: 123954 - DNA, 601 bp, Human
aagcttaccaatccattctgaaaaccagtactgaaaatcaatcttgccaggcgcgatggctcactcctgtaatcccagcacttcgggaggccaaggcggatagatcatttgaggtcaggagaccagcctggccaacatggtgaaaccccatctctactaaaaatacaaaaattagctgggcgtggtggcaggcacctataatcccagctagtcaggaggctgaggcaggagaatctcttgaacccaggagatagaggctgcagtgagcagagatggtgccactgcactgcaacctgagtgrcagaatgagactctgtctcaaaaaaataaaaataaataaaatcaatcttttcaataacttgtaaaggagacaaacacaactacatataacaacaacaccttaaattcatgatcacgacttttaaaaccattaaatagacatttactatagaaaggtatttgtgaagattcttcttgacttaactttttttgctacaaaatatttagattaagaagttatatgacattaaacaaattcattctctcttattactatttgttcttttgcattagccacactttgggttttttttaactggag

SEQ ID NO: 123955 - DNA, 601 bp, Human
tttaaccagatcattcactttaactttaaaatctagcaaaattgttaatataaccagaatgaagtactggtttacgttaaaaagaatctatgattaaaatctgggagaagaatttataggacatggcatattttaagttaatgaatttgagtttagatgatgtttagctgaagtgcatttctcttcagggatgctattaacagtttttccatcttatttgttcattaacacagagaactaaggattcagaaacagtgtaacataataaaagtaaaaaaaaaaaaaaaaaaaaaaaaaaagmctggcttcagggttagacagacctcaaattctcttaagtctatcaatgaataattgtgtgggtcagattatgttatacaagctaacccccaatttcctcactggataaaatgaggacaaaacctacctcctggaactgatggactagttaaatgaggcaaagtctatagcacataagggcttcttgaaaggtaattgttgtagcttcaagtgaaaaataaggcctattagtcttaaatttggaggttaaaaaaaactcatttaggttataaccagtaaatttcacatttttttccttctc

SEQ ID NO: 123956 - DNA, 601 bp, Human
tttgccgcccataataaaatttgagctttcaagtgaaaattagaattttagaacatctgtatctgccaccttgagcttgacacctttccataacttgaatttgttgataagactgcaactgatatcagcaagtataacttttgtatattatataatgaaatgagaaatgtgatttttccatttttcaaattttccaaatgaccaatgaaatataaattaagctttagttaaaaaaaattcaaagagcaagatagacaaatagattttcctgtagtagagagtgaaatacttattgatttgstttcagatttcacagtgatataggagttaagaagaaattacttaggcagatagcgagggtatagtccttggtaaggttttccagaaaagcagccccaaaatcattttcttctctaacaaagagcagcctgtgaaactgagctgcagacataaacaaccaagctgtaagcttgcacaggtgaatgccagcagttgtgcccactggactatactacctgggactaggcatgttcaaaatggtggctacatcttctctttttgccagccatgtgtacagtaaggagcagacaagatggcaaga

SEQ ID NO: 123957 - DNA, 601 bp, Human
tgatagcaatcacaagaaaaattttttatacatgataggactccattgcaagtttggaacctagagaggcctcctttttcataaatctttcagtgaaatactgattaaagcacagctctgatgcattattgaacaggcaaacccttgcacagtaattgatggtggcactctgatttaatgacccttatttttaaagctaattaaagaaattgaactgcatgttcaaagggaattagcttaatgtgacgaaactattttggacataaggtagctcctagctcctgaactaaatgagacacawaatggagcaataagttataagaagggaaaacaatattttcaaatagaacaagcacaattttacattttctatgagaccttcctttcattcattcaagtatttattgagcatctaaaatgtcttaaacatcactaggtgatagggatagtaattaaagtgacaaaatgctttccataatcactaatgtgttaaatatcctataaaattattctactaggcttagttcactcagatactgagataagatacctttctgttcacagccatgaattctcaaataccaaaacatagtgattgaga

SEQ ID NO: 123958 - DNA, 601 bp, Human
cattcaatgaaatacagcaccaaacatgatagcaatcacaagaaaaattttttatacatgataggactccattgcaagtttggaacctagagaggcctcctttttcataaatctttcagtgaaatactgattaaagcacagctctgatgcattattgaacaggcaaacccttgcacagtaattgatggtggcactctgatttaatgacccttatttttaaagctaattaaagaaattgaactgcatgttcaaagggaattagcttaatgtgacgaaactattttggacataaggtagctcstagctcctgaactaaatgagacacaaaatggagcaataagttataagaagggaaaacaatattttcaaatagaacaagcacaattttacattttctatgagaccttcctttcattcattcaagtatttattgagcatctaaaatgtcttaaacatcactaggtgatagggatagtaattaaagtgacaaaatgctttccataatcactaatgtgttaaatatcctataaaattattctactaggcttagttcactcagatactgagataagatacctttctgttcacagccatgaattct

SEQ ID NO: 123959 - DNA, 601 bp, Human
ctgaatatccaaatgaatccacaaataaaccattagctgtaataagtgaacttagtaagttggtggatgtaaaatcaataccaaaaaataaactgtatttcccagcaaaacaattagaaactaaaatgttttctaaaaatctgttcaagatatgattaaatttgtttaattggaacacaacatagggtttagaaacagacccacacatatatgaccccgtgatttacaacaatagtgacaatgcaagggagaaaggatgatctcttcaataaatggttctgggtcaaatggatattcaaayggaaaattatttataaacatacacatgcacataaatactttatttctacctcacaccacattcaaaatttaaaaggtaaaactttaataaagcttctgagagaaaatctctgtattttagaagtagccacaggtttcttatatagggcaaaaaagaaaaaaaaagcaatacccacaaagaaaaaaatttatttttaaaatttaaaatttgtttttaaaataaaaacaacttctggtcattaaaagatacaattaaaggagtgaaaatgcaaaacacaaaggagaaaatggttacaataca

SEQ ID NO: 123960 - DNA, 601 bp, Human
aacataaatttccagcattgggaataaaaaaaaggaacataattagactctacaggcatgcaataaccatatgcaaaaaaatggggaaaaaaatacatgaaatgaacaaattccttggtaacacatttatcaaaatatcaatagtttggccaggtgcagtggctcacacctgtaatcccagcactttgggaggccgaggtgggtggactacttgaggccaggagttcgagaccagcctggccaacatggcaaaaacccatctctaataaaaatacaaaaaattagctgagcatggttgtaygcacccataatctcagctacttgggaggttgaagcacgagaatcacttgaacctgggaggtggaggttgcagtgagccactgtactccagcctgggtgacaaagagcaactctatttaaaaaaataataataatagtaattttatatctatcaatgaaattgcatgcactattaaaaatcccccctccccgcaaaaataaaacaagaacaggtttagagagtttcactggtaaattcttcccattttttttttctgaattaacatcaattttttgtgacaaaaaaaaggctgaattgttc

SEQ ID NO: 123961 - DNA, 601 bp, Human
acaaagatgagagtaataaaactgataaacctctaacaatactgattaatatagcaaacataaatttccagcattgggaataaaaaaaaggaacataattagactctacaggcatgcaataaccatatgcaaaaaaatggggaaaaaaatacatgaaatgaacaaattccttggtaacacatttatcaaaatatcaatagtttggccaggtgcagtggctcacacctgtaatcccagcactttgggaggccgaggtgggtggactacttgaggccaggagttcgagaccagcctggccaayatggcaaaaacccatctctaataaaaatacaaaaaattagctgagcatggttgtacgcacccataatctcagctacttgggaggttgaagcacgagaatcacttgaacctgggaggtggaggttgcagtgagccactgtactccagcctgggtgacaaagagcaactctatttaaaaaaataataataatagtaattttatatctatcaatgaaattgcatgcactattaaaaatcccccctccccgcaaaaataaaacaagaacaggtttagagagtttcactggtaaattcttcccat

SEQ ID NO: 123962 - DNA, 601 bp, Human
agacaaaatgtcaatgagctaagcatccgaatcaaaaagctaaaataaaacagaaaaccaaatcagaaaaggaagaaaataacatatattgcagcaaaaatcaacaaaacaggaaaatgatacaataaagaaattcaaaaaagtcaaaaagttgatctttgagacaaagatgagagtaataaaactgataaacctctaacaatactgattaatatagcaaacataaatttccagcattgggaataaaaaaaaggaacataattagactctacaggcatgcaataaccatatgcaaaaaaakggggaaaaaaatacatgaaatgaacaaattccttggtaacacatttatcaaaatatcaatagtttggccaggtgcagtggctcacacctgtaatcccagcactttgggaggccgaggtgggtggactacttgaggccaggagttcgagaccagcctggccaacatggcaaaaacccatctctaataaaaatacaaaaaattagctgagcatggttgtacgcacccataatctcagctacttgggaggttgaagcacgagaatcacttgaacctgggaggtggaggttgcagtgagccact

SEQ ID NO: 123963 - DNA, 601 bp, Human
gaaatttttgactattttatttttactatgccctcgttctctagaagaatgccttatacagagttgttcaacatacattggcagaaaaaaaatgtttatctattttttaaggatctaactctgatccaatctcctgaacaacctttcaagtatcatctcaatgctaaggatgatgaaattacgtaaagtcacacagctaagttgtttgtgacctagattttttttcatcacggtgttcctatcatccttgtattatacagaaaacatacagtccttgtattatccacaaaacatttgagayatcatttaaaataaaacattaggtaaagaacatccactgacagaagctatcaaaatatttcacaatatgtcaccaaaatctatacataagagtttgttacctatccttaaaaataaaacagaaaactcattaagttaccaaagttaccaataacttaaccattatattagctttctacaatcacagatgaaaaagagatcaatgtgttgagaagagacttttgggaatccttttaaatgtttattttaaaatctatagcaggcatgatcaattattattttttcaaaagtaagcttctta

SEQ ID NO: 123964 - DNA, 601 bp, Human
tgggaaatgattctataattatttgtgtgtgccttttaaaagagtttgaagttaaatctaaataataataaagcaatgcagtcaatcctaatttcatatttatgttgggtgcctggattgtgactttttatctataactacttatcagaaagcttacttcattgatgtttttgagtcactctctgacctcatctcctagcagtctgtccctcacccacttagccctagctgtgctcccctcctcactgtgcctcaaagtgccaagctgttcactctaccaaacaggtatattcttccccaratatccacatgcttccttatttcattcaggtgtgcctaatctcaccacagaaaagtcctccttcgcattcctatctaagacagcaccattatactccacgaacttactgtgccctgttttaattcatggcactcattaccacctgatccacaccctgctgtcatgaagctttcatcccagtcagtggagaccgactagaatgcaaaaactctccagtggaaatttttgactattttatttttactatgccctcgttctctagaagaatgccttatacagagttgttcaacatacattggc

SEQ ID NO: 123965 - DNA, 601 bp, Human
ttatttgataaaatagcataaaagatctattgatgtagcctacctgatcagctactcctccaggcagaatggtttttactatcacaccagttgcttttcctcctatgatgccaaatcccaaaccagatccatcattcaccaattcaatcgtttccatgtgttgccagtgaacctacaaacaaagctcatatatgaatttgtagaaatttacaaagcactaccattttacattacagtagaaatttttgcgattattttgttaatattaaataattaaattcagacataataatgagtcctmacaatgtccctttcatttggtatacttccctttcaacagaatgtaagtgccattgacagaatcattcttgaaattatcaatatatcatcataatgatttcacttcaacagttaaagacaggcattgatttgcaagatcttttgtagaacttctttaaaaaaaaagaaaaagttcaaagaaaaaaaaaggtcacatgttaagaatgtcttctgcataatcctgccttgaggcaggattccaaattagatgacttcttaaaagttactgacagctaactctaacaatataattgtataattt

SEQ ID NO: 123966 - DNA, 601 bp, Human
atcgctgaataaaatgttttgtttaccataaaagaatgccatttaaacactttcataaacaagcattctttacttctttctctttgcaaaaaatagcaaccaaattcaatcctaaaaacaacagaatcatggaaattacaagtgttctaataaagttttaaagggcttgtggaggaggttaggatattaaaaaagaatttgtagcaactgcttagaaaaaactttaatagaacaaaacatagattttttacatctatgggaaaagaatataggacgtgtatttactataaggcttatctacaaactgggtgtaattcttaaatatttaagagacttctggataaattattttgttgatatttatcctctgtagtcttgcgacctgtaaatctgctgagatacccactactttccaataattttgaaattctctagcttttttcatatcaagttgacaaggatggaatgctatgcatatgaataaagtttttgttataacaccaaaagaataacttttgtttaaaaaattatataactgggtcagaataatgactacttattacaaatctgataacagttctaagacatactttaaaacaat

SEQ ID NO: 123967 - DNA, 601 bp, Human
gcaaattctattttcagagatggctcatcttaatttctggagaagtcaggatgcagtacatctgaaagaactaatgttatgaattcagatcaacaagttaaatctagctttgccacttcatctagaaagaaaatatcactttggtcaactatcaggaaaagaataacaacaactagaccagctaccatttattgagcagtttgtgtgtaactcagaattaagactctacatgtcttaattcattattcctcataattcctcataattcagcatcctgaatgataactgaaagtgggtttckcagatgccaccttctctaatgtgtagagttgttacaaattctatgttggactgaagagcaagtctccctaaaattaagcattacttgattggtacaatatatcatcaataagctattggtactatgtattagcatggtgtcagcagatcctacagagaaccttaagaagagcacaaagaaatcaaagctatagattctaatggacagtcaggttggggctagctgatgttttctaatttctttaaacaaactctgacagtccacttaaatgagatataattttacagtaaagtttgattt

SEQ ID NO: 123968 - DNA, 601 bp, Human
ttccatttacaggaaatatccagaacaggcaaatccatagagacagaaagtagattggtggttgcccaggactgggagaatgggggagaaggtgactgctaaggggtactgaaaatgtttttagggttctgaaaaatgttctagaattcaccatggtagtgaacgcacaactctgtgaatacactaaaagctactgtactgtacattttaaatgggtgaattgtatggtatgtgaattacatttcaatcaagcttatttttttaaaagttttctaattgattaatatagattacttaggaraaaaaagtaaattagctatgctttcaatttgtaattcagcatcagatatggatttagactccgtatgtattccttctgtctttcactttccctcaaaacaaaaacatgtacagtaattcatttacattgtatggtaaaatggagatacacagagaaagctcacttcgggcatatagccagatgaggtggcaagcacaacttgatctttagtgtagatctgaagaggtgaacaggtgtaggtaggagtttcacagaacaaaacccaagaagactcacggagttataatgtggacttaaagg

SEQ ID NO: 123969 - DNA, 601 bp, Human
ctaaaaagtagaaacaacccgaatgtccatcaattgatgaatgggtaaataaaatatggtatatccatataaaggaatattattcagcaataaagggaaatgaagactgaaacatactacaatacagatgaaacttgaaagcattatgctaagtgaaaggagtcagtcacaaagaaccacatcttgtatgattccatttacaggaaatatccagaacaggcaaatccatagagacagaaagtagattggtggttgcccaggactgggagaatgggggagaaggtgactgctaaggggtactgaaaatgtttttagggttctgaaaaatgttctagaattcaccatggtagtgaacgcacaactctgtgaatacactaaaagctactgtactgtacattttaaatgggtgaattgtatggtatgtgaattacatttcaatcaagcttatttttttaaaagttttctaattgattaatatagattacttaggagaaaaaagtaaattagctatgctttcaatttgtaattcagcatcagatatggatttagactccgtatgtattccttctgtctttcactttccctcaaaacaaaaacatgt

SEQ ID NO: 123970 - DNA, 601 bp, Human
aaagaatgagtgtttttatctaatgacaagtttgttcaactttttgaaaaaacaacagactccttttgtcaaatagtcaaattatttaaagaataccaacatatgaaatgggaaaaatggagacattcagtctattccttgtcactgtaatgcctacagtgaaaccctgttgacccaggggtccacagaacacaatgtgtaaaacaagaaccttataacaaaatatttttaagttacaaaataactcttcaaaatagtaagaaataatttcttaatctcatcacttcaacaactacaaaawaaaaatagattatactcctaatagctgctgtcaaaacaaaaatcgaacaaataacagacaaagactgcagttgtgaaaatgcaactggatgtgaagaacattactgcaaatatctcaaaagtccacaagatggtgatatttagtaaaaaattaatacatgttcaaaagcattgcatgatgttctccaggaatttaaaatgcttatatctttgtagtaaaagaatgtttgctaaaaattaaaaatcagaatattgatgagtgaagtcaagtgattttattgaaagcaagaaaacaattcag

SEQ ID NO: 123971 - DNA, 601 bp, Human
gctgggcgcagtggctaatgcctagtaatcccagcactttgggaggctgaggcagaaggactgcttgagcccaacagtttgaggccagcctgggcaacatgctgaaaccctgtctctataaaaaacagaaaaattacccaggcgtattggcacatgattgtaatcccatctactcaggaggctgagttgagaggatcacttaagcccagaaggttcaaaaggctgcagtgagccatgatcatgccagtgcattccagcctgggcatcagagtgagaccctgtcttacataaataaatattwaaaaaaaaaaaagacctagatcagttgtctccaagatggagtacccttactgcaaaggtttctgaaagaatataataaaacctctaaataaacattttaaaaactcatttgctttgtaaatatgtgtatatgtaggtgtgtatatatgtaattatgtatatgtacacatatgtaaacagcatataatgtctaagtttatataggatatatatatataatatatataacaacaatatatatgaatatatagtgaggaagaaagagggaaaatgagtagttatttttactagagggaatatt

SEQ ID NO: 123972 - DNA, 601 bp, Human
tctgcaaatggagacgaatatgagcatctacttcatagaaatgctgcaagtaaattaaacaagtatatagtatgcattaacatctaacatgattacataaccttatttaaccttcagggcaactttttgagacaagcatcatgacttacattttaccaaggagaaaactgaggttcagaaagatgaagtgatttgcccaatttcccacagctagtgtcaagtctgattcaaacccagatttgtctgactttaaattctatcctccaagccatgggcgatgtgagtaaatcaaataccaaaytgaaaaatgcttaaaaaattttaagccatttagcctttccattatatatgtaggttagcctcatgtatgcaaatctgataccttttctgttagctcaatatcacataagtccaggctatccaattctgattgggtggtgggtggcacagttcgacgacagcacaccattgtcacttctataggcagttcttttaagatattcaccacatcttggtgattttccccaagtaaagttatgccatttacctgtgaaaaaagatacattgtccaagaaacaacacttcataatatgaacattct

SEQ ID NO: 123973 - DNA, 601 bp, Human
ttatatctcgacagcaggattgtgcgtgactgtcacttttttcatcagtgtttcaatcatctctagtcagaaaaaaatgtaaagctattttgatattaaataaaaggaattcttatgataaataaaaacaagagaaaatggatatatgcaaaagttctatactctatacaaataagagttctaaaatgctgtgacttgtgcatatggttatttcattaacaaattaacatacacagtggcaaaacataagatttgaaatcagatttgcccccagcttgaagcagcttgaatatttaaaatytgaattacattgagcaatattcatcaactgggtcccagagttacccatctcatagaattttctgaggactaaatgaagtaacatttataaagcatcagacagaaatagggattcaaaatactaggttaatataggttaattcaactttgttcatctgtatgaacataacttaaagaaagatgtgtttatgaggatgaaattctagtttgtagaatatctttgcttctaatcaattattgcacagcctaggaccacagatacaaatgacacccatttgctttattgtaataatcccattat

SEQ ID NO: 123974 - DNA, 601 bp, Human
actgcttggggaaaacaaaataaataaatacaaaaggaggcaaacagacttcggtaagccaatatgttgtgctgcatacagccagcatttgccctgtaaaatatatgcttctcagtatgcagattgtgtaatccctttaagtaacaattactaagttaaacaatgcaatctgtccactgggaagaagacgtgtgctatgctgtggattaggagattccatcaggagatgaactcagcttccagccctgaggccagtaaagactaaacacattccagaacacattccagacaggacacagcyagacagacagtctcaggtgtggtgagagaggagcagctgctccactcaagattataccttgcaaaccatttcaaggagactgcccagcatcatttgcaaggataacaggtgcaccttgaacataaaagaaaatgctttgaaaatgttctggccaaaaaacctgttaatcaggaaaggaggaaaacagtgctagacctacggaaattctactttccaacttattcataaataccccttcccattgaattcaatttatgcagaaaatacatatttcgtatattaaaaaaaattgtccagtct

SEQ ID NO: 123975 - DNA, 601 bp, Human
aacgagcttgccaaaatttgcttcaacaaaagagtaaactgcttggggaaaacaaaataaataaatacaaaaggaggcaaacagacttcggtaagccaatatgttgtgctgcatacagccagcatttgccctgtaaaatatatgcttctcagtatgcagattgtgtaatccctttaagtaacaattactaagttaaacaatgcaatctgtccactgggaagaagacgtgtgctatgctgtggattaggagattccatcaggagatgaactcagcttccagccctgaggccagtaaagactraacacattccagaacacattccagacaggacacagccagacagacagtctcaggtgtggtgagagaggagcagctgctccactcaagattataccttgcaaaccatttcaaggagactgcccagcatcatttgcaaggataacaggtgcaccttgaacataaaagaaaatgctttgaaaatgttctggccaaaaaacctgttaatcaggaaaggaggaaaacagtgctagacctacggaaattctactttccaacttattcataaataccccttcccattgaattcaatttatgcagaaa

SEQ ID NO: 123976 - DNA, 601 bp, Human
tctacaatcctctgaaactctaaaattgtagagttctatataaatatgtatatctacttacaacagatatattgtatcacttgagtgctttgggaaagcagttgcttcataaactgctgttgaataaacatatcagttttcccttcaattctttcattgatagtttcaatgtataaaagtagcatatgaacatactattgcataaaggattcaagatacagacatatactgtgtatgcatatagaatacaatatgaagagttttcgctatggcttctacttccattcgcttccccagtaaraatggctagcatcagttaggtgtttatccatcaaatttttaatgcatttgcataatatatacatataagtacacatgcacacactcacacatacaagcagatatacatatatatttttaaaaactaaacacagccatacaataaatagcacttttactttttttgcagtatcttttcatcttgatgtgagaaatttccatgtcagtttaaaaacaagtcaacttcaattttcttatggctgtaagttattcctaagtatgaaagacagtggtgtgtagactgtgaaccaggatgcctgag

SEQ ID NO: 123977 - DNA, 601 bp, Human
gttcaatatttccccttgtcaagggggttgaggagtaggtatatgaggaaaatgagaaacttacctaggctagaattgccttttgctatattaatagtcctttcaaaagattctttagatacattttgaagcatgacacactcagcattacaggccagggagctctgttcaagcaggtactcagagccctttaagaaagaaaaagaagtcacaagtcacatggaaagggaaactagactttggagcgtgatttcaacatcacgcatgttctctaattgattgtgctttattttgcaagaayctgcaaccaaaacaagttcataggttgccttctgaaaatcttagtgtcaagaagcactcattccaaatgaagagattagccagaataaccttacttcactattccctatctcatcataaaacacaaaccatatctttaaaatattacctttccagctgaatcgggtagcacagaaggaagttctgcacttgatataacttcacttggtaaatgagattcagtccacactattgtgttttcacattcatattgttgttcaatagcatttgcaggtgtgtagtcatttatagtaaagccaga

SEQ ID NO: 123978 - DNA, 601 bp, Human
attattcagccttaaaaaggaaattctgacacatgctacaacatggatgaacctaaaagacattatacacagtcaaatatggacaaatactgtatgatttcacctacatgaagcatttcatcaaattcatagagacagaaaaatgaatggtagttgacaggggactggtagagagagcaatggggaataattgtttaatggatacagcgtttcaattggggaacccaaaaaacgttctggagatggatggtgatgatggctacacaacaatgtgagtgcacttaatgccacagaaatgtaytcttaaaaatgatgaaaatggtcaattttatgctgtgtctattttacaataaaaaatcaatgtatcttgacatattaggagaataaataagaaaatccatataatctccccaatagatgaagaaatgctttgacaaaattcagcattcttacaattaattaaaaattggtaagcaggccgggcagggtgactcgtgcctgtaatcctagcactttgggaggcggagatgggtggattgcctgagctcaggagttcaagaccaacctgggcaacatggtgaaaccccatctctactaaaac

SEQ ID NO: 123979 - DNA, 601 bp, Human
aatctgaacatttagcatctcctctgaaatgaggtaacagagtaatgtaatgttgttgccttggcatgcagtaaattttaactccaaaatgccagaggaacctcactgggtcccaggaaatcaaaacgccagggagaaagccctataaacatattgggcatagcatatcaataatggaaatgaagcagaaaagttaaactaattgtgatttacacttttatattacagtgtgaatggtaaactaatggtgctgtgatttcacacttaaatgtcttactttgttttttgtttttttttttttgagacgaagttttgctcttgtcacctaggctggagtgtagtggcacgatctcggctcactgcaacctccacctcccgagttcaagggattctcctgcctcagcctcctgagtagctgggattacaggtgcccaccaccaccacgctcagctaattttttgtattttcagtagagacggggtttcgccatgttgggcagactggtcttgaactcctgacctcaggtgatccactcgccttagcctcccaaagtgctgggattacaggcgtgagccaccgcgcccggccaaatgttttactt

SEQ ID NO: 123980 - DNA, 601 bp, Human
ttttaccttcaagtccaaacaccacattattaagcaagggaccacagacttatcaaaaagcatcaagattagaatttttcaaaggtcactatatgcacgtgtatatttattaatgtatctgtatttctgtatatattttcactctaaatttaacaaaattcaaaaacccaaatgattcatgaaatcaaaacaatggattatgacagcctttacagaaagctgtcatttattaataacttcttctggtcatcactagacaaagaaaaaattagccacaaagctaaaactgcaaacaactgcrtatagctgattaaggggagactatgaatctaagaaaatgagctcattgatagacctcttcataatatacttttccactagcacaaacccagcctctatttagacttcctaacatactatttatcacactttttgttactttaagttatacagccaaaaccttcctacactaaagcttaatttaatgctttaatatttacatagatttttcaagattcctttacatttagttattcgaagtgctatagaaatctgaacatttagcatctcctctgaaatgaggtaacagagtaatgtaatg

SEQ ID NO: 123981 - DNA, 601 bp, Human
taacctcacacagagcctcagtttacttacctttaaaaagggatgacatttactcttagggttgtttaaagaactaagtgagaaacacatatgtaatagtactttgaaaatacctgacacaaagtgtacgacaaaatttagtcacaaaactaaaaacaaaacaaaactcataaaatatgtttaaaatgcatctctcccccaaaccaaggttacattgctccctaaagactaaatgcaaatcttaattcagcttcaaaatgaagcctgttagtacaacaatcataatgtgcccttgggtaaytcaagtactgaatgtattgtacggtctatgtgaaaatcagagatagacaggcttgagttctgactctacccctttaagggttgagtaatttcagagaaattcctgagtctgtctatgtttctgtatctaatcagtgaagggaagataaagacttcctttcttttcccctgaagaaccttgtttttttaccttcaagtccaaacaccacattattaagcaagggaccacagacttatcaaaaagcatcaagattagaatttttcaaaggtcactatatgcacgtgtatatttattaatgta

SEQ ID NO: 123982 - DNA, 601 bp, Human
gaacacactgaaatgcttatttgagagttgaattaaaaattcaaactaacttttggatacacatggactaacttttggttacacatggactagaagaaaaaagaataccattagagatgctgaaatgtgatatggctattaatgcagagactattcccgcacgtgcagacaggatcgttcccttacaaaggagcttgaaagcttcataattggaaaatatgattttcaaatgagttcacaatcatcagtacaatctgaaaacgtaacaatctcatagctctgttggattttatgttcttayttaaacaaagaaaacaatctaaaatgtatatacaaaatctatatctggatctattcttgcattgggacattacaaaagcacaaaattgttttcacagacaagttgtaacacacagccataatgagctttcgaatcactgatactcacacataaaagggggctcgatcgtcagcaggtgctgcagaaaatctagaatgtgaagcatacgccgcggcatctttttacaatggtgttaacaaatgtcaatgtcttgtgctgaatgtgagatgcatacatatgtagttaaaagtgggtgctcct

SEQ ID NO: 123983 - DNA, 601 bp, Human
ttccaaatcgccagcaaaaatgccaaagctaaattatgagctgcgagaacacactgaaatgcttatttgagagttgaattaaaaattcaaactaacttttggatacacatggactaacttttggttacacatggactagaagaaaaaagaataccattagagatgctgaaatgtgatatggctattaatgcagagactattcccgcacgtgcagacaggatcgttcccttacaaaggagcttgaaagcttcataattggaaaatatgattttcaaatgagttcacaatcatcagtacaatstgaaaacgtaacaatctcatagctctgttggattttatgttcttacttaaacaaagaaaacaatctaaaatgtatatacaaaatctatatctggatctattcttgcattgggacattacaaaagcacaaaattgttttcacagacaagttgtaacacacagccataatgagctttcgaatcactgatactcacacataaaagggggctcgatcgtcagcaggtgctgcagaaaatctagaatgtgaagcatacgccgcggcatctttttacaatggtgttaacaaatgtcaatgtcttgt

SEQ ID NO: 123984 - DNA, 601 bp, Human
actacagagagtgaggccaccagaacaagcatcccacaatgcaacagaacatgcagagccatgctagcacaagcctggtcacaggatcatacagaacttccaaatcgccagcaaaaatgccaaagctaaattatgagctgcgagaacacactgaaatgcttatttgagagttgaattaaaaattcaaactaacttttggatacacatggactaacttttggttacacatggactagaagaaaaaagaataccattagagatgctgaaatgtgatatggctattaatgcagagactattccygcacgtgcagacaggatcgttcccttacaaaggagcttgaaagcttcataattggaaaatatgattttcaaatgagttcacaatcatcagtacaatctgaaaacgtaacaatctcatagctctgttggattttatgttcttacttaaacaaagaaaacaatctaaaatgtatatacaaaatctatatctggatctattcttgcattgggacattacaaaagcacaaaattgttttcacagacaagttgtaacacacagccataatgagctttcgaatcactgatactcacacataaaagg

SEQ ID NO: 123985 - DNA, 601 bp, Human
aatatccagtgccattactcttccagattgttgtcccaagcttattttgaactcttccaaatgttctgcaggcacataagtaattctggaacaaaccagaatccatggaagtgaagggaaataatattttgcctaattgttaggaaaagcttctaaaataaaggaaacaaatcatattgtccctttctccctactttttcatacaactcatttaatcagtatattcagcagagaatccaaacttcaataggataaagtattctatagggaagagtaacaacagaaactaagtttttaaatsctgctgattaactatgtgtttaccaatcatcatgcagagaaggaaaacaattatttatattatcaaatgaaaaggctaacaacaattttttttaaattaggaagatctataaatccctagaataatgattgtcagcaataacattaattttgcccaaagatttctgggatctctagcagaaacaaattaggtatactctattaaaatgctgaatatcacaaattactttgcatctttctataatacataattaattctagagattaacaagcattttcaataattatgttagctctatta

SEQ ID NO: 123986 - DNA, 601 bp, Human
tttctggtctaggcatggtggtgcatgcctgtgaatcccagcactttggcaggacgaggtgggcagactgcttaagctcagaagtttgagaccagcctgagcaatatggcaaaaccccatctctacaaaaaatacagaattagcctgatgtggtggcacacacctataatcccagctacctgggaggctgaggtgggaggattgcatgaacccagcaggtagaggctgcagttaactgtaatggcaccactgtactctagcctgagcaacagagtgaggctctgcctcaaaaaaaaaaaaagaaaaaaattctgaatttgtatgcatgttaataaaagaataaataacatttctgaagaagtttgctaatattaaaagagtaaaaaaatcatacaatttcttacgttctaagaaattaatggaataatactcatttggggcaaattatcaaaactcaacatgttaaaagtgctacattgtgtggtaaaattaaatattaatttattaatttgaatatttatatatttctcaaattttccatactatataataattacttatataattgagggaaagggaagaatattttttaaaatcttga

SEQ ID NO: 123987 - DNA, 601 bp, Human
cagagaggtaaaaattagccctgacctggaaatacaacaggacagagtatgacgaagaaagcagagttagaagacagacaagaattagaacttagaaacagtccttaaaatattcagtgacaggcaggggatggggggaggtccttagccctaaagcctaagcagtgagagctattcagaaacaccgtagccacaatgcatcttgcttcttcctttttaggtacaagaagataaatatcctgaataatccaatacaaggaccccagtctcttcagatgattctataatcttgaatcctttygcaaaccccatatatgctcctctataggtgctgattattgtttactcatcttagtgtgtggtttcagggactcaagtgtcatgtcttcctgcatgcactcagccaagaaagaagtcaatcaactgcttttccactgtgttaaaccactgaataccaacaaaaatgttatcaactataataagtagatctctttatatctgcaaatatgtaccaggtaaagtaactggcagaaagtcacatggtgagaaagacacatgatgagaaagacactggcagacagcataggtgagatttggattg

SEQ ID NO: 123988 - DNA, 601 bp, Human
tctgacactagggtaggactggtgggaagagctccaagagggagatcctaaaaacaatgtcaaagagttgacagagaaatagtaaaagtgaaatctttgtccagaggatgcaaggcagagaggtaaaaattagccctgacctggaaatacaacaggacagagtatgacgaagaaagcagagttagaagacagacaagaattagaacttagaaacagtccttaaaatattcagtgacaggcaggggatggggggaggtccttagccctaaagcctaagcagtgagagctattcagaaacacygtagccacaatgcatcttgcttcttcctttttaggtacaagaagataaatatcctgaataatccaatacaaggaccccagtctcttcagatgattctataatcttgaatcctttcgcaaaccccatatatgctcctctataggtgctgattattgtttactcatcttagtgtgtggtttcagggactcaagtgtcatgtcttcctgcatgcactcagccaagaaagaagtcaatcaactgcttttccactgtgttaaaccactgaataccaacaaaaatgttatcaactataataagtag

SEQ ID NO: 123989 - DNA, 601 bp, Human
aaagtatgtaaaattacagccattctcccctgacaggaatactgaactgtctcaactgatataatatgttgaattaaagatcagaagtcatctaatccagtcatccatctgagcttgaatgcgctttgcaacatttctggcaagcaaatgtccaggctctccaagaacatctcattctttcttggacctgaatgttaagtttttgtttttaagctattagaataaaatctatttgctataggtcctacccattggttttgtgtttgaatttccctcctgtgcaattaaagaataacgcctygaatgagggtagggctcctagagtctaagtctgacactagggtaggactggtgggaagagctccaagagggagatcctaaaaacaatgtcaaagagttgacagagaaatagtaaaagtgaaatctttgtccagaggatgcaaggcagagaggtaaaaattagccctgacctggaaatacaacaggacagagtatgacgaagaaagcagagttagaagacagacaagaattagaacttagaaacagtccttaaaatattcagtgacaggcaggggatggggggaggtccttagccctaaag

SEQ ID NO: 123990 - DNA, 601 bp, Human
aacctggcacagaatacttcttaatggaagaagcagtttacaacgcgtctgtgttcaaggtcaccttccgtttatgtagcaatttagattttgccaaatgccaggcatgtaacaaaatgtgtccagtctactgattgactgtaaagaaaactgtacaataataacaacatcaagaaatattttgttagtccaaaggaatactttgtatcaataaatgaggctgagaggacaatagagaatggttaaactgattatggcctgtgccttggctgttggtaaaaattggatttctaaagaaatrtgtccacatattcctcttaaagcagagaaggctataaaaactctgattcaataaatgttttcagttgatatttacagaaactgaagaatcaaaagaaagtatgtaaaattacagccattctcccctgacaggaatactgaactgtctcaactgatataatatgttgaattaaagatcagaagtcatctaatccagtcatccatctgagcttgaatgcgctttgcaacatttctggcaagcaaatgtccaggctctccaagaacatctcattctttcttggacctgaatgttaagtttttg

SEQ ID NO: 123991 - DNA, 601 bp, Human
ttggtatagcaaccttaaaaagcaatttgacaactgaaagtaaaaaatgcatataaacttacaggccagcaattccaattccacttctggatatattccctagataaattttcatgtgtaagtataaagaaataaatatatttactgaacagaattattataatagcaaataactattaactatctaatatgaatctgacaatgaataaactatggtatattcacatattgaaatgcaacacaacaactaaattgaatgaattagatctttaagtatcaagcttgatagatttacaaaacrtcaagaattgagagaaaaattaagcaaaatggaaaataatacatgtagtagtatatcaattgtgtaaaatgaaaatcacatgcaaaataaaatacagcccattttataatcttaaaatttatattttgctaaaaattctctattttcatacaaagtacatttttgttgatttcatgaatgactgtcccatcatgttttcaatgctatgaaccatgttcacaacactaactcctaatttattaaaagctctggttactccattaagctttcttctcatgttctatgaacttcccctagaag

SEQ ID NO: 123992 - DNA, 601 bp, Human
tagatcctatcagatccagtcattaatagcaacatcttaaaacagtctggaactaaagatttgtctctaatgacctgaatctatacctgagtctaaatcaggccacaaaccacaaaggaaactagttgtcaaactgatcccaaatttcttttatttttgctcaatgtcttcggtattactaacagaggcacatatattttgcccatcttatatattaatacatgttttatgaataccagtaaacatgttcaaaattaaaaccacaaaattttttatctacatctaaaagctaatttttttwaaataatctgtctagaatgcaaattataaactggtctgctagttcactggcaaccttcattattcttttattttgcatcctagtaaggaaactttccatattttgacttgatattaaagtgcttcagagcaattgtattttttaaattaaaaaaacagtaatttattaaaaaatgaactcctgtagagtggtgttctctatttctgcccagtttttgtggaggtagaaacatggagattcatgttttaaataaatttcctataaaattgcccatattactggagaatttatgaggcttta

SEQ ID NO: 123993 - DNA, 601 bp, Human
taccttgaacctatagttttcctatatatctttattttacttttttactgcataagaattcctctgatacaatgttttattatatatgtttatatctagaaaaatattatgattttttttaaaaaactgacttcttgtaaggatacattaaatgataaacacgcacaaatacttagaaattattaattggtgccacgaattaggatacctaaaaatatatgtaacactagaactatttgagactgaatgcgacctttctttgttgattcagaaagcactcaattttctggcaaagcaaagmgctgactgatagagatttaagggcgtaagtgtcagattacagaatctgctatattgaaatgttcagtctatatgtcattggacaaacagataaaagttactaatgtaaatggaacccttgttatcttcccaaatgctgtgccataaatgtctcaaattaataatataccaataaaaatgaacaaacacacacacataaaaccctcatttggtccaatcaagtttcattatcatagtaaagaggagcaaggtatgtactttagaatttttctggctaaaaaaaatttacttctctgtaaaa

SEQ ID NO: 123994 - DNA, 601 bp, Human
ataccttgaacctatagttttcctatatatctttattttacttttttactgcataagaattcctctgatacaatgttttattatatatgtttatatctagaaaaatattatgattttttttaaaaaactgacttcttgtaaggatacattaaatgataaacacgcacaaatacttagaaattattaattggtgccacgaattaggatacctaaaaatatatgtaacactagaactatttgagactgaatgcgacctttctttgttgattcagaaagcactcaattttctggcaaagcaaakagctgactgatagagatttaagggcgtaagtgtcagattacagaatctgctatattgaaatgttcagtctatatgtcattggacaaacagataaaagttactaatgtaaatggaacccttgttatcttcccaaatgctgtgccataaatgtctcaaattaataatataccaataaaaatgaacaaacacacacacataaaaccctcatttggtccaatcaagtttcattatcatagtaaagaggagcaaggtatgtactttagaatttttctggctaaaaaaaatttacttctctgtaaa

SEQ ID NO: 123995 - DNA, 601 bp, Human
taaccattccctcttccagctttagttcaggtccttgttaactgtttcctgaattattccaataattatcttacttcctctaacctctctcccctgctacctctgatttttctctacagtactgccagagaaatttttaactaaacatttctcattctttgagctccacactgcctcaaagacaaagctggcacatgttggcctatcaatgtatcccatgatctgaccctgtcccctttaacattgaccctttccccaccagcttccattccctgcccctcattgctcagtgatgctctayaatttagcttcctgcattggccaaagtctccatgccattcctcactccatgccctccgcttgcaacatttttgccccccaaatcttccaacatacacttcatatgtaaccttccatataaagttttatcctcaatttcttttcagaggcagaactgataactcttttcctaccctcactattccctaggcagactacaagtactcttcacataagtggtatgcttatttccatgagtgtcttcttatactaggatgtacactccttgaaggccaaggctataacttatctacctctaata

SEQ ID NO: 123996 - DNA, 601 bp, Human
tatgtatacataagctctatgtttatatattcatttaggaaagaatgtttctcttcctacaggtacccccactgataatcaccaaagttcctctaattttaagcttttcattctctactaactccttttattcatcatacacatgtatccaaagctttcctaaatcaaaacaaaaccactctcccaattctctgtcaccctctagccactgcctctctctctccttgacttcttgtccatcatttgctttctcaaaaaccactaacagtctcctagttaccacacccaagggactctttcyactcatcttctcactggattcttgctacatggcagcatgtagagctgtggagtgtacccttgaaggacactcttctccgctgctctgccacatgccctcctggttcttcatagtctctgatctcttggttagccttcctccttactgttgctaccacatgattctgcccttggccctctttctctctaaatgctctctgtagcaagcacctcagcctccatggctaagaaatgccaaatctgcatatacaggaaatcatctctaaactggagaccaaatgtcccaatgtacatttttacc

SEQ ID NO: 123997 - DNA, 601 bp, Human
aagtgaggaccaatgggattaagtgatttataggcaatcactcaggatgtgagaagggcttctgacagcacaggcttctgtccaccctcattgctaaatgcccagccaaagaacttgaatgtatctgtttggaaatgaacgtccttgggaggttctgagtaggggattaagatgctatgaacatctatcaagcaccttaatcaggtagcctaatgtggaaatagatgtggaaacagaaaacatcagagaaaatcagtgacaggtagccatcaggcaactctataccagcttattcattcckaattattaaaacaataataatagcaagcactatttgtatatgtgtgccaggtgctggaaactgaacatatgtatatttaattttcacaatatatacttaattctcactacaagtctatgaggtaagttggacaattattaagtccattttcaaaaggtgaaactatgtacacgttaagaaacatgctcaaagtcacagtctcatagatagtgagtggcaaatctaggtctctgacacatgtggtctggctttaagtctgctcccaatcactacagtatgttgccctttatccatctaaca

SEQ ID NO: 123998 - DNA, 601 bp, Human
tagtatacacaatggatatttataacagcaaacattcattaaaaaatattttggcactaacagtcactgttaaggagtttaaagttttcctaaggaaaaaatggaaatatttatcaaaactgcccagtgaatattgaataatttgtgtggcaacgaaaaataccttaacaccaactggaaaataagaaatagaaattgaagaacttctgaacaatctcttcttttccttaagaacatgtctaatacagctacataaccctaattctctatgatcgcagacacaaacactttaatcatgccsaaggatgggcctacattaccatttactttattttggaaaattaccttttcaatagggtaaccaacaacaatttcatcatctacagccagtatctgatctccgactttgagtcgtccatcctaaatggaaacgtagaagaatttgagtgatattccaaaagtaattccctccccaactacttaatgacagcaagaaaggtaaacctcaccgtggctgctaccccatgctctgttaagctctttatgatgactccactgagtgtatcttcttcgctgatagcaatacccaaacccccctgat

SEQ ID NO: 123999 - DNA, 601 bp, Human
aaaagccaatgccttatttttttttgtttgttttgatgctgcagagcttgaaactgttttattacacaccagtgtattctttctcaaaaagtaactcaaaggaataatgtacctccatatactagactggaagtgtaatgacacattaaagtgtcaccctatggttcacgtaacctaaatccatttccattatgacaggacccactattacacctaaagcatagaactcagatctgtagatcatggcaatgactaaagagtttcttacagtggcaggcagtactgatcccacctatgaaayaggataattgcatatccattctacagaaaagaaagctgaggcttagagaagttaaattactttcccagcttaaaaaaagaatctacgaaatgatatttctaattcattagttagaggcctggaatcaaggtgcccttagcaatatatttttggagagcaaagaatactattcccttgttttagagatgaagaagctgaggctttgagtgggtaggtttcctaagatgccacagctgcttaatgtacagcacatagattgcctgcctaacagtccagtactctttttccagaagtcctctc

SEQ ID NO: 124000 - DNA, 601 bp, Human
aataaaggattattttcggagatgtattactttaagactttttcatccaactacattacaaatgatttaaactagtgtttccttaaaaaactgttaaaagaacagtttggaggccaaaagaaatttctcccctccaccccccgttacagaaaaagccaatgccttatttttttttgtttgttttgatgctgcagagcttgaaactgttttattacacaccagtgtattctttctcaaaaagtaactcaaaggaataatgtacctccatatactagactggaagtgtaatgacacattaaagtgtcaccctatggttcacgtaacctaaatccatttccattatgacaggacccactattacacctaaagcatagaactcagatctgtagatcatggcaatgactaaagagtttcttacagtggcaggcagtactgatcccacctatgaaataggataattgcatatccattctacagaaaagaaagctgaggcttagagaagttaaattactttcccagcttaaaaaaagaatctacgaaatgatatttctaattcattagttagaggcctggaatcaaggtgcccttagcaatatatttt

SEQ ID NO: 124001 - DNA, 601 bp, Human
ccgctttcccatctttagaaacagggtattggattagacggtctttgtatggtcttcccaaggcacagagtttagggttcattaatggtggtttttatgatgacctggtgaccccacatcctatagtagccatgttacccatgtcatatttcatgagaactagactactgatactgtattccaaaaaaagtctattttttagacatattcccactgacactcaaataatatgctaaattctttctgtgtttaaaaataattagcctttagctgtctctgagaaacaaaatggtgtaaatgyccttttatttccatacagaaaagtcgctgcagaaccaggtgtctatgctgctggtttggcaattctgaagaatgcctatttccaaagaaggatattctgaaataaagatcaccatttcacagatttctgactcactggaaaaaataagctgctttgaaatggtggctatctgaggcccaagaaatgacaaaataaacttagagacactgcagactgcaggggcactttttactgaatgctgacttcacaagtttagctatctggtagattctgagatcagatccagatgggcttataata

SEQ ID NO: 124002 - DNA, 601 bp, Human
cacctcagtcactatcccacgctgccaggggaccagaccttgtacacagacccacagtcagggccatctatgtgtcctcttggcatgccgattgcatcgccctgatgaactccacagctacccacctggctgctttgagatggcctcctctctgaatggaatggaccagctttgattcttccaacttccaaggttactgtgcctagggaacactgggggtgggcatggggggtgttttatggaaatgtttaaataaaatgctataatcatctttaggaatacattttactcttcaagactkttttgaaaggcatcttccttttggaatttctataagcaaggatacctccaatcccttgtggaaaatggctttttataaaacattcaaactaataaaaataatcagcagcagcaacaccaagtgtttaccttatcacctcatgatttctatggagactacttgtaccaaaaagaaatggagaattgagcaattatctcatgaaacacactaattttgataggacaaacaagctgaataactgagggtttaaaaaacaaagcgactgtaatcccaccactttgggaggccgaggcgggtgga

SEQ ID NO: 124003 - DNA, 601 bp, Human
ctaacatattcatggcatgttctcattgtacagagaagctcattctttttccagtttatttaaagtgagagggctaaagttcaggggactatattagaataagtcataaacatcagtacgcccaagctcagagagaaaaatcaattataagcaatggaaaagctgcatcaaattatttaaaatttctaatgcgcctctctcttctcctctgttttccaatgcttttgtatccaagtattgttacttaatactgtgaattttttcagtccaaatgataatatattagatgaataggcagtgygggaaattttaaaatgatagatttgacttgctccatattacatgaagtggtaacatcaagactaaaatgtcctccgccccaaaatcagagctgaaaccatgggaagggtagtagcacgcatatctatctagctagttatctatctctacttatctttgatcagctaaatccatgccacaattatttaagtttagaagcacctgatatgtataattcacacttcatatatcctatcattttacctgtacgtaattcctagaaacatgggacagagaacgcaactgtcaggaagacttgatt

SEQ ID NO: 124004 - DNA, 601 bp, Human
gcagttggtgggaacacaaattaataaagaatatttgggaatttgcctagtaggaatgattcaatagaatccaggattttctatcctgtaaataagacctacagaaagaaggtaaaggattaggtaggaacaaaaacagttttacaggacaagggcttgggggatgacaaaatccaaaggtctgcaaaagcacaaagccacctgaacattccctatggcaggataaggcataagttctaaatttaaaacccactgctatttctttttgtggttttgaaaaagctattcaagctgtcttagytcttacttcccaagggtagagagattcttcatattccttatggaccctaaatgattaagattaaatacagacattggtgttagaaaaagaaccccatcttaaagcacgcttatagaagacaattatgcaattaaatataaaattaaaaatatggaaaagttaatgaggaatccataatgatgaaattcttaaaatatgttctaactagcatgccttaaataaattgttcctaggctgaggaaaaggactgtatgactcttctattcactagcaaatgctgtttgtatttttggacatacc

SEQ ID NO: 124005 - DNA, 601 bp, Human
ttagcattgagataccaatttgagagagaatttagcagtcgatagatcagttggatgggtttttggctgttcagcacagcagttggtgggaacacaaattaataaagaatatttgggaatttgcctagtaggaatgattcaatagaatccaggattttctatcctgtaaataagacctacagaaagaaggtaaaggattaggtaggaacaaaaacagttttacaggacaagggcttgggggatgacaaaatccaaaggtctgcaaaagcacaaagccacctgaacattccctatggcaggrtaaggcataagttctaaatttaaaacccactgctatttctttttgtggttttgaaaaagctattcaagctgtcttagctcttacttcccaagggtagagagattcttcatattccttatggaccctaaatgattaagattaaatacagacattggtgttagaaaaagaaccccatcttaaagcacgcttatagaagacaattatgcaattaaatataaaattaaaaatatggaaaagttaatgaggaatccataatgatgaaattcttaaaatatgttctaactagcatgccttaaataa

SEQ ID NO: 124006 - DNA, 601 bp, Human; identical to SEQ ID NO: 121561

SEQ ID NO: 124007 - DNA, 601 bp, Human; identical to SEQ ID NO: 121560

SEQ ID NO: 124008 - DNA, 601 bp, Human; identical to SEQ ID NO: 121559

SEQ ID NO: 124009 - DNA, 601 bp, Human
cctgtgacatatcacatatttttctatttcctgcttcgttttctgtcagccctgccgccagctccacgggccctgctatggacagagccagccacatggaaggtattccaaaaatacctgccaaatgaatgaactcactggaggctcacttggccatcttaaatttttaatcttgacacataactgttgattgatctttctcaaatattaatttcaaatctatgcagaaaggaagtataattaaccacccaataaatacgggttatgttaaaatttaaaatgttagcctcctttcaaatcrcatttgttttaatcctgaagatcatgtgaatctttgaggaaaaaaagtcatagttactgcctcagttttcaaattcatagtaaccattaacatacatgttatgacaaccacaaaaacatccacctgcctgatctctaatttcattattaaaatacttgcttgaattgcttagagtttttgtttcatgggtaagattcatatatgtatctcctgtgagtattgtgttttgttgattttaaaatgctgagagatcctcactcacatgatttagttcagatggtctgattcgtagctacacct

SEQ ID NO: 124010 - DNA, 601 bp, Human
ctcagtcaatacaaaaagagccctgattgtcattgaagcaggtgggttggggcaacaccaagaacccatttttccataaaaactttactctaagtattttctggaaatagctgaaataatattgtgcaccagccagggggcccaaacaaacatctagtatatacgttaacttttaagagaagatgatttctgtgacctaaaactatgatttaccaatgacctccgttccttgctggggctgctactgcttctcacgtgaacttcattttccttctcagcactcatcgccctgtgacatatsacatatttttctatttcctgcttcgttttctgtcagccctgccgccagctccacgggccctgctatggacagagccagccacatggaaggtattccaaaaatacctgccaaatgaatgaactcactggaggctcacttggccatcttaaatttttaatcttgacacataactgttgattgatctttctcaaatattaatttcaaatctatgcagaaaggaagtataattaaccacccaataaatacgggttatgttaaaatttaaaatgttagcctcctttcaaatcacatttgttttaa

SEQ ID NO: 124011 - DNA, 601 bp, Human
tgggaaggagcaactacaatctggcttttttcctagaggattaaatatactggcccctttgaaaaacattccttcatgttccatggtgtaagcacaagtagacgtaatctcacccccatgtgatggggtgagacggtgcatgtaaagtgcccaagcacagccatcccttagtaaacacttaactccttcccttgctatgaaggaataatggaattagcacaatgtttcatatctatctcgttcgacttatccgtatctatctatccatccattcatccatccatccacccacctataaaascaatccagaaatatattcaagacaagtctgtcttttcacagcccaggtccatgggtgagctccatggggaccacttcctcatatgcttcaaatcaaaaccctcaccatgcgatgccccagagaaggataattcaggtacagagcccagagataacgcgtctctccaacagatccctgctcagtcaatacaaaaagagccctgattgtcattgaagcaggtgggttggggcaacaccaagaacccatttttccataaaaactttactctaagtattttctggaaatagctgaaataatatt

SEQ ID NO: 124012 - DNA, 601 bp, Human
gatgacagatgacggtctctcaaccgcacagaactcacgcctcctccgggatcagcctatgcaccctgtacagaggctccctgctgctcagttttctactgatccacccttccccaagtgccccactctttgggaaggagcaactacaatctggcttttttcctagaggattaaatatactggcccctttgaaaaacattccttcatgttccatggtgtaagcacaagtagacgtaatctcacccccatgtgatggggtgagacggtgcatgtaaagtgcccaagcacagccatcccttastaaacacttaactccttcccttgctatgaaggaataatggaattagcacaatgtttcatatctatctcgttcgacttatccgtatctatctatccatccattcatccatccatccacccacctataaaaccaatccagaaatatattcaagacaagtctgtcttttcacagcccaggtccatgggtgagctccatggggaccacttcctcatatgcttcaaatcaaaaccctcaccatgcgatgccccagagaaggataattcaggtacagagcccagagataacgcgtctctccaacag

SEQ ID NO: 124013 - DNA, 601 bp, Human
gacggtaagaaaaacatcaagtaaaggtaattaagaatgcaaggaaaatgactgtaccattccggtacaggatcagtgcgaagaagatgcctaataagtgtgcgtgcacacgcgtgcttaacagagtcctgctgctgacacccccttgagttttgttttgctttcccaaatgtacattctatctgcttttatgtgacatggggtggactgtacattccatcacttatcaaagcactcctatacaatagggactggaactaattaaaataagataccgtctgcatttgatggaactttatcytaagccccataacattcatttccagtttggtcatttgaacacaatggcagcctcgcattccgaagtctctgaataatattaaatcatcttttccttttgttaataatattaattacacaactctccagatgtgaaggtatcataaaaatgctttgccaacgtagggaaacgttctgatgcactgcaataaaagataacactaaatacttccataaaacagctaatttcaccaagtgtttaattgtaatgactgggtggagtaaatattagtcagactgacagctaattgatttggtttgc

SEQ ID NO: 124014 - DNA, 601 bp, Human
ctgtaatatccacccttctccagacttttggcaaaagaacaagttaaaaacaaatgctttcagtttgcttaaatgacaagccttggaaaaacccagcgaccgataactgcacactgcgaacacttgggctgttcctccaaggacagggctgagtaacaaagcaatctgagcaaaatggcccttttcaaagacggtaagaaaaacatcaagtaaaggtaattaagaatgcaaggaaaatgactgtaccattccggtacaggatcagtgcgaagaagatgcctaataagtgtgcgtgcacacrcgtgcttaacagagtcctgctgctgacacccccttgagttttgttttgctttcccaaatgtacattctatctgcttttatgtgacatggggtggactgtacattccatcacttatcaaagcactcctatacaatagggactggaactaattaaaataagataccgtctgcatttgatggaactttatcctaagccccataacattcatttccagtttggtcatttgaacacaatggcagcctcgcattccgaagtctctgaataatattaaatcatcttttccttttgttaataatatta

SEQ ID NO: 124015 - DNA, 601 bp, Human
tccatctgtggttaatggaaagatctgcttcaacattgcatcactgctggaaggaaacccgagctttgattaaactccgggggcaaagtcccatcctacaaaacagaatgcctcctctggtccttgcaatcattttgcaacttctaagctttaaagcactgaaatgaagcattgaacccaagcctcctacggccctagaaggagccaccaaggctccctctgaacatctttatccttccatttccatcaccaatctggctgagatctgtagggaaggaaaagagctgaacccaagtcatcttgctaaaatgtaaggtctggaagacacaggcagcaacgactaactataagccagcttggaacataatcagaacaagtaattttaaaaaaatttgtgagccctttcagtgattggtcgacgcttctgtaatatccacccttctccagacttttggcaaaagaacaagttaaaaacaaatgctttcagtttgcttaaatgacaagccttggaaaaacccagcgaccgataactgcacactgcgaacacttgggctgttcctccaaggacagggctgagtaacaaagcaatctgagcaaaatg

SEQ ID NO: 124016 - DNA, 601 bp, Human
ctctagcacacaaaactgttagataaaattccatctgtggttaatggaaagatctgcttcaacattgcatcactgctggaaggaaacccgagctttgattaaactccgggggcaaagtcccatcctacaaaacagaatgcctcctctggtccttgcaatcattttgcaacttctaagctttaaagcactgaaatgaagcattgaacccaagcctcctacggccctagaaggagccaccaaggctccctctgaacatctttatccttccatttccatcaccaatctggctgagatctgtagsgaaggaaaagagctgaacccaagtcatcatgctaaaatgtaaggtctggaagacacaggcagcaacgactaactataagccagcttggaacataatcagaacaagtaattttaaaaaaatttgtgagccctttcagtgattggtcgacgcttctgtaatatccacccttctccagacttttggcaaaagaacaagttaaaaacaaatgctttcagtttgcttaaatgacaagccttggaaaaacccagcgaccgataactgcacactgcgaacacttgggctgttcctccaaggacaggg

SEQ ID NO: 124017 - DNA, 601 bp, Human
gccagtggtggccgtatttcagaggatccctcaggagcatgggaggtgactggccggggcaaggatgcccacatgaggccagcaaggagggcagtgcagtggtgcaggcaagagatgacaggagctgggcctagggcaggagacacaggacatggcagggccaggttgtacgggaggtggaacaagtgtaggggggaaggagaggccgctggcactgcagtggaatgcggatgagcgcttccctctgagacagactagggtcagagacagtgagctgggtttgggacatactgactttggrttgtctttgagatatctaagcggaagggcagagcatgtcgtgaaagaataaaatgctgtcttttaaggtaaatttacacattcaaactttttaccaattcctagcagccatgccactagaaccagctgggtggtgctgaaaatgtgaacagccaacttgtcactgtcattcgatcaccctcatgggggagcagtccaccgtccccacgtgggcaaatcctctgggccctgggcagctgcctggccctgccctcagcccatgacacagttcatcaacccctgagaccaatgtggtcactta

SEQ ID NO: 124018 - DNA, 601 bp, Human
accacctgcagctcccctgccgactctgtctgtccctgacagatcccaaacaaactgaactagtcatcgttcccaacaaacactgctgtgtgctcctactctagggccagatctagaatacaaacatacgactgctagaagagcaggccaagtccgcagcctctgagcaggcttcctggtggcagggatattggagcccagaggggaaggtggggaagagagcaacagcaggggaaggtggggagccgtctgtgcaaaagctctgcagagggaaaaagagcgaaagtcacccgaggaggaycttaaaggccagtggtggccgtatttcagaggatccctcaggagcatgggaggtgactggccggggcaaggatgcccacatgaggccagcaaggagggcagtgcagtggtgcaggcaagagatgacaggagctgggcctagggcaggagacacaggacatggcagggccaggttgtacgggaggtggaacaagtgtaggggggaaggagaggccgctggcactgcagtggaatgcggatgagcgcttccctctgagacagactagggtcagagacagtgagctgggtttgggacatactg

SEQ ID NO: 124019 - DNA, 601 bp, Human
ccgccttcccatcgcctctcctctggttctggaacactgaacgccctcccaagcctgacaatccaggtcccccaggaaccacctgcagctcccctgccgactctgtctgtccctgacagatcccaaacaaactgaactagtcatcgttcccaacaaacactgctgtgtgctcctactctagggccagatctagaatacaaacatacgactgctagaagagcaggccaagtccgcagcctctgagcaggcttcctggtggcagggatattggagcccagaggggaaggtggggaagagagcracagcaggggaaggtggggagccgtctgtgcaaaagctctgcagagggaaaaagagcgaaagtcacccgaggaggatcttaaaggccagtggtggccgtatttcagaggatccctcaggagcatgggaggtgactggccggggcaaggatgcccacatgaggccagcaaggagggcagtgcagtggtgcaggcaagagatgacaggagctgggcctagggcaggagacacaggacatggcagggccaggttgtacgggaggtggaacaagtgtaggggggaaggagaggccgctggcact

SEQ ID NO: 124020 - DNA, 601 bp, Human
aaagaagttgcttatgttacacacaacttgcttataggagtcacatctctggaacttgagatatgcttcaggaagcattgtctactgttctctgggttgctgctggacttgtaagggagtaaaagcaaatgatatgtggccttgaccctcgataacctcctgttgcattggcaagagatgggcttgcatgctttgaactccaagttcctctctcccgaggcatccgcacagcagcgtcagtccgccttcccatcgcctctcctctggttctggaacactgaacgccctcccaagcctgacratccaggtcccccaggaaccacctgcagctcccctgccgactctgtctgtccctgacagatcccaaacaaactgaactagtcatcgttcccaacaaacactgctgtgtgctcctactctagggccagatctagaatacaaacatacgactgctagaagagcaggccaagtccgcagcctctgagcaggcttcctggtggcagggatattggagcccagaggggaaggtggggaagagagcaacagcaggggaaggtggggagccgtctgtgcaaaagctctgcagagggaaaaagagcga

SEQ ID NO: 124021 - DNA, 601 bp, Human
gttaatatgaggtcatgatgcgggggaccctaatccaatctggccagtgtcccatgagaagaggagattaggacagagccactcgcagagagggacaaccacgtgaggatcaagagacctcagaagaaaccaaccctgccaacgccgtaatctcagtcttccaaccttcctaagtgtgagacaatacggttctgcggttgaagtccccgcatcctgtgggactttgttacaactgcccccgcagactaacaaactatgaggtccaacactgctcaacgtgtctgacatgcagtcactgtcwgtacctctgttattttagcttcagcaatacaggatacagctttgtcaactgaaaactatatttaggatttttccataatttagccaaggtgggtcagaatttacttctaaagtatttacatagaaagaagttgcttatgttacacacaacttgcttataggagtcacatctctggaacttgagatatgcttcaggaagcattgtctactgttctctgggttgctgctggacttgtaagggagtaaaagcaaatgatatgtggccttgaccctcgataacctcctgttgcattggcaagag

SEQ ID NO: 124022 - DNA, 601 bp, Human
gagagcccatcatggcgagatgcccaggcccacctccggcgcagcactggctcacctaggggtggggccgggaaaccccaggctgccatggcaaacacacagcgggaacccagtgagtaagcccgggcagtagaggagggggaggaggaaccagaaaataaaggacattctaactcagcctagaaagccacccccaccaccacctcccgtgtcatccaggcagctgcgagcccagctccctccccactgcctcccctgcagccataactgcaacagcgtagagaccatttcttgaattctktccattgaagttaaactacaggtgccagaagacccctgcttaacagtcatgagagagggaagtcctcgctctgccgatgacggaaatgggacagtgcgtgtgaaagctctttgggaaagtaaagctactcatttgtaagttagttcttattttgctgaaaggggacagaaggtgcccctctccccaccgcccgccacccacctccactcactgacaacagaagaggcagctggagcccagcttcacctattgttaggggctgacctgtgaacccctaaattcttatgttgaaatcttaac

SEQ ID NO: 124023 - DNA, 601 bp, Human
agcctgttattctctctgtgtgggaggtgggcaccctgcctgggcctctccctccacactgtaaagcaggggctgggaccggtccctctctcagagcttgtgcactcaacagtctgtggcgcttagatcttgattcccatcaaccttgactgctctgagcacctcgctgggccaacatccaaccagctaaagagctcagtgagaaagctgactggtgaatttaaagaaagaaaaatcccactccccgacaagtgcccgtcactgcataatgtgcaacgtggcccttctctcactgacaggygacgattcatgcagcacactggagccatcttgccctggatcccacagtccctcaaggagtggaaggacaggctcgagtcccagaaaccccagaactgtatgcaaaatggtgccggcatgagcatgatgtcttttttcctctggagagcgagaggccccacaacttccaacagcttttcaaaggggcctgtgattcccccaaatggctaagaaccactgaaccaagctagacagaggcagaaagcagatccaagttctccgagtgagggattggtcctgtggctgtcatcttccagcaggg

SEQ ID NO: 124024 - DNA, 601 bp, Human
tctccctggtttcatcaaagcgaaggttactttattctgtaactgtgaaagaacaaggggactgcaagccagacctgactgtccaccagggcatatcaagggagggagtcggaggccatacctcggcacccaggagccaccaagctccaaagcctcctccaggagagaacaatcagggcaccgtagaaaataagcctgttattctctctgtgtgggaggtgggcaccctgcctgggcctctccctccacactgtaaagcaggggctgggaccggtccctctctcagagcttgtgcactcamcagtctgtggcgcttagatcttgattcccatcaaccttgactgctctgagcacctcgctgggccaacatccaaccagctaaagagctcagtgagaaagctgactggtgaatttaaagaaagaaaaatcccactccccgacaagtgcccgtcactgcataatgtgcaacgtggcccttctctcactgacaggcgacgattcatgcagcacactggagccatcttgccctggatcccacagtccctcaaggagtggaaggacaggctcgagtcccagaaaccccagaactgtatgcaaaatg

SEQ ID NO: 124025 - DNA, 601 bp, Human
cagagacccagaagggtgccctgcccgcgttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacaggggagggtgtttcgaaactttcactcatgagccagtgtcaccaaagagagcatgaaatccctcccacttgcacgtccacccaaagccaccatgtcctctgccctaacttcaagcctgtgcctattcagaggggccctgctgtggctcaggaaggcccctagaagttcttgggagctggagagtcctaaaaggagaggggcttcagtctttgctctgagatggagggaaggccacgaagggcatacacaggcaccctcccccagcggtccaggggtcccacacagcatcaagggagtcaagctgctgaggttctttgaagtacgcaccggcagggctgcggacaccaggttcacacaggttctgcacagttgtagccaacgcaagggagacagctcgg

SEQ ID NO: 124026 - DNA, 601 bp, Human
acaagcagagacccagaagggtgccctgcccgcgttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacaggggagggtgtttcgaaactttcactcatgagccagtgtcaccaaagagagcatgaaatccctcccacttgcacgtccacccaaagccaccaggtcctctgccctaacttcaagcctgtgcctattcagaggggccctgctgtggctcaggaaggcccctagaagttcttgggagctggagagtcctaaaaggagaggggcttcagtctttgctctgagatggagggaaggccacgaagggcatacacaggcaccctcccccagcggtccaggggtcccacacagcatcaagggagtcaagctgctgaggttctttgaagtacgcaccggcagggctgcggacaccaggttcacacaggttctgcacagttgtagccaacgcaagggagacag

SEQ ID NO: 124027 - DNA, 601 bp, Human
taaacaagcagagacccagaagggtgccctgcccgcgttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacaggggagggtgtttcgaaactttcactcatgagccagtgtcaccaaagagagcatgaaatccctcccacttgcacgtccacccaaagccaccatgtcctctgccctaacttcaagcctgtgcctattcagaggggccctgctgtggctcaggaaggcccctagaagttcttgggagctggagagtcctaaaaggagaggggcttcagtctttgctctgagatggagggaaggccacgaagggcatacacaggcaccctcccccagcggtccaggggtcccacacagcatcaagggagtcaagctgctgaggttctttgaagtacgcaccggcagggctgcggacaccaggttcacacaggttctgcacagttgtagccaacgcaagggaga

SEQ ID NO: 124028 - DNA, 601 bp, Human
taaaatgaggcatccgttgactgtccctctgttgataagacgaggtaaaatctaaggatgttcctaaagggtaacataaacaagcagagacccagaagggtgccctgcccgcgttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacaggggagggtgtttygaaactttcactcatgagccagtgtcaccaaagagagcatgaaatccctcccacttgcacgtccacccaaagccaccatgtcctctgccctaacttcaagcctgtgcctattcagaggggccctgctgtggctcaggaaggcccctagaagttcttgggagctggagagtcctaaaaggagaggggcttcagtctttgctctgagatggagggaaggccacgaagggcatacacaggcaccctcccccagcggtccaggggtcccacacagcatcaagggagtcaagctgctgaggttct

SEQ ID NO: 124029 - DNA, 601 bp, Human
acgctctggggcagggagttctaatcatgaagaaggcttcatcgtcttctcaagacaggtgcgcagcaacactttcttttgtagtgtgtgcttcctccagcttccttctcgagaagccaagttaaaatgaggcatccgttgactgtccctctgttgataagacgaggtaaaatctaaggatgttcctaaagggtaacataaacaagcagagacccagaagggtgccctgcccgcgttccagtaaatggcttgccatgctgcaggctgtccatgccaccgagttgtgatccttgtccaagcrtcctttcagcgagcagccatgggcagccttggccctgtcttcttccctgtgggccacaggtgggccagaagcttgctgacatatcattcccaggtgtgacaagcgacaggggagggtgtttcgaaactttcactcatgagccagtgtcaccaaagagagcatgaaatccctcccacttgcacgtccacccaaagccaccatgtcctctgccctaacttcaagcctgtgcctattcagaggggccctgctgtggctcaggaaggcccctagaagttcttgggagctggagagtcctaaaag

SEQ ID NO: 124030 - DNA, 601 bp, Human
tatccttttctctattttccaaatgtatgtttcctgctaaacatgcagcacagttatagataagctacgctctggggcagggagttctaatcatgaagaaggcttcatcgtcttctcaagacaggtgcgcagcaacactttcttttgtagtgtgtgcttcctccagcttccttctcgagaagccaagttaaaatgaggcatccgttgactgtccctctgttgataagacgaggtaaaatctaaggatgttcctaaagggtaacataaacaagcagagacccagaagggtgccctgcccgcrttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacaggggagggtgtttcgaaactttcactcatgagccagtgtcaccaaagagagcatgaaatccctcccacttgcacgtccacccaaagccaccatgtcctctgccctaacttcaagcctgtgcctatt

SEQ ID NO: 124031 - DNA, 601 bp, Human
ctctgacctttttatccttttctctattttccaaatgtatgtttcctgctaaacatgcagcacagttatagataagctacgctctggggcagggagttctaatcatgaagaaggcttcatcgtcttctcaagacaggtgcgcagcaacactttcttttgtagtgtgtgcttcctccagcttccttctcgagaagccaagttaaaatgaggcatccgttgactgtccctctgttgataagacgaggtaaaatctaaggatgttcctaaagggtaacataaacaagcagagacccagaagggkgccctgcccgcgttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacaggggagggtgtttcgaaactttcactcatgagccagtgtcaccaaagagagcatgaaatccctcccacttgcacgtccacccaaagccaccatgtcctctgccctaacttcaag

SEQ ID NO: 124032 - DNA, 601 bp, Human
cttcactctgacctttttatccttttctctattttccaaatgtatgtttcctgctaaacatgcagcacagttatagataagctacgctctggggcagggagttctaatcatgaagaaggcttcatcgtcttctcaagacaggtgcgcagcaacactttcttttgtagtgtgtgcttcctccagcttccttctcgagaagccaagttaaaatgaggcatccgttgactgtccctctgttgataagacgaggtaaaatctaaggatgttcctaaagggtaacataaacaagcagagacccagragggtgccctgcccgcgttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacaggggagggtgtttcgaaactttcactcatgagccagtgtcaccaaagagagcatgaaatccctcccacttgcacgtccacccaaagccaccatgtcctctgccctaact

SEQ ID NO: 124033 - DNA, 601 bp, Human
aaggcaaggtttgccaaatgccacttctagcccaaacagaaaccgtctttctctgcaaatctgtagaaagtgccaggatttctttaacgtcatactttgaagatagaacttcactctgacctttttatccttttctctattttccaaatgtatgtttcctgctaaacatgcagcacagttatagataagctacgctctggggcagggagttctaatcatgaagaaggcttcatcgtcttctcaagacaggtgcgcagcaacactttcttttgtagtgtgtgcttcctccagcttccttctygagaagccaagttaaaatgaggcatccgttgactgtccctctgttgataagacgaggtaaaatctaaggatgttcctaaagggtaacataaacaagcagagacccagaagggtgccctgcccgcgttccagtaaatggcttgccatgctgcaggctgtccatgccaccgagttgtgatccttgtccaagcgtcctttcagcgagcagccatgggcagccttggccctgtcttcttccctgtgggccacaggtgggccagaagcttgctgacatatcattcccaggtgtgacaagcgacag

SEQ ID NO: 124034 - DNA, 601 bp, Human
ggtcacttattctgtggctcactcaacaaaaatgcactgagtcttcctgtgtgtctggcgctaggttctgggaagatcagcatgaacatacctggttcccggccaggaccaaagtgcctccccctcccatccccagctgggatgcaaagctctgccttcaatgccccctcggggtgaaaccaggagccacctggacactctgtggaggtcagaggtgtgtcaccagccccaaaccaagcgactaaaactccagccctcccatcgaatggaagcaaccctcacaggttgcagtgagcagagrttgcaccattgcactccagcctgggcgacagagtgagactctgtctcaaaaaaaaaaagaaagaaagaaagaaagaaaatgtgattaggtctaaatgactgctagatgacatctgttgactttttttgtggaaaatcaactataagtgatttggggcaaaggcaaggtttgccaaatgccacttctagcccaaacagaaaccgtctttctctgcaaatctgtagaaagtgccaggatttctttaacgtcatactttgaagatagaacttcactctgacctttttatccttttctctattt

SEQ ID NO: 124035 - DNA, 601 bp, Human
ctttttacctggtctaagatgccgcaaacaatatttcataatctgttcagcacgctattacaaaatacagtggtatgtagatcccgcacagcccaaagctcccagggatgtcccgccctcctgccaggctgagccctgtttgtgctaaggggccctgaactctctgttctaacaacatccagccccttccaattgctgtgcccaccagaccacacttccagtcagaggaggaggcacactctgcccttccaagcccaagtgggtgacaccccactaatcagctgggagatgtgggaaagcrtagagccagaagtcataagagggttcctcagcaggatggaagagcctgggcatcccggcccttggtccttgctgggctctgggcaaaaccccacaacactggcacacagttctgagggggactgtgatagcctgcggcccgcagcacagtttggggctctctctctgtcgtggtcgcaggggcagccctctctctgctaacacacctgctcattgtaagtctctgacggcaagtgaggtgctgtcaggccaatggaaccgaacactgtacaacagatgactgaccaggcgtgggggcttc

SEQ ID NO: 124036 - DNA, 601 bp, Human
aagtcctagataatttataatggccgctgacagatacttccacagaaaataaaactataaaatgagatattttgttcctaacaccggctgatggcattttgcaatgtccccatatattactgcctgaactagaaggctttttacctggtctaagatgccgcaaacaatatttcataatctgttcagcacgctattacaaaatacagtggtatgtagatcccgcacagcccaaagctcccagggatgtcccgccctcctgccaggctgagccctgtttgtgctaaggggccctgaactctcygttctaacaacatccagccccttccaattgctgtgcccaccagaccacacttccagtcagaggaggaggcacactctgcccttccaagcccaagtgggtgacaccccactaatcagctgggagatgtgggaaagcgtagagccagaagtcataagagggttcctcagcaggatggaagagcctgggcatcccggcccttggtccttgctgggctctgggcaaaaccccacaacactggcacacagttctgagggggactgtgatagcctgcggcccgcagcacagtttggggctctctct

SEQ ID NO: 124037 - DNA, 601 bp, Human
cagcccgtcccaccccgatgtaattcgtctataaaacaccagcagaccagacgccttagaaacactgcaaagggctcaaaaccagtttcacgtcacacacttaaaaaatcctcagcaccaagtcctagataatttataatggccgctgacagatacttccacagaaaataaaactataaaatgagatattttgttcctaacaccggctgatggcattttgcaatgtccccatatattactgcctgaactagaaggctttttacctggtctaagatgccgcaaacaatatttcataatctgytcagcacgctattacaaaatacagtggtatgtagatcccgcacagcccaaagctcccagggatgtcccgccctcctgccaggctgagccctgtttgtgctaaggggccctgaactctctgttctaacaacatccagccccttccaattgctgtgcccaccagaccacacttccagtcagaggaggaggcacactctgcccttccaagcccaagtgggtgacaccccactaatcagctgggagatgtgggaaagcgtagagccagaagtcataagagggttcctcagcaggatggaagagc

SEQ ID NO: 124038 - DNA, 601 bp, Human
tagaggcaggggaggaacaagagaagggggcggggccccaaggtgacccaaggctggcgacccagggtcgtgctggaagctagaacagagctacctgaggctgagtgggcagggagtaacagtccccaagagcaaagggacaagatttctcttcctcctccctgagccgtggcctccccacatcaccctgagcaaggagagcggagcacctgcatacacagctcaaatttagggctggggatggcctccaagacatccttggtgtacagggcaaaatgccggaagagaggcatcccagccygtcccaccccgatgtaattcgtctataaaacaccagcagaccagacgccttagaaacactgcaaagggctcaaaaccagtttcacgtcacacacttaaaaaatcctcagcaccaagtcctagataatttataatggccgctgacagatacttccacagaaaataaaactataaaatgagatattttgttcctaacaccggctgatggcattttgcaatgtccccatatattactgcctgaactagaaggctttttacctggtctaagatgccgcaaacaatatttcataatctgttcagc

SEQ ID NO: 124039 - DNA, 601 bp, Human
ctctttgcaggtgctacagccttccttgtgcgtgaatatctgtgtcatagcagatattttagatggtaagttcctggggacattttcacttcaaagtgactacatttgaaagatgagaagttgtttgtgtatacagaggaagaaataacaccactctgatagattttgaagtcgttgtactaaaagaaagaaagtgctcacgcctgtcatcccagcacgttgggaggccgaggcaggaagatcgcctgagcccaggagtttgagaccagcctgggcaacatggtgaaaccccacctctccaaaaaaaaaaaaaaaaaaatctagctgggcatgatggcgcatgcctgtagtcccagctcctcaggagactgaggtgaaaggattgcttgagcctgggaagtcaaggctgcagtgagccatgattggtgccactgcactccagtctgggcaacacagcaagaccctgtcaaaaaaaaaaaaagacagagagagagagagacagaaagacaagaaggaagggagggagagagggagagaaggaaggaagccagccttgtgaaattgccaataaattatctggtgatccttgtcctgaagaaaa

SEQ ID NO: 124040 - DNA, 601 bp, Human; identical to SEQ ID NO: 25242

SEQ ID NO: 124041 - DNA, 601 bp, Human; identical to SEQ ID NO: 25243

SEQ ID NO: 124042 - DNA, 601 bp, Human; identical to SEQ ID NO: 25244

SEQ ID NO: 124043 - DNA, 601 bp, Human; identical to SEQ ID NO: 25245

SEQ ID NO: 124044 - DNA, 601 bp, Human; identical to SEQ ID NO: 25246

SEQ ID NO: 124045 - DNA, 601 bp, Human; identical to SEQ ID NO: 25247

SEQ ID NO: 124046 - DNA, 601 bp, Human
tccaagcccacctctgggtgaggtgctctaacacagctccctctctgtgtgtgctggcacacaacagggaatttccctgggatgtccctggagctgaccatagagctcttccttttcatgtctttattgttagttgtcactcaagagactataatgcatatcctaacttatcccagtctatctggaattaatagtatactattttctgtataatgtataaatctaagatagagcgtttccattcaccatgactgttaccattcctgctgttgtttatatacatatatatatatattgcttyatacgttataaacccacagtgcattgctattattcttgttttaaacacatgccaaattctatccctacattttccagatctggagggagcaccttcacttgcaggactcgggaaacgtagggaaagagtttggcgatgagtgtagagctatctaacggtaatgctgtatttactgtgcacctcatctgggaggatctttatgcatgttacttccactgactcctccccgcaatccatgatgcaggtgttacctacctgtgagaccccagggagtcctctaaaccagcgcttctcacattg

SEQ ID NO: 124047 - DNA, 601 bp, Human
gcttgacacggcaggacttgactacccgtgagagtgctgaggagacaattacgtctgcggcgtggggctggggtgagcaggccacataaagatcgaggacatgaggtggagctcacacctctctggaaggtaggtgtggggttgaggctggccttgacccaaggatccagtgatagccactggctccaaagctgctgcaaacagctttagcctctccacacaggcagccaacccgcttcctcctggttctccctccaagcccacctctgggtgaggtgctctaacacagctccctctctgwgtgtgctggcacacaacagggaatttccctgggatgtccctggagctgaccatagagctcttccttttcatgtctttattgttagttgtcactcaagagactataatgcatatcctaacttatcccagtctatctggaattaatagtatactattttctgtataatgtataaatctaagatagagcgtttccattcaccatgactgttaccattcctgctgttgtttatatacatatatatatatattgcttcatacgttataaacccacagtgcattgctattattcttgttttaaaca

SEQ ID NO: 124048 - DNA, 601 bp, Human
tcagcatgtctttggagggaaccaacaaggaagatggcacagaaccacctattgaagttaaaggggcaggtaggagccccaggggtggcagagcaggcaccccatgagagcagggcatgagggtgtggctgagcttgacacggcaggacttgactacccgtgagagtgctgaggagacaattacgtctgcggcgtggggctggggtgagcaggccacataaagatcgaggacatgaggtggagctcacacctctctggaaggtaggtgtggggttgaggctggccttgacccaaggatccrgtgatagccactggctccaaagctgctgcaaacagctttagcctctccacacaggcagccaacccgcttcctcctggttctccctccaagcccacctctgggtgaggtgctctaacacagctccctctctgtgtgtgctggcacacaacagggaatttccctgggatgtccctggagctgaccatagagctcttccttttcatgtctttattgttagttgtcactcaagagactataatgcatatcctaacttatcccagtctatctggaattaatagtatactattttctgtataatgt

SEQ ID NO: 124049 - DNA, 601 bp, Human
tatgcatgataacagggatattttttaattaacgcattgaatatggttgagcacatgctgcatgtataatactggatatgccgctgacagagagacgaaagagatgagggtcacagttctgggcctctaggagctcagcatgtctttggagggaaccaacaaggaagatggcacagaaccacctattgaagttaaaggggcaggtaggagccccaggggtggcagagcaggcaccccatgagagcagggcatgagggtgtggctgagcttgacacggcaggacttgactacccgtgagagwgctgaggagacaattacgtctgcggcgtggggctggggtgagcaggccacataaagatcgaggacatgaggtggagctcacacctctctggaaggtaggtgtggggttgaggctggccttgacccaaggatccagtgatagccactggctccaaagctgctgcaaacagctttagcctctccacacaggcagccaacccgcttcctcctggttctccctccaagcccacctctgggtgaggtgctctaacacagctccctctctgtgtgtgctggcacacaacagggaatttccctggga

SEQ ID NO: 124050 - DNA, 601 bp, Human
ggtacacaggcaggtaaatgtatttcttgtcataagtagtttgcggtcaactacatgtttaaaacaagaaatgcactgtgggtttataacatgtgaagtagaatctataaaaacaacagcacaaacaatgacagtgatggtgaatggaaacaatcttagatttacacattatatagaaagtacactattaattccagatagactgggataagttgggatatgcatgataacagggatattttttaattaacgcattgaatatggttgagcacatgctgcatgtataatactggatatgccrctgacagagagacgaaagagatgagggtcacagttctgggcctctaggagctcagcatgtctttggagggaaccaacaaggaagatggcacagaaccacctattgaagttaaaggggcaggtaggagccccaggggtggcagagcaggcaccccatgagagcagggcatgagggtgtggctgagcttgacacggcaggacttgactacccgtgagagtgctgaggagacaattacgtctgcggcgtggggctggggtgagcaggccacataaagatcgaggacatgaggtggagctcaca

SEQ ID NO: 124051 - DNA, 601 bp, Human
taattagctgggaaaggttgtgttcacctgcagtcccagatacttgggaggctcgggtgggaggatcacttgaggccaggagtttaaggctgcagtgagctatgattatgccactgcactccaacctgggtgacagagcaagaccccatctcttcaaaaaaaaaaaaaggagccataggaacaaatcacgtttcttaaaagggaacaacaataaggatggcaattaacaatcgactcatcgtcggaaacaatggataccagaagacaacagaataacacctttaaagtgttgaaagacaamaaaaaagttagaaggtcgtgttcagcataatttcttttaagaaaaatgaagagaagccactttcagataaaattggagagaatttttcactagcatacctgaacctcaacaaataccaaaagaggtgagagataacctcaataaataccaaagagcctggcgacaggctgaagataaatggaaagatggaaatctgaagctagaaaaagtaaggaagaccagtcagtggaatggtacacaggcaggtaaatgtatttcttgtcataagtagtttgcggtcaactacatgtttaaaacaag

SEQ ID NO: 124052 - DNA, 601 bp, Human
gtccagcctgggcaacacagcagtatctcatcctacaaggaaaaaggtgtgtgttttttttaattagctgggaaaggttgtgttcacctgcagtcccagatacttgggaggctcgggtgggaggatcacttgaggccaggagtttaaggctgcagtgagctatgattatgccactgcactccaacctgggtgacagagcaagaccccatctcttcaaaaaaaaaaaaaggagccataggaacaaatcacgtttcttaaaagggaacaacaataaggatggcaattaacaatcgactcatcrtcggaaacaatggataccagaagacaacagaataacacctttaaagtgttgaaagacaaaaaaaaagttagaaggtcgtgttcagcataatttcttttaagaaaaatgaagagaagccactttcagataaaattggagagaatttttcactagcatacctgaacctcaacaaataccaaaagaggtgagagataacctcaataaataccaaagagcctggcgacaggctgaagataaatggaaagatggaaatctgaagctagaaaaagtaaggaagaccagtcagtggaatggtacaca

SEQ ID NO: 124053 - DNA, 601 bp, Human
gatagcaaacattaaaaaaaagaataatcaggtctccacaagctcacatttaaccaactgctagaacgaaacttttttttttttttgagacggagtctcgctctgtcgcccaggctggagtgcagttggcgcgatctcagctcactgcaagctctgcctcccgggttcacgccattctcctgcctcagcctcccaagtagctgggactgcaggcgcccgccaccgcgcccggctaattttttgcatttttagtagagatggggtttcactgtgttagccaggatggtctcaatctcctgayctcgggatccacccgcctcagcctcccacagtgctgggattacaggcgtgagccaccgcgcctggccaagaaagaaacttaatgatattcaaagacaacagaatccagagtctctacaatgtaacaatatctaccatacaataaaaaattactagacatatgcaaagaaagagaaatacatgacccactgtaaagagaaaaatcagtcattataaacatactcctaaaatggcctagatgttggaattaagtgcaaaagactttaaagtatttcttacaaacatgttaaagagtctagaa

SEQ ID NO: 124054 - DNA, 601 bp, Human
ctggaggagctgagcaggtatttcagctgctgcccactacagggcagtccatctggagtttcagacttgctaagttagaggtctgggtttaaacattgcaggctttccactgaaataccaaaagggtcatggtctaggagtaaagaccatatgctagggctaatggattttccctaaggctatgcgaaaatcagaaagatagcaaacattaaaaaaaagaataatcaggtctccacaagctcacatttaaccaactgctagaacgaaacttttttttttttttgagacggagtctcgctcygtcgcccaggctggagtgcagttggcgcgatctcagctcactgcaagctctgcctcccgggttcacgccattctcctgcctcagcctcccaagtagctgggactgcaggcgcccgccaccgcgcccggctaattttttgcatttttagtagagatggggtttcactgtgttagccaggatggtctcaatctcctgatctcgggatccacccgcctcagcctcccacagtgctgggattacaggcgtgagccaccgcgcctggccaagaaagaaacttaatgatattcaaagacaacagaa

SEQ ID NO: 124055 - DNA, 601 bp, Human
gaagtccagtaggaaaacagcagctgagaggctggaggagctgagcaggtatttcagctgctgcccactacagggcagtccatctggagtttcagacttgctaagttagaggtctgggtttaaacattgcaggctttccactgaaataccaaaagggtcatggtctaggagtaaagaccatatgctagggctaatggattttccctaaggctatgcgaaaatcagaaagatagcaaacattaaaaaaaagaataatcaggtctccacaagctcacatttaaccaactgctagaacgaaacttttttttttttttgagacggagtctcgctctgtcgcccaggctggagtgcagttggcgcgatctcagctcactgcaagctctgcctcccgggttcacgccattctcctgcctcagcctcccaagtagctgggactgcaggcgcccgccaccgcgcccggctaattttttgcatttttagtagagatggggtttcactgtgttagccaggatggtctcaatctcctgatctcgggatccacccgcctcagcctcccacagtgctgggattacaggcgtgagccaccgcgcctggccaagaa

SEQ ID NO: 124056 - DNA, 601 bp, Human
aaattgagaggagaaatttcagaaaggagagatctacagaagagaacatataaactcctcacaaccacttggctgaaccctgaagtatacatgggcaacccactaagaagtccagtaggaaaacagcagctgagaggctggaggagctgagcaggtatttcagctgctgcccactacagggcagtccatctggagtttcagacttgctaagttagaggtctgggtttaaacattgcaggctttccactgaaataccaaaagggtcatggtctaggagtaaagaccatatgctagggctaayggattttccctaaggctatgcgaaaatcagaaagatagcaaacattaaaaaaaagaataatcaggtctccacaagctcacatttaaccaactgctagaacgaaacttttttttttttttgagacggagtctcgctctgtcgcccaggctggagtgcagttggcgcgatctcagctcactgcaagctctgcctcccgggttcacgccattctcctgcctcagcctcccaagtagctgggactgcaggcgcccgccaccgcgcccggctaattttttgcatttttagtagagatggggtttc

SEQ ID NO: 124057 - DNA, 601 bp, Human
cagtaaaatgtcatcttattctccagaggagtcaggggatagagttgggactgtcagagctgctggaaattgagaggagaaatttcagaaaggagagatctacagaagagaacatataaactcctcacaaccacttggctgaaccctgaagtatacatgggcaacccactaagaagtccagtaggaaaacagcagctgagaggctggaggagctgagcaggtatttcagctgctgcccactacagggcagtccatctggagtttcagacttgctaagttagaggtctgggtttaaacattkcaggctttccactgaaataccaaaagggtcatggtctaggagtaaagaccatatgctagggctaatggattttccctaaggctatgcgaaaatcagaaagatagcaaacattaaaaaaaagaataatcaggtctccacaagctcacatttaaccaactgctagaacgaaacttttttttttttttgagacggagtctcgctctgtcgcccaggctggagtgcagttggcgcgatctcagctcactgcaagctctgcctcccgggttcacgccattctcctgcctcagcctcccaagtagc

SEQ ID NO: 124058 - DNA, 601 bp, Human
cccggctaaatttttcaaaattttttgtagagacagggtatcactatgttgaccaggttggtctcaaatttctgggctcaaaaggtcttcctgcctcaacccccaaagtgctgggattacaagtgtgaaccactatgcccagcccataaaaactttaaacagatttttattaaaaaattatatatgaaaagggggcacaaatcatcaatgtacagcttgacaacttaatataaaattaaagtctctctaaaatgaaagacatcagggaccagtgaccgcacaggggtaccccactctcctytctggaaacaatgaagatggcacatgcctctgtggattcctgacagtgtaaaatttctccccagggtaggtgctaatgcacctgaaggcaacacacctagggaaactgggggttgaaggagttttgtttcttttttattatttttgagatggagtctcgctctgttgcccaggctggagtgcagtggcacgatcttggctcactgaaacctccaccttacaggttcaagcaattctcctgcctcagcctcccaagtagctgggactacaggcccctaccaccacatccagctgattttta

SEQ ID NO: 124059 - DNA, 601 bp, Human
ggtgggaagactcaatattgtaaagatgtcattctcccccaattaatctataatttccaagcaatcccaatcaaaatcccaacagggctttttttttttttaatggaacttgacaagcagattctcaagttcatctgaaagagaaaatgtgcaagaatagccaagtaatttttgaaaaggaaccataagagaaaatttgccctatcagttaccaaaaaaacaaaaacaaaaccccaaaactctcctaaactgtaataattcaaagcgtggtattgttagggcttatgaaggaactgactarggaaacgtaagggcagacccagtgtccatatggggatctaggatgtgatgagggccacgtgtggcaatcaccaaatattgatttggggggatctctctttcacactactcacagaaataaattccatatggatcaaaaagctgaacagaaaggctggttgtagtggctcacacctgtaatcccagtactttgggcagctgaggcaggtggatcacctgaggtcaggagtccgagatcagcctggccaacatagtgaaacaccgtctttacataaaaaatacaaaaaaattagccaggcat

SEQ ID NO: 124060 - DNA, 601 bp, Human
aaaaacaatgtaaaagaagacctgaataaataaaaacataccatgctcctgggtgggaagactcaatattgtaaagatgtcattctcccccaattaatctataatttccaagcaatcccaatcaaaatcccaacagggctttttttttttttaatggaacttgacaagcagattctcaagttcatctgaaagagaaaatgtgcaagaatagccaagtaatttttgaaaaggaaccataagagaaaatttgccctatcagttaccaaaaaaacaaaaacaaaaccccaaaactctcctaaaatgtaataattcaaagcgtggtattgttagggcttatgaaggaactgactaaggaaacgtaagggcagacccagtgtccatatggggatctaggatgtgatgagggccacgtgtggcaatcaccaaatattgatttggggggatctctctttcacactactcacagaaataaattccatatggatcaaaaagctgaacagaaaggctggttgtagtggctcacacctgtaatcccagtactttgggcagctgaggcaggtggatcacctgaggtcaggagtccgagatcagcctggccaac

SEQ ID NO: 124061 - DNA, 601 bp, Human
tcaataaggtgaccagaaacaaaacccaacatacaaaaatcaatagctttcctatatccgtttcaataatgaccaattagaaatacaaatttttaaaaaatctagatataaatctaataagaaatgtataaaatcgatatggagaaagtgataaaactttaaaaaacaatgtaaaagaagacctgaataaataaaaacataccatgctcctgggtgggaagactcaatattgtaaagatgtcattctcccccaattaatctataatttccaagcaatcccaatcaaaatcccaacagggctttttttttttttaatggaacttgacaagcagattctcaagttcatctgaaagagaaaatgtgcaagaatagccaagtaatttttgaaaaggaaccataagagaaaatttgccctatcagttaccaaaaaaacaaaaacaaaaccccaaaactctcctaaactgtaataattcaaagcgtggtattgttagggcttatgaaggaactgactaaggaaacgtaagggcagacccagtgtccatatggggatctaggatgtgatgagggccacgtgtggcaatcaccaaatattgatttgggg

SEQ ID NO: 124062 - DNA, 601 bp, Human
aaattgatgattttctaggaagatttaattacaaaaatctcctcaagaagaaacagaaaacctgaataggtctagtccttttgaaagtcaccatatccaatcagactagttaatcagctctaccaacacttcagaaatcatgcactatccacaatatattaactatttcagagcacaggaaaagaaagtttcctaactctttctacgagactggcctgactctgataaacaagttagagagaaacatcacaaaacacagaaactgtgattctatccattttataaatgaagttgtaaaacyataagaagacatcagcagttgaatgcagatgtatcaaaacaacaatactcatgagcaaatggaacttatttcaaaaatgaaagaaaaagtttccaatttaggatttttttttttttttttttgaggcaaagtcttacagggctgcagtgcagtggtgtcatctcgactcactgcagcctttgtctcccaggttcaagcgattctcctgcctcagcctcccgagtagctgggattacaggtgcctgccaccatgcccagctaatttttgtatttttagtacaaacagggtttcaacatttt

SEQ ID NO: 124063 - DNA, 601 bp, Human
acctattttattaaaaatagaaatttttcatcaatcaaggaaaaaagaggagatgtcacaaataagattagaaacaattataactataaacatggaggatgtacttttaaattacgagcatatgatattgaatttatgtcatatatttgaaaatcttgaaaaattgatgattttctaggaagatttaattacaaaaatctcctcaagaagaaacagaaaacctgaataggtctagtccttttgaaagtcaccatatccaatcagactagttaatcagctctaccaacacttcagaaatcakgcactatccacaatatattaactatttcagagcacaggaaaagaaagtttcctaactctttctacgagactggcctgactctgataaacaagttagagagaaacatcacaaaacacagaaactgtgattctatccattttataaatgaagttgtaaaactataagaagacatcagcagttgaatgcagatgtatcaaaacaacaatactcatgagcaaatggaacttatttcaaaaatgaaagaaaaagtttccaatttaggatttttttttttttttttttgaggcaaagtcttacagg

SEQ ID NO: 124064 - DNA, 601 bp, Human
agctgaaacgtacaattattcagaaatatatagcaagaaaagcaccatataattaaactagtaagaggtgatgaaaggagaatgtatgattatttatttatttattagaacacataaaatcctgaaaataaagaactaaatacacattccattcaaggaattagaacacagcaacaacaaatttaaaagctgaaggaattaataaataagtaaaagcagaaatttatgatgcagaaaataaaggaactcaattaaaaaaaacctagttctctgcaaaagcctgtttttttttatttttacrtacactattttttataattttaacttttactttagattcaggggttatatgtgcaaatttattacatgggtatattgtatgacactgaggtgaaaaaacctattttattaaaaatagaaatttttcatcaatcaaggaaaaaagaggagatgtcacaaataagattagaaacaattataactataaacatggaggatgtacttttaaattacgagcatatgatattgaatttatgtcatatatttgaaaatcttgaaaaattgatgattttctaggaagatttaattacaaaaatctcct

SEQ ID NO: 124065 - DNA, 601 bp, Human
gaataagtcttatgagatctgatgggtttatcaggggtttctgcttttgcttcctcctcatttttctcttgccaccgccatgttaagaagtgcctttcacctcccaccatgattctgacgcctccccagccatgtggaactataagttcaattaaatttctttttgttcccagtcttgggtatgtctttatcagcagtgtgaaaacggactaatgcaaacacccattggcatattcacaaaaactgaacgtgtattaggacacaaagatattctccagaaattccaaaaggcagaaaatayacagaacattctgtgaacccaatataagaaacttaaaaattaacaacaaaaggagcatcagaaaatctacgcagttgaaaaattttataaatctcttctaaataactcctgggttaaagagaaaaatctaagctgaaacgtacaattattcagaaatatatagcaagaaaagcaccatataattaaactagtaagaggtgatgaaaggagaatgtatgattatttatttatttattagaacacataaaatcctgaaaataaagaactaaatacacattccattcaaggaattagaacaca

SEQ ID NO: 124066 - DNA, 601 bp, Human
gcttgtaccatgtgcctggaaaagctactatattatattatatcctgtgctattctcgtgatagtgaataagtcttatgagatctgatgggtttatcaggggtttctgcttttgcttcctcctcatttttctcttgccaccgccatgttaagaagtgcctttcacctcccaccatgattctgacgcctccccagccatgtggaactataagttcaattaaatttctttttgttcccagtcttgggtatgtctttatcagcagtgtgaaaacggactaatgcaaacacccattggcatattyacaaaaactgaacgtgtattaggacacaaagatattctccagaaattccaaaaggcagaaaatatacagaacattctgtgaacccaatataagaaacttaaaaattaacaacaaaaggagcatcagaaaatctacgcagttgaaaaattttataaatctcttctaaataactcctgggttaaagagaaaaatctaagctgaaacgtacaattattcagaaatatatagcaagaaaagcaccatataattaaactagtaagaggtgatgaaaggagaatgtatgattatttatttatttat

SEQ ID NO: 124067 - DNA, 601 bp, Human
cccagaggcccaggaggaaaaagtggtttcatgggccacgcccagggtcctcgtactgtatgcagcctaaggacttggtgcactgtgtcctagccacgtcagtcgtggctgaaaggagccaacgtacagcttgggctgtggcttcagagggtgggagccccaagctttggcaacttccacttgtgtgttgagcctgcaggtgcacagaagtcaagaactgaggtttgggaacctccacctagatttcagaagctgtagggaaacacctggatgcccaggcagaactttgctgcaggggtgrggccctcatgaagaacctctgctagggcagtgcagaagggaattgtggggtcagaacccccacaaagagtccctactggggtactgcctagtggacctgtgagaagagggccaccatcctccagaccccagaatagtagatccactggcagcttgtaccatgtgcctggaaaagctactatattatattatatcctgtgctattctcgtgatagtgaataagtcttatgagatctgatgggtttatcaggggtttctgcttttgcttcctcctcatttttctcttgccaccgccatgtta

SEQ ID NO: 124068 - DNA, 601 bp, Human
tgatgatgcagtagaaaagaaaatcccattttctgaggagaaattcaagccggctgcagaaatctgcataagtaacaaggaatctaacattaatccccaagaccatgggaaaatgtctccaggccatgtcagagaccttcacagcagcccctcccatcagaggcccagaggcccaggaggaaaaagtggtttcatgggccacgcccagggtcctcgtactgtatgcagcctaaggacttggtgcactgtgtcctagccacgtcagtcgtggctgaaaggagccaacgtacagcttgggctstggcttcagagggtgggagccccaagctttggcaacttccacttgtgtgttgagcctgcaggtgcacagaagtcaagaactgaggtttgggaacctccacctagatttcagaagctgtagggaaacacctggatgcccaggcagaactttgctgcaggggtggggccctcatgaagaacctctgctagggcagtgcagaagggaattgtggggtcagaacccccacaaagagtccctactggggtactgcctagtggacctgtgagaagagggccaccatcctccagaccccagaatagt

SEQ ID NO: 124069 - DNA, 601 bp, Human
aagccattctgttttaaaagggaagcagagcataaaagttcagaaaatctgcagcctgatgatgcagtagaaaagaaaatcccattttctgaggagaaattcaagccggctgcagaaatctgcataagtaacaaggaatctaacattaatccccaagaccatgggaaaatgtctccaggccatgtcagagaccttcacagcagcccctcccatcagaggcccagaggcccaggaggaaaaagtggtttcatgggccacgcccagggtcctcgtactgtatgcagcctaaggacttggtgcrctgtgtcctagccacgtcagtcgtggctgaaaggagccaacgtacagcttgggctgtggcttcagagggtgggagccccaagctttggcaacttccacttgtgtgttgagcctgcaggtgcacagaagtcaagaactgaggtttgggaacctccacctagatttcagaagctgtagggaaacacctggatgcccaggcagaactttgctgcaggggtggggccctcatgaagaacctctgctagggcagtgcagaagggaattgtggggtcagaacccccacaaagagtccctactgggg

SEQ ID NO: 124070 - DNA, 601 bp, Human
gcatttaaaaggtgacttgggtgctgttaaagccattctgttttaaaagggaagcagagcataaaagttcagaaaatctgcagcctgatgatgcagtagaaaagaaaatcccattttctgaggagaaattcaagccggctgcagaaatctgcataagtaacaaggaatctaacattaatccccaagaccatgggaaaatgtctccaggccatgtcagagaccttcacagcagcccctcccatcagaggcccagaggcccaggaggaaaaagtggtttcatgggccacgcccagggtcctcrtactgtatgcagcctaaggacttggtgcactgtgtcctagccacgtcagtcgtggctgaaaggagccaacgtacagcttgggctgtggcttcagagggtgggagccccaagctttggcaacttccacttgtgtgttgagcctgcaggtgcacagaagtcaagaactgaggtttgggaacctccacctagatttcagaagctgtagggaaacacctggatgcccaggcagaactttgctgcaggggtggggccctcatgaagaacctctgctagggcagtgcagaagggaattgtggggtc

SEQ ID NO: 124071 - DNA, 601 bp, Human
tttagcaaagagactggcagaattttgcccctgccccagagatctgtggaactttgaacttgagaaagatgatttagagtatctggcagaagaaatttctaagtagcaaagcatttaaaaggtgacttgggtgctgttaaagccattctgttttaaaagggaagcagagcataaaagttcagaaaatctgcagcctgatgatgcagtagaaaagaaaatcccattttctgaggagaaattcaagccggctgcagaaatctgcataagtaacaaggaatctaacattaatccccaagaccaygggaaaatgtctccaggccatgtcagagaccttcacagcagcccctcccatcagaggcccagaggcccaggaggaaaaagtggtttcatgggccacgcccagggtcctcgtactgtatgcagcctaaggacttggtgcactgtgtcctagccacgtcagtcgtggctgaaaggagccaacgtacagcttgggctgtggcttcagagggtgggagccccaagctttggcaacttccacttgtgtgttgagcctgcaggtgcacagaagtcaagaactgaggtttgggaacctccacctaga

SEQ ID NO: 124072 - DNA, 601 bp, Human
tgctgatagtgatatgaacagtaaggtccatggtcaggtggtctcagatggagatgaggaactcattgggaactggagcaaaggtgactcttgttatgttttagcaaagagactggcagaattttgcccctgccccagagatctgtggaactttgaacttgagaaagatgatttagagtatctggcagaagaaatttctaagtagcaaagcatttaaaaggtgacttgggtgctgttaaagccattctgttttaaaagggaagcagagcataaaagttcagaaaatctgcagcctgatgaygcagtagaaaagaaaatcccattttctgaggagaaattcaagccggctgcagaaatctgcataagtaacaaggaatctaacattaatccccaagaccatgggaaaatgtctccaggccatgtcagagaccttcacagcagcccctcccatcagaggcccagaggcccaggaggaaaaagtggtttcatgggccacgcccagggtcctcgtactgtatgcagcctaaggacttggtgcactgtgtcctagccacgtcagtcgtggctgaaaggagccaacgtacagcttgggctgtggctt

SEQ ID NO: 124073 - DNA, 601 bp, Human
gaatcatgggtgccagtctttcctgtgctatttttgtgatagagagtaagtctcatgagatctgacaggtttatcacgggtttctgcttttgcttcctcctcatttttctcttgccaccaccatataagaagtggctttcgcctcccaccatgattctgaggccttcccagccacgtggaactgtaagtccaattaaatctctttttcttcccagtctcgggaatgtcttcatcagcagcatgaaaatggactaatacagtaaattggtgcccatagagtgggcattgctgaaaagatacsccaaaatgtggaagcaactttggaactgggtaacaggcagaggctggaacagtttggagggctcagaagaagacaggaaaatgtgggaaagtttggaacctcctagagatttgttgaatggctttgacaaaaatgctgatagtgatatgaacagtaaggtccatggtcaggtggtctcagatggagatgaggaactcattgggaactggagcaaaggtgactcttgttatgttttagcaaagagactggcagaattttgcccctgccccagagatctgtggaactttgaacttgagaaag

SEQ ID NO: 124074 - DNA, 601 bp, Human
ctcagaaacagatcaggtagacaaaaagtaagaaagactccagaacttctgaatgaacttgatagaacacacaggtgatagaggctgatgcctaaaggtatcaggcaggcagggtaaatggctgaagcagccaggtctgtgaaggccacccggggacgggtagactgccctttgagttaggagcaatcgtagccgactgttgccattaaggaatgagggcccagcacagccagagcttctaagctttcatagaaagccccaaatccatatttttacataaaatactgtgatttgtaaatgyttactcaagttttcaaaaatacacttgtgtgagtcaaacaaaacatgtctgcaggccaaaggcagcttatgggctaccagttgcaatccctaatctgatacagattttttttactcaatgagcatagaataaaaatactcttcaaacactgatatggtttggctgtgtccccacccaaatctcaactagaattgaatctcccagaattcccacatgttgtgggagggactcagggggaggtaattgaatcatgggtgccagtctttcctgtgctatttttgtgatagagagtaagtctca

SEQ ID NO: 124075 - DNA, 601 bp, Human
gccaaagtacaattaaagggcaaaaatgagatagagaggattttatattgatgaagattcattataccttgtaatgtaccttgtaaatagctataaaatgtgtacagcgaaaacggaaagaaactgacacatccataatcatcatggaaaccagcattccttctcagaaacagatcaggtagacaaaaagtaagaaagactccagaacttctgaatgaacttgatagaacacacaggtgatagaggctgatgcctaaaggtatcaggcaggcagggtaaatggctgaagcagccaggtctstgaaggccacccggggacgggtagactgccctttgagttaggagcaatcgtagccgactgttgccattaaggaatgagggcccagcacagccagagcttctaagctttcatagaaagccccaaatccatatttttacataaaatactgtgatttgtaaatgtttactcaagttttcaaaaatacacttgtgtgagtcaaacaaaacatgtctgcaggccaaaggcagcttatgggctaccagttgcaatccctaatctgatacagattttttttactcaatgagcatagaataaaaatac

SEQ ID NO: 124076 - DNA, 601 bp, Human
gtacaggtgttatatcagccaaagtacaattaaagggcaaaaatgagatagagaggattttatattgatgaagattcattataccttgtaatgtaccttgtaaatagctataaaatgtgtacagcgaaaacggaaagaaactgacacatccataatcatcatggaaaccagcattccttctcagaaacagatcaggtagacaaaaagtaagaaagactccagaacttctgaatgaacttgatagaacacacaggtgatagaggctgatgcctaaaggtatcaggcaggcagggtaaatggmtgaagcagccaggtctgtgaaggccacccggggacgggtagactgccctttgagttaggagcaatcgtagccgactgttgccattaaggaatgagggcccagcacagccagagcttctaagctttcatagaaagccccaaatccatatttttacataaaatactgtgatttgtaaatgtttactcaagttttcaaaaatacacttgtgtgagtcaaacaaaacatgtctgcaggccaaaggcagcttatgggctaccagttgcaatccctaatctgatacagattttttttactcaatga

SEQ ID NO: 124077 - DNA, 601 bp, Human
ctgcttataaaaccaacattagaaataaagaatatatgagaagaaggatgataaaataaattcgcaagtgtgctacttttatcaatcaaagtacaggtgttatatcagccaaagtacaattaaagggcaaaaatgagatagagaggattttatattgatgaagattcattataccttgtaatgtaccttgtaaatagctataaaatgtgtacagcgaaaacggaaagaaactgacacatccataatcatcatggaaaccagcattccttctcagaaacagatcaggtagacaaaaagtaaraaagactccagaacttctgaatgaacttgatagaacacacaggtgatagaggctgatgcctaaaggtatcaggcaggcagggtaaatggctgaagcagccaggtctgtgaaggccacccggggacgggtagactgccctttgagttaggagcaatcgtagccgactgttgccattaaggaatgagggcccagcacagccagagcttctaagctttcatagaaagccccaaatccatatttttacataaaatactgtgatttgtaaatgtttactcaagttttcaaaaatacacttgtgtg

SEQ ID NO: 124078 - DNA, 601 bp, Human
taaatccaaagatatctgaaatcagcacatgtatgaatataacaaagtccttctttaaagagactcttcaattgtgttaaaatataaatccagatacatgctgcttataaaaccaacattagaaataaagaatatatgagaagaaggatgataaaataaattcgcaagtgtgctacttttatcaatcaaagtacaggtgttatatcagccaaagtacaattaaagggcaaaaatgagatagagaggattttatattgatgaagattcattataccttgtaatgtaccttgtaaatagctayaaaatgtgtacagcgaaaacggaaagaaactgacacatccataatcatcatggaaaccagcattccttctcagaaacagatcaggtagacaaaaagtaagaaagactccagaacttctgaatgaacttgatagaacacacaggtgatagaggctgatgcctaaaggtatcaggcaggcagggtaaatggctgaagcagccaggtctgtgaaggccacccggggacgggtagactgccctttgagttaggagcaatcgtagccgactgttgccattaaggaatgagggcccagcacagcca

SEQ ID NO: 124079 - DNA, 601 bp, Human
aataatttaatagatgagaaaatctagtaaaataaaaaaatcacatacaaagatgtaagaaaaaagaaacaatggtgaccaaagaaattaattagactttatacttaagctcacacaattgttgatgcatgatgtaaacttgttaaaaataatatggagttaaatttttgaattatcccaattcaaggaggtgacgacagacagaagatggcagaggagtggagctatggtaagtttcttatgttgctcaggtgaaagagttaagtactgattagcgctaaacactgtagagaaacataartcccaataactgtgtttaaagagtaacagaaaaacagatttagaatgtaaaaatttcaacccattagaatgaaagaaaagagaagaaactacatctaaccagcaaaaggaaggtaaagacagattggtagacagatggacggacagatggatggatggatggatggatgaatagataaaaacaaatacaatagaaataaatccaaagatatctgaaatcagcacatgtatgaatataacaaagtccttctttaaagagactcttcaattgtgttaaaatataaatccagatacatgctgc

SEQ ID NO: 124080 - DNA, 601 bp, Human
aacatggcccacgtttgacagcagaccggggggctacagttagcaacaatatgttaaatatttcagtgtagaagagaggacttgaaatgttaccaacacatagacatgataaatacccaagatgacggataccccaaatgccttgacttgatcattctgcattccatgcatgtagaaaacattcacaggtacctcttaaatatgtgaaatgtcatttatcaataaaagaaaaaagaggcaatttctactgtattgtactcttcaaattaataaaaatttttataaaagaaaaataaatttwaaaaaatggcccaaatatatgttatctacaggagactcaattcaaatataacaatataggcaagttgaaagtaaaaggatggaaaaacgtatactgtacaaccattaatcaaaggaaagtagaagtagctatattaatatcagataaagtagacttcagagcaaaaaaattcacctgagacaaagagacgccccttgtcagcaacactgaataccaaagaccatggggtaataccttttaaattatgagtgaaaattatcttgaacttaaagtcaaaacctagccaaatttgtagggaga

SEQ ID NO: 124081 - DNA, 601 bp, Human
agacttaacccctaatgtatcaataattacattaaatattaaccatctaaatatagtaactaaaagagattggcaagtgaatctaaaaacatggcccacgtttgacagcagaccggggggctacagttagcaacaatatgttaaatatttcagtgtagaagagaggacttgaaatgttaccaacacatagacatgataaatacccaagatgacggataccccaaatgccttgacttgatcattctgcattccatgcatgtagaaaacattcacaggtacctcttaaatatgtgaaatgtcrtttatcaataaaagaaaaaagaggcaatttctactgtattgtactcttcaaattaataaaaatttttataaaagaaaaataaattttaaaaaatggcccaaatatatgttatctacaggagactcaattcaaatataacaatataggcaagttgaaagtaaaaggatggaaaaacgtatactgtacaaccattaatcaaaggaaagtagaagtagctatattaatatcagataaagtagacttcagagcaaaaaaattcacctgagacaaagagacgccccttgtcagcaacactgaata

SEQ ID NO: 124082 - DNA, 601 bp, Human
aaaatggcagacttaacccctaatgtatcaataattacattaaatattaaccatctaaatatagtaactaaaagagattggcaagtgaatctaaaaacatggcccacgtttgacagcagaccggggggctacagttagcaacaatatgttaaatatttcagtgtagaagagaggacttgaaatgttaccaacacatagacatgataaatacccaagatgacggataccccaaatgccttgacttgatcattctgcattccatgcatgtagaaaacattcacaggtacctcttaaatatgtraaatgtcatttatcaataaaagaaaaaagaggcaatttctactgtattgtactcttcaaattaataaaaatttttataaaagaaaaataaattttaaaaaatggcccaaatatatgttatctacaggagactcaattcaaatataacaatataggcaagttgaaagtaaaaggatggaaaaacgtatactgtacaaccattaatcaaaggaaagtagaagtagctatattaatatcagataaagtagacttcagagcaaaaaaattcacctgagacaaagagacgccccttgtcagcaac

SEQ ID NO: 124083 - DNA, 601 bp, Human
aatagagaagttaaaatggcagacttaacccctaatgtatcaataattacattaaatattaaccatctaaatatagtaactaaaagagattggcaagtgaatctaaaaacatggcccacgtttgacagcagaccggggggctacagttagcaacaatatgttaaatatttcagtgtagaagagaggacttgaaatgttaccaacacatagacatgataaatacccaagatgacggataccccaaatgccttgacttgatcattctgcattccatgcatgtagaaaacattcacaggtacckcttaaatatgtgaaatgtcatttatcaataaaagaaaaaagaggcaatttctactgtattgtactcttcaaattaataaaaatttttataaaagaaaaataaattttaaaaaatggcccaaatatatgttatctacaggagactcaattcaaatataacaatataggcaagttgaaagtaaaaggatggaaaaacgtatactgtacaaccattaatcaaaggaaagtagaagtagctatattaatatcagataaagtagacttcagagcaaaaaaattcacctgagacaaagagacgccc

SEQ ID NO: 124084 - DNA, 601 bp, Human
agtgagattttaaaaagtgttcaagtaacccacaggaaggcaggaaaaaaaaaacagagaaactaaatacagaggaaaataatagagaagttaaaatggcagacttaacccctaatgtatcaataattacattaaatattaaccatctaaatatagtaactaaaagagattggcaagtgaatctaaaaacatggcccacgtttgacagcagaccggggggctacagttagcaacaatatgttaaatatttcagtgtagaagagaggacttgaaatgttaccaacacatagacatgataaayacccaagatgacggataccccaaatgccttgacttgatcattctgcattccatgcatgtagaaaacattcacaggtacctcttaaatatgtgaaatgtcatttatcaataaaagaaaaaagaggcaatttctactgtattgtactcttcaaattaataaaaatttttataaaagaaaaataaattttaaaaaatggcccaaatatatgttatctacaggagactcaattcaaatataacaatataggcaagttgaaagtaaaaggatggaaaaacgtatactgtacaaccattaatcaaa

SEQ ID NO: 124085 - DNA, 601 bp, Human
aataatgggatataaaggaaggtaaggtttctgtacctcacgctggtaaagtgacaacacccataaaattgattgtgagaagttacatgtgcataatgtaataccaagggtagccactaaaaaagctatacaagaagacatactcaaaaacattataaaccaagtgagattttaaaaagtgttcaagtaacccacaggaaggcaggaaaaaaaaaacagagaaactaaatacagaggaaaataatagagaagttaaaatggcagacttaacccctaatgtatcaataattacattaaataytaaccatctaaatatagtaactaaaagagattggcaagtgaatctaaaaacatggcccacgtttgacagcagaccggggggctacagttagcaacaatatgttaaatatttcagtgtagaagagaggacttgaaatgttaccaacacatagacatgataaatacccaagatgacggataccccaaatgccttgacttgatcattctgcattccatgcatgtagaaaacattcacaggtacctcttaaatatgtgaaatgtcatttatcaataaaagaaaaaagaggcaatttctactgta

SEQ ID NO: 124086 - DNA, 601 bp, Human
aaattaaaaagacaaaaaggtgaacagagcaagagagcaaagaaaggatgaataagaagaggggctaggaaatgcctgctgccctctctcgctccctcctgtgctgttcccattatcatacctttttaggccaggaggaagaggcgaggccaaaatatgcttggaaggaatcagaattcagtcaagaagtatacagttatacactgcgaaggcttccccttctgcttctgtttctggccactgggcttggtggcagctgttctcatctggtcaccgcgatgtcctagcatcagaaggctaygattgcaaaggtggaatccaggcttcagggcaacaggcctgagctcaagcctctgcgctgcctcttggcagctgtgtgaacccagatgtggcaattcatctctctgttagtctcccctggtgggaaacggccatgatcatgtccagcgcacagaggcacactaagaactggatgcaaagatgactacaagtgcttggcaaccaacagcaatcggcaagaggtgtcaccatctgcaccacagtgaaaagactcaagagacccaacccaggaggaagactgagcacgcagcctacctctccc

SEQ ID NO: 124087 - DNA, 601 bp, Human
aaaaaggcagaaaattagccgggcgcggtggcgggcgcctgtagtcccagctactcgggaggctgaggcaggagaatggcgtgaacccgggaggcggagcttgcagtgagccgagatcgtgccactgcactccagcctgggcgacagagtaagactccgtctcaaaaaaaaaaaaaaaatgcagggaaagtgtaccataatgcagtgtccctcatgacacccctcctgccttaggaaagtgtctgaatctggttaagtatcagcacacgtgaggaacttgctaaagggtagaagcctggtmaagttaaaggggtgagggctccactcacctcccctgcatattgcaagcctccctgagagagcaggttccactccggccaagccagcacacctggctccccagcaagcttttctcaaaggatgccgcatggggcacgaagccaggaggacctggtgcagtggatgggatcacatcctcagcctgcattctgggaggggccttcacacttttttgtttgtttgtttttttgagtttgagtcttgctctgttgcccaggctggagtgcagtgccacaatcattgctcactgcagcttcaaaca

SEQ ID NO: 124088 - DNA, 601 bp, Human
ggactggcgatgcttctgaaaagcagggaggctgagcgcgggggctcatgcctgtaatcccagcactttgggcggccgaggcgggcggatcacgaggtcaggagatcgagaccatcctggccaacatggtgaaaccctgtctctattaaaaatacaaggccaggcgcagtggctcacgcctgtaatcccagcactttgggcggccgaggcgggcggatcacgaggtcaggagatcgagaccatcctggctaacacagtgaaaccccgtctctactaaaaaggcagaaaattagccgggcgyggtggcgggcgcctgtagtcccagctactcgggaggctgaggcaggagaatggcgtgaacccgggaggcggagcttgcagtgagccgagatcgtgccactgcactccagcctgggcgacagagtaagactccgtctcaaaaaaaaaaaaaaaatgcagggaaagtgtaccataatgcagtgtccctcatgacacccctcctgccttaggaaagtgtctgaatctggttaagtatcagcacacgtgaggaacttgctaaagggtagaagcctggtaaagttaaaggggtgagggctccact

SEQ ID NO: 124089 - DNA, 601 bp, Human
tggactggcgatgcttctgaaaagcagggaggctgagcgcgggggctcatgcctgtaatcccagcactttgggcggccgaggcgggcggatcacgaggtcaggagatcgagaccatcctggccaacatggtgaaaccctgtctctattaaaaatacaaggccaggcgcagtggctcacgcctgtaatcccagcactttgggcggccgaggcgggcggatcacgaggtcaggagatcgagaccatcctggctaacacagtgaaaccccgtctctactaaaaaggcagaaaattagccgggcrcggtggcgggcgcctgtagtcccagctactcgggaggctgaggcaggagaatggcgtgaacccgggaggcggagcttgcagtgagccgagatcgtgccactgcactccagcctgggcgacagagtaagactccgtctcaaaaaaaaaaaaaaaatgcagggaaagtgtaccataatgcagtgtccctcatgacacccctcctgccttaggaaagtgtctgaatctggttaagtatcagcacacgtgaggaacttgctaaagggtagaagcctggtaaagttaaaggggtgagggctccac

SEQ ID NO: 124090 - DNA, 601 bp, Human
ccggagcaggggagcttttctgtttgtcaggtgggagggctccctgcggtctccagctgcccttgctgcaggccccaaatgcagcctactccagaccagcctcagggatcctgccctgtggactggcgatgcttctgaaaagcagggaggctgagcgcgggggctcatgcctgtaatcccagcactttgggcggccgaggcgggcggatcacgaggtcaggagatcgagaccatcctggccaacatggtgaaaccctgtctctattaaaaatacaaggccaggcgcagtggctcacgcctrtaatcccagcactttgggcggccgaggcgggcggatcacgaggtcaggagatcgagaccatcctggctaacacagtgaaaccccgtctctactaaaaaggcagaaaattagccgggcgcggtggcgggcgcctgtagtcccagctactcgggaggctgaggcaggagaatggcgtgaacccgggaggcggagcttgcagtgagccgagatcgtgccactgcactccagcctgggcgacagagtaagactccgtctcaaaaaaaaaaaaaaaatgcagggaaagtgtaccataatgcagtg

SEQ ID NO: 124091 - DNA, 601 bp, Human
caaaaacaccaacaggaatctggtcgctgccgtttacttttccttcccagaaacagggcaaacatggtctgaaaagatgcacctatatccgggggccggagcaggggagcttttctgtttgtcaggtgggagggctccctgcggtctccagctgcccttgctgcaggccccaaatgcagcctactccagaccagcctcagggatcctgccctgtggactggcgatgcttctgaaaagcagggaggctgagcgcgggggctcatgcctgtaatcccagcactttgggcggccgaggcgggcrgatcacgaggtcaggagatcgagaccatcctggccaacatggtgaaaccctgtctctattaaaaatacaaggccaggcgcagtggctcacgcctgtaatcccagcactttgggcggccgaggcgggcggatcacgaggtcaggagatcgagaccatcctggctaacacagtgaaaccccgtctctactaaaaaggcagaaaattagccgggcgcggtggcgggcgcctgtagtcccagctactcgggaggctgaggcaggagaatggcgtgaacccgggaggcggagcttgcagtgagcc

SEQ ID NO: 124092 - DNA, 601 bp, Human
tgtttatgaaaggaaaaacatgattcagttccccaatcaaaatatggagcaaaaacaccaacaggaatctggtcgctgccgtttacttttccttcccagaaacagggcaaacatggtctgaaaagatgcacctatatccgggggccggagcaggggagcttttctgtttgtcaggtgggagggctccctgcggtctccagctgcccttgctgcaggccccaaatgcagcctactccagaccagcctcagggatcctgccctgtggactggcgatgcttctgaaaagcagggaggctgagckcgggggctcatgcctgtaatcccagcactttgggcggccgaggcgggcggatcacgaggtcaggagatcgagaccatcctggccaacatggtgaaaccctgtctctattaaaaatacaaggccaggcgcagtggctcacgcctgtaatcccagcactttgggcggccgaggcgggcggatcacgaggtcaggagatcgagaccatcctggctaacacagtgaaaccccgtctctactaaaaaggcagaaaattagccgggcgcggtggcgggcgcctgtagtcccagctactcgggaggc

SEQ ID NO: 124093 - DNA, 601 bp, Human
taaactgcttaatggaaacactaacgagactgaattctgtgactcagaattaacataattaaccaatttatgggcatggattaatttagctgttatgtacttaacattttcgtgtttatgaaaggaaaaacatgattcagttccccaatcaaaatatggagcaaaaacaccaacaggaatctggtcgctgccgtttacttttccttcccagaaacagggcaaacatggtctgaaaagatgcacctatatccgggggccggagcaggggagcttttctgtttgtcaggtgggagggctcccygcggtctccagctgcccttgctgcaggccccaaatgcagcctactccagaccagcctcagggatcctgccctgtggactggcgatgcttctgaaaagcagggaggctgagcgcgggggctcatgcctgtaatcccagcactttgggcggccgaggcgggcggatcacgaggtcaggagatcgagaccatcctggccaacatggtgaaaccctgtctctattaaaaatacaaggccaggcgcagtggctcacgcctgtaatcccagcactttgggcggccgaggcgggcggatcacgaggt

SEQ ID NO: 124094 - DNA, 601 bp, Human
cttgggatgcaggacaggacagcaggcttctgagccagatggagcacccgtacatctgcaccacacgcaagtacggcaaggaaccctagaggaggcgcacgtgccaagaaagcaaacccatatcctgaacggacctctgaaggggacacggacggcgaaaaggagacgttcatgccgccatgaacaaaggccacccaggagcttgtttctaagactcagcgtgctctcttcctgtctctctgcttctttcttatgtacacccaggaagaaagcccctcagcagccctctcaggaacccagrgctatgcagcccacagcattcgagagctagcctcacccattctctgcgggtgtctgcagcagggcggcctgaggagggcatggccaccagggagacacagggcagaaggggctatgccagttcttgcccatctcctccttcctatggctcctgcttagcctggcgatgctcagatctagcaggcaggggccttggatgtgttgggggaggtgagggacgaggaagtggggaacacccgctccctgacagcagcagctcctaacattcaccaaatccccccaagccccccagtgcatttaa

SEQ ID NO: 124095 - DNA, 601 bp, Human
agtgagagccggcagcttgggatgcaggacaggacagcaggcttctgagccagatggagcacccgtacatctgcaccacacgcaagtacggcaaggaaccctagaggaggcgcacgtgccaagaaagcaaacccatatcctgaacggacctctgaaggggacacggacggcgaaaaggagacgttcatgccgccatgaacaaaggccacccaggagcttgtttctaagactcagcgtgctctcttcctgtctctctgcttctttcttatgtacacccaggaagaaagcccctcagcagccmtctcaggaacccagggctatgcagcccacagcattcgagagctagcctcacccattctctgcgggtgtctgcagcagggcggcctgaggagggcatggccaccagggagacacagggcagaaggggctatgccagttcttgcccatctcctccttcctatggctcctgcttagcctggcgatgctcagatctagcaggcaggggccttggatgtgttgggggaggtgagggacgaggaagtggggaacacccgctccctgacagcagcagctcctaacattcaccaaatccccccaagcc

SEQ ID NO: 124096 - DNA, 601 bp, Human
cccgtgtcttcccctctctcctgcctcctgacagaacccgctgcttctctgtgtggccccacatacggtactgggacgcatcctcttgggaactggaacaaaccaccttttcaatgcatggcagtggtctcctcatctgctggccttgccaaacctaaataataccgaaaatgattgtacatatttaaacaggtctctctttgataatcgggtcctgttgattcttcaaagaacaatacaaaacctggaaaagccttagccatggtctagaggtttgacatcgaggctgaccctttcacgrtctccccgctagggaatgagggctggagaacagaagtgcatggcccaggcacacacaggaagccagtgagagccggcagcttgggatgcaggacaggacagcaggcttctgagccagatggagcacccgtacatctgcaccacacgcaagtacggcaaggaaccctagaggaggcgcacgtgccaagaaagcaaacccatatcctgaacggacctctgaaggggacacggacggcgaaaaggagacgttcatgccgccatgaacaaaggccacccaggagcttgtttctaagactcagcg

SEQ ID NO: 124097 - DNA, 601 bp, Human
tcgggatagtaaactacccatcaggagtgtgcttttcacatgcaagccaaccaatccagagtctacaccccagccacctccatcatgggctctcacacaccaggtcactactcccttaacctaaccacccaaggccaggtgtcaggcagctagggacagcccctattcccctgagtctgctgaaattattcagcctagctgattctgaacttgccttctctgcctcacccactccttcccacagaaaccaccacaaggcctctggcccgtgtcttcccctctctcctgcctcctgacagamcccgctgcttctctgtgtggccccacatacggtactgggacgcatcctcttgggaactggaacaaaccaccttttcaatgcatggcagtggtctcctcatctgctggccttgccaaacctaaataataccgaaaatgattgtacatatttaaacaggtctctctttgataatcgggtcctgttgattcttcaaagaacaatacaaaacctggaaaagccttagccatggtctagaggtttgacatcgaggctgaccctttcacggtctccccgctagggaatgagggctggagaacagaa

SEQ ID NO: 124098 - DNA, 601 bp, Human
gacatgaagtgtgtggggacgcgcgggggatcaccaagccaaatctcttcctgcttcctgttctgttcctgatgccctgatggagccactccacctccttctacagtggaaacacagctgtagccagcgacgctccttatgggcatgtcctgcatgcagccctggatccaggagatgaggtctgtcccaggtcaggtcccgtgataactgagactggttccccagtctgtggtccatgtgtctggcgtcccatctccacagctgtgtcacggacacaggtgcgcagctctctcagccagcracctccaagagaagggccgtgaccagcgtgggaggctggcagtgtggtgtggcaagggtatggcccctggcaagatacagagcagctcatggtagggggaagacagctggggtcagagagtcctggagcggaatgtcggctctgcatgaccttgggccatagtctcagcctctctaaatcatgttttctacaatatttatctgccaaggcagttgagaagattaatgaaaagctaagttgaggccctggccctggtactgcgtctgggataactttggtatcatccatcttctccccttc

SEQ ID NO: 124099 - DNA, 601 bp, Human
ccgggccaagtaaggtttcaacagttacttagaaatgctacaatcctaaaaggtttctgtcaaccctcattatcacctaagacaatagacacggctttcaaattgctaactatgcccccacaggacagccttgttctaggagctccagggagctgtggtctgccgagttgtcaaggcagacctacgttcgccatcgtgacatgaagtgtgtggggacgcgcgggggatcaccaagccaaatctcttcctgcttcctgttctgttcctgatgccctgatggagccactccacctccttctasagtggaaacacagctgtagccagcgacgctccttatgggcatgtcctgcatgcagccctggatccaggagatgaggtctgtcccaggtcaggtcccgtgataactgagactggttccccagtctgtggtccatgtgtctggcgtcccatctccacagctgtgtcacggacacaggtgcgcagctctctcagccagcgacctccaagagaagggccgtgaccagcgtgggaggctggcagtgtggtgtggcaagggtatggcccctggcaagatacagagcagctcatggtagggggaaga

SEQ ID NO: 124100 - DNA, 601 bp, Human
attagccctgggtttattttagtaagtccacagagaattatgttttgtttttgttttgtttttttcagtaaaactatagcacattctgttctatgagcagccattccgggccaagtaaggtttcaacagttacttagaaatgctacaatcctaaaaggtttctgtcaaccctcattatcacctaagacaatagacacggctttcaaattgctaactatgcccccacaggacagccttgttctaggagctccagggagctgtggtctgccgagttgtcaaggcagacctacgttcgccatcrtgacatgaagtgtgtggggacgcgcgggggatcaccaagccaaatctcttcctgcttcctgttctgttcctgatgccctgatggagccactccacctccttctacagtggaaacacagctgtagccagcgacgctccttatgggcatgtcctgcatgcagccctggatccaggagatgaggtctgtcccaggtcaggtcccgtgataactgagactggttccccagtctgtggtccatgtgtctggcgtcccatctccacagctgtgtcacggacacaggtgcgcagctctctcagccag

SEQ ID NO: 124101 - DNA, 601 bp, Human
tgggcccaagtgtccagctctctcagccaggaacctccaagagaagggtcagggccaggcccagtgcaagaggctggcaagatcgtggccgccggcaagatacagagcagctcacggtaggggaagagagtggggtcagagagtcctggggtgtaatctcgcttccacatgaccttgggccatggtctcaacctctctaaatcatgtttcttacaatttttatctaccggggcagttaagaagattaacgaaaagctaagttgaggccctggccccggaactgctggataaatggcagcarggttctctttgcccttactttcagccatggatctccagggcaggagacctcactggccacccgggggtcaagaccaattctgatgctctaagtggtgaagctgatcctgttctaggattctctctacaagttataggtgttgaaatgcctatttttgaacaagaagaacgggatgccagaagacatccaaaaatacataaaaacatatgaccagaatgatttcccaacacctctcaccatgcttttcatcttggaaaaagactgactgatgtgtgggaaagcaagcatcacgcgcttaga

SEQ ID NO: 124102 - DNA, 601 bp, Human
ttgctggcatctattgtaagttcctttcccccttttataggcagggcagagccacctctaggcccagctcacatgggctgtggcatcagctcactgtattttgtcctttctgggtggagaggaggggtcgggtggacatgaagtggggtctttcccaaatctgtggtccatgtgcctgccatcccatctccatggctgtgtcagggacactgggcccaagtgtccagctctctcagccaggaacctccaagagaagggtcagggccaggcccagtgcaagaggctggcaagatcgtggccsccggcaagatacagagcagctcacggtaggggaagagagtggggtcagagagtcctggggtgtaatctcgcttccacatgaccttgggccatggtctcaacctctctaaatcatgtttcttacaatttttatctaccggggcagttaagaagattaacgaaaagctaagttgaggccctggccccggaactgctggataaatggcagcagggttctctttgcccttactttcagccatggatctccagggcaggagacctcactggccacccgggggtcaagaccaattctgatgctcta

SEQ ID NO: 124103 - DNA, 601 bp, Human
tggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgaccagttaatgggtgcagcacaccagcatggcacatgtacacatatgtaactaacctgcacattgtgcacatgtaccctaaaacttaaagtataataataattaaaaaaaaragagagaaaaaaaaatggaggtagtaacaataactgattggtttttctttttgttttctaaaaacacatgacttgataagcacaaaagattgtatgtcacatacacgttagttataaagcctaataaaaaaacggatacccatgaaccctgcagcccaatgcaagaacaagaacgtgacccactgggggcctctacttctgtgtcctccctgtcacccccagcttctcagaggaaaatgatcagaatttttggattattcatgccattgcctttatttatttatttatttatttattttg

SEQ ID NO: 124104 - DNA, 601 bp, Human
cctggaattgtattcaaaatcaatgtcagagaaatttacaccaaggcaatagcaaggttgaggcataggagacatcagaagttcaacaacagtgctagagacattcggcagtgtcagccacgtgggcatgggcagcgatggaggatggggctgaagtcacgggaagagccatctcttcatagcttgaaagcctactatgagcagtaggaataaatgtaacttcagtgttatctatcttctcttctcactccacctgtttcccttcctctctttcctacctcagcgagctggctgcaggacrgcccagggtagccaccagtgtccaggcactgagatggcacaaggcaagtggacttagatgcctcgacgcctgctcccaaggggaggtccacagagtggagctgtcactcacagtgagcctcggagccagcaggagggacgtggggcatgccacaggtgaagaccttgccttcaccatcaactgtgaccaggtagtgactctgaagttctcccgtctcgctgagcctcagtcttctgcacactgcaatgatgacacttatcatatgtagagggatgtcaaacaaatgaaatcggatgatcc

SEQ ID NO: 124105 - DNA, 601 bp, Human
gagggaggaccactctagggctcggcatgttgaccttaacacttaggtgggacaccaagcttaactggaaacttctgctccaaaagcctggaattgtattcaaaatcaatgtcagagaaatttacaccaaggcaatagcaaggttgaggcataggagacatcagaagttcaacaacagtgctagagacattcggcagtgtcagccacgtgggcatgggcagcgatggaggatggggctgaagtcacgggaagagccatctcttcatagcttgaaagcctactatgagcagtaggaataaaygtaacttcagtgttatctatcttctcttctcactccacctgtttcccttcctctctttcctacctcagcgagctggctgcaggacggcccagggtagccaccagtgtccaggcactgagatggcacaaggcaagtggacttagatgcctcgacgcctgctcccaaggggaggtccacagagtggagctgtcactcacagtgagcctcggagccagcaggagggacgtggggcatgccacaggtgaagaccttgccttcaccatcaactgtgaccaggtagtgactctgaagttctcccgt

SEQ ID NO: 124106 - DNA, 601 bp, Human
agatccctaacacatacatttcaaatgttcttgtcctatcatctttcacccagtagcacatggattataaacatataaccaaatgtacttcttcacttgccagggtaagaagcttccaacctaaaaggaatttgaagatgatttcgctgcagtaaattcttccattccatccattcattctacccagttttgaaggttcaggtttccctaaggttttccccttaatatatgccctgaaatttcccaggcatgaagcaagacagagaatacaagagtcaccaaaggcagttcttgggaggcyaggtaggatagttggtggtgggagagggaggaccactctagggctcggcatgttgaccttaacacttaggtgggacaccaagcttaactggaaacttctgctccaaaagcctggaattgtattcaaaatcaatgtcagagaaatttacaccaaggcaatagcaaggttgaggcataggagacatcagaagttcaacaacagtgctagagacattcggcagtgtcagccacgtgggcatgggcagcgatggaggatggggctgaagtcacgggaagagccatctcttcatagcttgaaagc

SEQ ID NO: 124107 - DNA, 601 bp, Human
cgtaatggaaaagaggacttcttctgattgtaagaatagtatatgctcttgcccaaactttgggaaaaagagaaataaccaataatattttggctattttcttttctttttttgctttacagatggggtctcactctgtcacccaggctggaatgcagtgacacagatcatagctcactgcagcctcaaacacctgggctcaagcaatcatcccacctcagcctcccgagtagctaggatcacaggtgcacaccactgcacctggctggttattttcttctagtctttttctttgcctctrgcatatactttctttctaaatcctttttttcccccactgagctttatacagggcatttccctgtgccattaaagactcttccaaggcttagtggctgcagctccctgccatcatgcacacacccctggcccaggcagcttccttctggggttcaccttctgaagtaggggttccccaccttacccatactagtctgcgcctgtttgttctacattccagaatctacatcaacacgtagtgcatactcaaaagcagcaactttaaatatgactgactttaaaaaacaaaatagtgaagttt

SEQ ID NO: 124108 - DNA, 601 bp, Human
ggggctcagagaatcttgccacccgaccctgggtcaactctcttcatggccacttgacacccacagctccccactcagaggcccccgggagcccctcacccacggggcccagctctgtgtgtgcgatgaccatgccttcatcaagacgaattctaaatcttagagctatttaagacgtaatggaaaagaggacttcttctgattgtaagaatagtatatgctcttgcccaaactttgggaaaaagagaaataaccaataatattttggctattttcttttctttttttgctttacagatgrggtctcactctgtcacccaggctggaatgcagtgacacagatcatagctcactgcagcctcaaacacctgggctcaagcaatcatcccacctcagcctcccgagtagctaggatcacaggtgcacaccactgcacctggctggttattttcttctagtctttttctttgcctctagcatatactttctttctaaatcctttttttcccccactgagctttatacagggcatttccctgtgccattaaagactcttccaaggcttagtggctgcagctccctgccatcatgcacacacccc

SEQ ID NO: 124109 - DNA, 601 bp, Human
tgacggccatggacacactcttcctggattctagtagatacagaaagtcgacttctctggggctcagagaatcttgccacccgaccctgggtcaactctcttcatggccacttgacacccacagctccccactcagaggcccccgggagcccctcacccacggggcccagctctgtgtgtgcgatgaccatgccttcatcaagacgaattctaaatcttagagctatttaagacgtaatggaaaagaggacttcttctgattgtaagaatagtatatgctcttgcccaaactttgggaaawagagaaataaccaataatattttggctattttcttttctttttttgctttacagatggggtctcactctgtcacccaggctggaatgcagtgacacagatcatagctcactgcagcctcaaacacctgggctcaagcaatcatcccacctcagcctcccgagtagctaggatcacaggtgcacaccactgcacctggctggttattttcttctagtctttttctttgcctctagcatatactttctttctaaatcctttttttcccccactgagctttatacagggcatttccctgtgcc

SEQ ID NO: 124110 - DNA, 601 bp, Human
ccatttgggtttgggttctatgttccctggaggggtctttagaggtggagagtccagcttcctcgagagcaccccaaaaagagaggggtgaggggctcccataagcctctcccaatgcctgccatcccagccaggggcgtcccttcttgcctcatacttggcatttgcctttattactgggtgccctctgcagccagaaagttgccccagcaacagtgcctcccccagagaaggcatctgagaaaaacctggcatgaaacggggaagcagggggtaatgacggccatggacacactcttcytggattctagtagatacagaaagtcgacttctctggggctcagagaatcttgccacccgaccctgggtcaactctcttcatggccacttgacacccacagctccccactcagaggcccccgggagcccctcacccacggggcccagctctgtgtgtgcgatgaccatgccttcatcaagacgaattctaaatcttagagctatttaagacgtaatggaaaagaggacttcttctgattgtaagaatagtatatgctcttgcccaaactttgggaaaaagagaaataaccaataatatttt

SEQ ID NO: 124111 - DNA, 601 bp, Human
acctattattattattattattatttattattattattttgagacagagtctcactctgtcacccaggctggagggcagtggtgcaatctcggctcactgcaagctccacctcccgggttcaagtgattctcctgcctcagcctcccgagtagctgggactacaggcacataccaccatgcctggctaacttttatttttaatagagacagggtttggccatgttggccaggctggtctcgaactcctgacctcaagtgatccacctgcctcagcctcccaaagtgctgggcttacaggcrtgagccaccactcctggccaaaaggcacatttctataatggaactccagaggctttccacctctcccagctgttgagagttcacatctgtttctctctcctttataattccactccgacgtataacttatgatgaaccaaatgatgagctttcaacctggaagacagaagcccgcaccccaggttgcaatggaggggactggggtcttggacttcgctggccagctcatctccatttgggtttgggttctatgttccctggaggggtctttagaggtggagagtccagcttcctcgagag

SEQ ID NO: 124112 - DNA, 601 bp, Human
cacagagtccctccccagcaggggctgttcccagtcattctgcaaaactggctcctcttctccatgctggctgatgtgaaagaactcaggccagggcaacaaaagaaagcaagctacgtcccaaagagagggttcagcttccctcagtgctatgatgtcctgctggtatctaaaaatgcatatttctgttttttattttaaaaaacaagacctattattattattattattatttattattattattttgagacagagtctcactctgtcacccaggctggagggcagtggtgcaatctcrgctcactgcaagctccacctcccgggttcaagtgattctcctgcctcagcctcccgagtagctgggactacaggcacataccaccatgcctggctaacttttatttttaatagagacagggtttggccatgttggccaggctggtctcgaactcctgacctcaagtgatccacctgcctcagcctcccaaagtgctgggcttacaggcgtgagccaccactcctggccaaaaggcacatttctataatggaactccagaggctttccacctctcccagctgttgagagttcacatctgtt

SEQ ID NO: 124113 - DNA, 601 bp, Human
ctcggtgtcggcgcccaggctccgggcacacagcgacgggaacccgggcccaggaggctcggatgaggacaccgcatcacagagtccctccccagcaggggctgttcccagtcattctgcaaaactggctcctcttctccatgctggctgatgtgaaagaactcaggccagggcaacaaaagaaagcaagctacgtcccaaagagagggttcagcttccctcagtgctatgatgtcctgctggtatctaaaaatgcatatttctgttttttattttaaaaaacaagacctattattattaytattattatttattattattattttgagacagagtctcactctgtcacccaggctggagggcagtggtgcaatctcggctcactgcaagctccacctcccgggttcaagtgattctcctgcctcagcctcccgagtagctgggactacaggcacataccaccatgcctggctaacttttatttttaatagagacagggtttggccatgttggccaggctggtctcgaactcctgacctcaagtgatccacctgcctcagcctcccaaagtgctgggcttacaggcgtgagccaccactcc

SEQ ID NO: 124114 - DNA, 601 bp, Human
gcactgtaaatgtcgatgtagttgggtctgatgcccagcgactttgcctcgaccacatctgtgacatcgccgtccagcatgcggatgcctgaaagcacagaggaggctcggtgtcggcgcccaggctccgggcacacagcgacgggaacccgggcccaggaggctcggatgaggacaccgcatcacagagtccctccccagcaggggctgttcccagtcattctgcaaaactggctcctcttctccatgctggctgatgtgaaagaactcaggccagggcaacaaaagaaagcaagctacrtcccaaagagagggttcagcttccctcagtgctatgatgtcctgctggtatctaaaaatgcatatttctgttttttattttaaaaaacaagacctattattattattattattatttattattattattttgagacagagtctcactctgtcacccaggctggagggcagtggtgcaatctcggctcactgcaagctccacctcccgggttcaagtgattctcctgcctcagcctcccgagtagctgggactacaggcacataccaccatgcctggctaacttttatttttaatagagac

SEQ ID NO: 124115 - DNA, 601 bp, Human; identical to SEQ ID NO: 25248

SEQ ID NO: 124116 - DNA, 601 bp, Human; identical to SEQ ID NO: 25249

SEQ ID NO: 124117 - DNA, 601 bp, Human; identical to SEQ ID NO: 25250

SEQ ID NO: 124118 - DNA, 601 bp, Human; identical to SEQ ID NO: 25251

SEQ ID NO: 124119 - DNA, 601 bp, Human; identical to SEQ ID NO: 25252

SEQ ID NO: 124120 - DNA, 601 bp, Human; identical to SEQ ID NO: 25253

SEQ ID NO: 124121 - DNA, 601 bp, Human; identical to SEQ ID NO: 25254

SEQ ID NO: 124122 - DNA, 601 bp, Human; identical to SEQ ID NO: 25255

SEQ ID NO: 124123 - DNA, 601 bp, Human; identical to SEQ ID NO: 25256

SEQ ID NO: 124124 - DNA, 601 bp, Human; identical to SEQ ID NO: 25257

SEQ ID NO: 124125 - DNA, 601 bp, Human; identical to SEQ ID NO: 25258

SEQ ID NO: 124126 - DNA, 601 bp, Human; identical to SEQ ID NO: 25259

SEQ ID NO: 124127 - DNA, 601 bp, Human; identical to SEQ ID NO: 25260

SEQ ID NO: 124128 - DNA, 601 bp, Human; identical to SEQ ID NO: 25261

SEQ ID NO: 124129 - DNA, 601 bp, Human; identical to SEQ ID NO: 25262

SEQ ID NO: 124130 - DNA, 601 bp, Human; identical to SEQ ID NO: 25263

SEQ ID NO: 124131 - DNA, 601 bp, Human; identical to SEQ ID NO: 25264

SEQ ID NO: 124132 - DNA, 601 bp, Human; identical to SEQ ID NO: 25265

SEQ ID NO: 124133 - DNA, 601 bp, Human; identical to SEQ ID NO: 25266

SEQ ID NO: 124134 - DNA, 601 bp, Human; identical to SEQ ID NO: 25267

SEQ ID NO: 124135 - DNA, 601 bp, Human; identical to SEQ ID NO: 25268

SEQ ID NO: 124136 - DNA, 601 bp, Human; identical to SEQ ID NO: 25269

SEQ ID NO: 124137 - DNA, 601 bp, Human; identical to SEQ ID NO: 25270

SEQ ID NO: 124138 - DNA, 601 bp, Human; identical to SEQ ID NO: 25271

SEQ ID NO: 124139 - DNA, 601 bp, Human; identical to SEQ ID NO: 25272

SEQ ID NO: 124140 - DNA, 601 bp, Human; identical to SEQ ID NO: 25273

SEQ ID NO: 124141 - DNA, 601 bp, Human; identical to SEQ ID NO: 25274

SEQ ID NO: 124142 - DNA, 601 bp, Human; identical to SEQ ID NO: 25275

SEQ ID NO: 124143 - DNA, 601 bp, Human; identical to SEQ ID NO: 25276

SEQ ID NO: 124144 - DNA, 601 bp, Human; identical to SEQ ID NO: 25277

SEQ ID NO: 124145 - DNA, 601 bp, Human; identical to SEQ ID NO: 25278

SEQ ID NO: 124146 - DNA, 601 bp, Human; identical to SEQ ID NO: 25279

SEQ ID NO: 124147 - DNA, 601 bp, Human
acacactccgttctgtatcagatacaaggcccagagaaacaccgttctccttaaaaacagctgcgatggcagaattggaataatctgatttcctctcctagtgggctagggttcttgctttctgatttactttatggctgcttttttttttttaaataaaaattttggccaggcacggtagctcacatctgtaatccaagcactttgggaggccaaggcgggtggatcacctgaggtcaagagtttgagaccagcctggccaacatggtgaaaccccgtctctactaaaaatacaaaaaamctagctgggcatggtggtgggtgcctataatcccagctactcgggaggctgaggcaggaagatggcttgaactcaggaggcagaggttgcagtgagccgggatcatgccactgcactccagcctgggcaacaagagcaaaactcggtctcaatcaatcaatcaatcaatcaatgaacaaatataacagatttagaaacacttactccaaagagcagttccgggtgtgccctgctcacgggagagagatgaagccagggcccttctgctcgagccttgttaaaaaaatcccagcgcttaag

SEQ ID NO: 124148 - DNA, 601 bp, Human
gggaacaagtagttatgggaaaaacacactccgttctgtatcagatacaaggcccagagaaacaccgttctccttaaaaacagctgcgatggcagaattggaataatctgatttcctctcctagtgggctagggttcttgctttctgatttactttatggctgcttttttttttttaaataaaaattttggccaggcacggtagctcacatctgtaatccaagcactttgggaggccaaggcgggtggatcacctgaggtcaagagtttgagaccagcctggccaacatggtgaaaccccrtctctactaaaaatacaaaaaacctagctgggcatggtggtgggtgcctataatcccagctactcgggaggctgaggcaggaagatggcttgaactcaggaggcagaggttgcagtgagccgggatcatgccactgcactccagcctgggcaacaagagcaaaactcggtctcaatcaatcaatcaatcaatcaatgaacaaatataacagatttagaaacacttactccaaagagcagttccgggtgtgccctgctcacgggagagagatgaagccagggcccttctgctcgagccttg

SEQ ID NO: 124149 - DNA, 601 bp, Human
acacgttttccaaagggaacaagtagttatgggaaaaacacactccgttctgtatcagatacaaggcccagagaaacaccgttctccttaaaaacagctgcgatggcagaattggaataatctgatttcctctcctagtgggctagggttcttgctttctgatttactttatggctgcttttttttttttaaataaaaattttggccaggcacggtagctcacatctgtaatccaagcactttgggaggccaaggcgggtggatcacctgaggtcaagagtttgagaccagcctggccaasatggtgaaaccccgtctctactaaaaatacaaaaaacctagctgggcatggtggtgggtgcctataatcccagctactcgggaggctgaggcaggaagatggcttgaactcaggaggcagaggttgcagtgagccgggatcatgccactgcactccagcctgggcaacaagagcaaaactcggtctcaatcaatcaatcaatcaatcaatgaacaaatataacagatttagaaacacttactccaaagagcagttccgggtgtgccctgctcacgggagagagatgaagccagggccctt

SEQ ID NO: 124150 - DNA, 601 bp, Human
ggcaggagaagaatgcttcattcaggagccgccctgacggggacacgagcggaggcgccggggcagagggcagcccccaggtcaggaaccagacccaggagcccacctccctcacctagcctctgagggtccaggctgcaggcgttttccagcaaagacagagaaggcaaaacctcctttatctcagagactctcccacgttgtttcaaatttgacagtctaaggctcctcagagaaaccgacgccttaagaagtcaagactgaggcttgtcaggtgtctggccgacctgtcggggcctgsagtgaccactcagcggtcagtgtgcaattagccacgggagaaaaaggtgatttttcaaaagatccttctgtggctattcatccagctgctcagccaacacacactctctgcactcctaccatatgcgagccctccaccagacacatttttctcaactatttgtggcaagagtgtattacaagagtagaggcatattcaaggaagagcatctaaagagagtgacctgtatttgttgataaagaaatatatcactttcagtcatcacactgtttctttttcaaacacgttttccaaagggaa

SEQ ID NO: 124151 - DNA, 601 bp, Human
gggaaaactcgcatagctgtggggatactcgcggctcaggtgcagatgaccccgacctgcaggcaggctcagtggcagagctggctggagctccctgccaggaggggagacccacaggtggacgtgaggcatggaactctgcttggtaacacccctctctctggaggcccgtatgtcctctgcaacaaccacgttacagagttaagcaagtgatctgataagcaagtggtgtgagacggtaggctggctgaatatcccagaaagagtctgaaactgctaaaggtaaagatgacttttcttyagaaacagaagtctgattcttctcctcttggagtttggagggtccttactttcctcaaaggacaggaacaatgttacactgtatgtgacggcgggctccctcaacctgtgctgtctagactccgtgtgctttcacttaaaaaacaaaataaaataaaaataaaaacaaccactcgccacctaggcaccactctgccatcttaaaacgatttctggcaggagaagaatgcttcattcaggagccgccctgacggggacacgagcggaggcgccggggcagagggcagcccccaggtcagga

SEQ ID NO: 124152 - DNA, 601 bp, Human
acacgagaggggtgtataaagaggcatacacacactctgtcttccctcttgctctgctcttcaccatgggaagcagcttagggcaggttcaggacattcaggaagtcctaggattccaccatgagaggaagaaatcagaatgaggccaagagagtagacagctggacccacaaacgtgcacggagagggggcagttagaagaagacgggaaaatggctgtgtgggaacgcttccttttcattttcggccacgtgatcctagcagctgggaaccccgatggggaaaactcgcatagctgtgrggatactcgcggctcaggtgcagatgaccccgacctgcaggcaggctcagtggcagagctggctggagctccctgccaggaggggagacccacaggtggacgtgaggcatggaactctgcttggtaacacccctctctctggaggcccgtatgtcctctgcaacaaccacgttacagagttaagcaagtgatctgataagcaagtggtgtgagacggtaggctggctgaatatcccagaaagagtctgaaactgctaaaggtaaagatgacttttctttagaaacagaagtctgattctt

SEQ ID NO: 124153 - DNA, 601 bp, Human
accgcctgagctcctacctaggggggcaaggtggactctggagacaagcagcctgcgggagcagctcagccccacagcaccccacctctgggcctaagttcctaactcctttctgcctccatttcttcctccataaaatgaggataaagatagaactccaacctcacatgtttattggggatttttatataaagtgcttagagcaatgcctggcacacagtaagtgcctttataatcacaatccattatctctcatccacagccatatgtcttcataaatagagttgttttaaaatgaccrccatacgcagtctagtttcacgaaattccagaaaagcaggtgatatgcggctaatccagagttaattcctgaacatctataaaaagattatctgctctacagataagccttgatagtcaaagcaacacattggcttttgggtctgaagtgtcttgtgtgggttgtgggtgtgtgaagagttcattaaaagacaggccaaggtaaactgtaagctctgtctggacagtaaccttccaaaccagcagaaactaaagacgtgcaggtaagttatcgctttgtgttggtttaaaagaccctgtt

SEQ ID NO: 124154 - DNA, 601 bp, Human
tggcctcaccagcttgcccagctgacctgccgcagatgagacgccagcagctggcgtctggccaaggccggaggaagctctgggcagccagggtcaggtactttatcatccctggaggtggtgcgcccagctagctcctggcacagaggtcacagaggtgaggtcttctaacgggtgggcaggtcgctctcattggctcagtaccgcctgagctcctacctaggggggcaaggtggactctggagacaagcagcctgcgggagcagctcagccccacagcaccccacctctgggcctaagytcctaactcctttctgcctccatttcttcctccataaaatgaggataaagatagaactccaacctcacatgtttattggggatttttatataaagtgcttagagcaatgcctggcacacagtaagtgcctttataatcacaatccattatctctcatccacagccatatgtcttcataaatagagttgttttaaaatgaccgccatacgcagtctagtttcacgaaattccagaaaagcaggtgatatgcggctaatccagagttaattcctgaacatctataaaaagattatctgctct

SEQ ID NO: 124155 - DNA, 601 bp, Human
aagcttggttccagcaacgagcactagtgctgtccgctgtgagtctaaagtgaatgaaccaatgatctatgttaaataagctgtctttaaacccatacacataaagctcggtctatatggacaggctggcaaaaatgtgaccggaggctcacaggaacttaaccctgtatctctcctaggaataacgcttcagtgttcgtggtgactttgtggaacagtaccacaaatagggagaatcaactgtattcaaattccaaatcctaattttagaaataagtagcctttacaatttggggaaaasaagtttgcttcaaaactaagccaggaagggaaagggttgcaagaacataaccagctggttaagtttgctcgcagctacaaggggtagcagcaggcaggaaaagtgttgtgggtccactgtggttacccccagggcgggactgcacagcaccccacagatcttctgaggacacccaggcatgctctgtataacaacagcccaagaggagaaaccagaagtaagggcctcctgtggtacccaggtatacacagaggtcagatgccctggagggagaggctgggtaaggtgaggaggggatgg

SEQ ID NO: 124156 - DNA, 601 bp, Human
aggtgcagtggtgcaatcctagctcactggagccttgacctcctgggctcaagcgatcctcccacctcagcctcccgagtagctaggactgtaggtgcaaaccaccatgcctggctctgtgcttttctgttggtgaattcactgtttgaaatggccccaagtgcagtgctgaaacactgtctagtgtcaaacagcatgagaaagcagagacctgccttaaggagaaaacacacgggtaagacaagcttggttccagcaacgagcactagtgctgtccgctgtgagtctaaagtgaatgaaycaatgatctatgttaaataagctgtctttaaacccatacacataaagctcggtctatatggacaggctggcaaaaatgtgaccggaggctcacaggaacttaaccctgtatctctcctaggaataacgcttcagtgttcgtggtgactttgtggaacagtaccacaaatagggagaatcaactgtattcaaattccaaatcctaattttagaaataagtagcctttacaatttggggaaaagaagtttgcttcaaaactaagccaggaagggaaagggttgcaagaacataaccagctgg

SEQ ID NO: 124157 - DNA, 601 bp, Human
ctccagaatcaggagccagcagcatcctgccagctgctgtgctggcacctggcttggggaggagaggctaaagaactgaggcccattacagcagaaggtcatccaggaaaccctttcacagacccgctaacgggagtgaatggaatggcaagagttaattgggacagacttgctaaattaagcaataggaaaacagcaggtcggagggcacacagtgcccgtgtgaaggtggcaagaggcttctaggtcacttctcagacctgtgttccaggatgcacgctctcaacaagactgtcgttasgctctgaggtaagctgcttcattcatctgtgggcttccttattcatatgagttcagactgagaattttcctcacatgaaattactttttttttttttttgagatggagtctcactctgtccgcaggctggagtgcagtggtgctatctcagcttacggtaacctctgcctcccgggttcaagcaattctcccgcctcagactcctgagtagctgggactacaggcatgcgccaccacgcccggccaatgtttgtatttttagtagagatggggtttccccatgttggccacgctggtctc

SEQ ID NO: 124158 - DNA, 601 bp, Human
gagagaccctccagaatcaggagccagcagcatcctgccagctgctgtgctggcacctggcttggggaggagaggctaaagaactgaggcccattacagcagaaggtcatccaggaaaccctttcacagacccgctaacgggagtgaatggaatggcaagagttaattgggacagacttgctaaattaagcaataggaaaacagcaggtcggagggcacacagtgcccgtgtgaaggtggcaagaggcttctaggtcacttctcagacctgtgttccaggatgcacgctctcaacaagacygtcgttaggctctgaggtaagctgcttcattcatctgtgggcttccttattcatatgagttcagactgagaattttcctcacatgaaattactttttttttttttttgagatggagtctcactctgtccgcaggctggagtgcagtggtgctatctcagcttacggtaacctctgcctcccgggttcaagcaattctcccgcctcagactcctgagtagctgggactacaggcatgcgccaccacgcccggccaatgtttgtatttttagtagagatggggtttccccatgttggccacg

SEQ ID NO: 124159 - DNA, 601 bp, Human
tcctgttctacctgggaagctactccatgtcagtatttctcactccctccttgaagccctctccccaggttggcttcctggaccaacctggatccttgcacaacgcacttgctttgttcctcactgggcccatgaatgttctagggccatgttgagagaccctccagaatcaggagccagcagcatcctgccagctgctgtgctggcacctggcttggggaggagaggctaaagaactgaggcccattacagcagaaggtcatccaggaaaccctttcacagacccgctaacgggagtgartggaatggcaagagttaattgggacagacttgctaaattaagcaataggaaaacagcaggtcggagggcacacagtgcccgtgtgaaggtggcaagaggcttctaggtcacttctcagacctgtgttccaggatgcacgctctcaacaagactgtcgttaggctctgaggtaagctgcttcattcatctgtgggcttccttattcatatgagttcagactgagaattttcctcacatgaaattactttttttttttttttgagatggagtctcactctgtccgcaggctggagtgcagtg

SEQ ID NO: 124160 - DNA, 601 bp, Human
gaacagtcaatgaaaaaaacagaagtggttctccaccctacagttatttctaaggtaacactgaaaatgcaagtcgactgccaagtaatttatctttcaagttaaacaatgtgcagagattatcactgtcacgtgaatacacctacattgtactttaatgatgaaaactgatttagaaagatcttaaagtccccaaagtaactgaaaagtgtcttctgctattaacttctgaaactgtggtctatgtacataaagccatcttccgaggacgctaagggagtccacggagttaaatgatccygcaaaacctgcctggagaccgtgcgttgttgaagccagggagacggccagacttggaaaagatctctaatgacagcaaatgccacgtgccacgcagccacatttcaacgttaattactctggtacttcagatgttctccattcatcccaaatgctctccacccgctcccttctcctgaggaggcgaaggcccaccaacagtagccaccctgctgactccctaggaactccagaccacagatatgttggcctcctcctatttttttttccaatgcataatactatctaatagcaaaaataa

SEQ ID NO: 124161 - DNA, 601 bp, Human
tttaaaaaattaactccaagacagaaagtagaacagtcaatgaaaaaaacagaagtggttctccaccctacagttatttctaaggtaacactgaaaatgcaagtcgactgccaagtaatttatctttcaagttaaacaatgtgcagagattatcactgtcacgtgaatacacctacattgtactttaatgatgaaaactgatttagaaagatcttaaagtccccaaagtaactgaaaagtgtcttctgctattaacttctgaaactgtggtctatgtacataaagccatcttccgaggacsctaagggagtccacggagttaaatgatcccgcaaaacctgcctggagaccgtgcgttgttgaagccagggagacggccagacttggaaaagatctctaatgacagcaaatgccacgtgccacgcagccacatttcaacgttaattactctggtacttcagatgttctccattcatcccaaatgctctccacccgctcccttctcctgaggaggcgaaggcccaccaacagtagccaccctgctgactccctaggaactccagaccacagatatgttggcctcctcctatttttttttcca

SEQ ID NO: 124162 - DNA, 601 bp, Human
acactctcacacttcaacacctttccagtgctgaatagcaagatcaaggggaaacagacacaaaagccttaaccaagttgaagacacggtccccacactccaaccaattgctcatcggtaggggaagtgatcaatctgctctagaaatagacctggaatccttgtgaagaagctttaatcccattgataaggcacagggatgagagaacgggagcagggtaattacaagtgaaagacaaccaagccccacctctcacctgccccgccactctgagccccacccacagagcgaacacctagaaaaaaaaaatcatttcagagtatgaaagtctcttgcatctgacttttttattcctgctaagggactccagccgctgcataaagaaggctgggttgggtgtgatcctccgccagccccgctgctgctgcctgcagggaggctggctgggggcgggagcacccagctcctgcaggagttaatggcctcacttcgtttggttttcaaagccatgcccttaccttcacctgggggctaggagcccagcagcctcctggaacaaggctaactgtaacaattagtttttatgtgaaagctcttaac

SEQ ID NO: 124163 - DNA, 601 bp, Human
cctggactctcctcccgggaggcatgaggcgttctgctcagagcctctcaggagttacactgcttggctctactgggccctgagtcataaaaaacaatcaaaacagttataaacagtgatgtaattccctcggagactctgtaagtatttgaaaacacgctttgcatgcaccataaattgatctagagatgctgacttccttcattgccttctcccaagctttactgctagtgtttactggccagcagcccccgctgcggtagatgccgaacacaagagaaggctctggggagttccaggwcctgcagggcccatgtgtctctccaggtgagtgtcccccatcccccaccttcaccccacactaagaatgtaaggtgggtacgttagggagaagcaaggtgtggagacggagaaacgtctatgccggcagacttactcagtgctcccctggggcttcaaaatgtagctcccagtcaaccccaaaaaccaggaataaccctacactctcacacttcaacacctttccagtgctgaatagcaagatcaaggggaaacagacacaaaagccttaaccaagttgaagacacggtccccacactcc

SEQ ID NO: 124164 - DNA, 601 bp, Human
ctaaaaatacaaaaattagctgggcatggtggcgggtgtctgtaatcccagctactcgggagcctgaggcaggagaatctcttgaacccaggaggtggaggttgcagcgagccgaggtcgcaccactgcactccagcctgggagacagagcaaggctccaactcaaaaataaaataaaataaaagatgggttcttgggcagacttgggtgaatgtccccagggatgggctccctttggtgaccagaaggcggcttctcctcggtggcatttggccagctcgtttctcagttgccctagtaygacctccatggtgacaggtacactaaaaggccagacctcaccacactgcaatatgtgcatgtaagaaacctgtccttggaccccctaaatatataaaaataattaaatgttttaacaaacaaacaaataaaaaatcccactactttgttccgaagactagcattgaaaatagaagtcacaatgctaaataacagcaatcagcaaacatttcccaagctgactgtgcactgagcataaggcactggcctgagaatttccaaggattaacccatttaatccagagggaaattaaggactgta

SEQ ID NO: 124165 - DNA, 601 bp, Human
cttgcctacagtggagagaccaggctgctgggcagtgctgtggggtgcacagcacaggccccattcctctggacgatggccctgtctgccttgcattgctgctgagtcaattattttgtcttatacaaagtggggggagggggagggcagatcacaaggtcaggagtttgagaccagcctggccaatacggtgaaaccctgtctactaaaaatacaaaaattagctgggcatggtggcgggtgtctgtaatcccagctactcgggagcctgaggcaggagaatctcttgaacccaggaggyggaggttgcagcgagccgaggtcgcaccactgcactccagcctgggagacagagcaaggctccaactcaaaaataaaataaaataaaagatgggttcttgggcagacttgggtgaatgtccccagggatgggctccctttggtgaccagaaggcggcttctcctcggtggcatttggccagctcgtttctcagttgccctagtatgacctccatggtgacaggtacactaaaaggccagacctcaccacactgcaatatgtgcatgtaagaaacctgtccttggaccccctaaatatata

SEQ ID NO: 124166 - DNA, 601 bp, Human
gcctcacgtggatgctccactgtgaactttatcacctgtcctgaagacgtttatgcctctggaatttgcttacagagatttgaaagacggttcggctgggcactgtggctcacgcctctgatcccagctctttgggaggccgaggcaccgcctgctgccaccgctccaacttgcctacagtggagagaccaggctgctgggcagtgctgtggggtgcacagcacaggccccattcctctggacgatggccctgtctgccttgcattgctgctgagtcaattattttgtcttatacaaagtrgggggagggggagggcagatcacaaggtcaggagtttgagaccagcctggccaatacggtgaaaccctgtctactaaaaatacaaaaattagctgggcatggtggcgggtgtctgtaatcccagctactcgggagcctgaggcaggagaatctcttgaacccaggaggtggaggttgcagcgagccgaggtcgcaccactgcactccagcctgggagacagagcaaggctccaactcaaaaataaaataaaataaaagatgggttcttgggcagacttgggtgaatgtccccagggatgg

SEQ ID NO: 124167 - DNA, 601 bp, Human
ggtccgagtgctccgcgcaggcgctggtcagggccgtagtccgcagcacctgcactaaggggatgctcctgggggagaagggagggctcagcacttggcaccggaagcatgaagtctcacccacacagccaggagctccagcgcccgtccactctatccccactgcagcctcagggccctgcgggccccggggagccgcagcagcctctgactgcctcacgtggatgctccactgtgaactttatcacctgtcctgaagacgtttatgcctctggaatttgcttacagagatttgaaagayggttcggctgggcactgtggctcacgcctctgatcccagctctttgggaggccgaggcaccgcctgctgccaccgctccaacttgcctacagtggagagaccaggctgctgggcagtgctgtggggtgcacagcacaggccccattcctctggacgatggccctgtctgccttgcattgctgctgagtcaattattttgtcttatacaaagtggggggagggggagggcagatcacaaggtcaggagtttgagaccagcctggccaatacggtgaaaccctgtctactaaaaatacaaaa

SEQ ID NO: 124168 - DNA, 601 bp, Human; identical to SEQ ID NO: 25280

SEQ ID NO: 124169 - DNA, 601 bp, Human; identical to SEQ ID NO: 25281

SEQ ID NO: 124170 - DNA, 601 bp, Human; identical to SEQ ID NO: 25282

SEQ ID NO: 124171 - DNA, 601 bp, Human; identical to SEQ ID NO: 25283

SEQ ID NO: 124172 - DNA, 601 bp, Human; identical to SEQ ID NO: 25284

SEQ ID NO: 124173 - DNA, 601 bp, Human; identical to SEQ ID NO: 25285

SEQ ID NO: 124174 - DNA, 601 bp, Human; identical to SEQ ID NO: 25286

SEQ ID NO: 124175 - DNA, 601 bp, Human; identical to SEQ ID NO: 25287

SEQ ID NO: 124176 - DNA, 601 bp, Human; identical to SEQ ID NO: 25288

SEQ ID NO: 124177 - DNA, 601 bp, Human; identical to SEQ ID NO: 25289

SEQ ID NO: 124178 - DNA, 601 bp, Human; identical to SEQ ID NO: 25290

SEQ ID NO: 124179 - DNA, 601 bp, Human; identical to SEQ ID NO: 25291

SEQ ID NO: 124180 - DNA, 601 bp, Human; identical to SEQ ID NO: 25292

SEQ ID NO: 124181 - DNA, 601 bp, Human
cccaaatgtccatcacaggtgaatgaataaacaaaatgtgatcaatccgtacaatggaatatcgtttagccatacgagtaatgacgttttgatgcatacgacaatattgaaaaactttgaaaacatcatgctaagtgaaagaagccagacacaaaaggccaggtgttgtattatttcatctatatgaaatgtccaggagaggcaaatccaaagaaatggtaagtggattagaggttgccaggagctgggaggggaggagggaatggggagtggctgcttcatgggtatggggtttcttttwgtggggatgaaaacattctggaattagatagtgctgacgtttacatgacatcgtggatgtactaaaagccactgaactgtccacttaaaaataattaaaatggtgaattttctgttatgggaattctacctctaaaacacaaaacaaagaattatcagagactccgtagttaaataaggcccagaggtaaaaagaggcttgagatacaaaagctgtcatgagattcccaagagccactgaccttgcttctccgggttgcggacctgggatggcagatcttggatttccaaggtccactgc

SEQ ID NO: 124182 - DNA, 601 bp, Human
atgtaaaagggtgcagccaatgtggaagacagtttggctgttcctcaaaacgttcaacatagagttaccatatgacctgacaattccaatcttaggtatacgcccacgagaaacaaaaacataggtccacataaaaacttgtacatgaatcctcatagctgtactatttgtaacagctaaaaggtagaaacaacccaaatgtccatcacaggtgaatgaataaacaaaatgtgatcaatccgtacaatggaatatcgtttagccatacgagtaatgacgttttgatgcatacgacaatatkgaaaaactttgaaaacatcatgctaagtgaaagaagccagacacaaaaggccaggtgttgtattatttcatctatatgaaatgtccaggagaggcaaatccaaagaaatggtaagtggattagaggttgccaggagctgggaggggaggagggaatggggagtggctgcttcatgggtatggggtttctttttgtggggatgaaaacattctggaattagatagtgctgacgtttacatgacatcgtggatgtactaaaagccactgaactgtccacttaaaaataattaaaatggtgaa

SEQ ID NO: 124183 - DNA, 601 bp, Human
aggagtctcaagatcacctaatgggtaaagaatgcatttttcagcaagtggtgctggaacaaatgggtacaaaagaatgagtttggacccctacttcacaccatatacaaaaataattcaaaatggatcaaagtcctacatgtaagagctataacactcttaaaaggaaacacaggagtaaatctctgtgactttgggttaggcaatggtttctcaggtatgacaccaagagcacaagcaacagaagaaaaaataaattgaatttcatcataatttaaaacttttgtgcatcaaggtgcaycatcaggcaattgaagaaccacagataccacttcacacctactagaacgcttataattttttaaaaagcagagaatattaagtgttaacgagaatgtgaaggagctggacctctcatatattgctggccggaatgtaaaagggtgcagccaatgtggaagacagtttggctgttcctcaaaacgttcaacatagagttaccatatgacctgacaattccaatcttaggtatacgcccacgagaaacaaaaacataggtccacataaaaacttgtacatgaatcctcatagctgtactatt

SEQ ID NO: 124184 - DNA, 601 bp, Human
acttaggaacaactttcaccaaggaggcgaaagacttatatactcaacactacaaaaaacactgctaaacaaaattaaagaagagctaaataaacagaaaactatcccaagtttatggactggaagacttaatattgttaatgtggaaatattccccaaaatgatctacatatccaatctctaccagaattccaactaccttttaaaaaagaaatgtacaagcttatcttcaaattcacatggaattacacgggacccaaaatagccaaaacaatcttgagaaagaaccaccaagttggargactcgcactttcttatttcaaaacttactacaaagctacagtgatcaaaacaatatggtactgactccaagatagatatacagaccaatggaacagaatcgagagtgtggaaacgaacctctcttctgtggtcagttgatttgcaacaggagtctcaagatcacctaatgggtaaagaatgcatttttcagcaagtggtgctggaacaaatgggtacaaaagaatgagtttggacccctacttcacaccatatacaaaaataattcaaaatggatcaaagtcctacatgtaagagctat

SEQ ID NO: 124185 - DNA, 601 bp, Human
gcttttaaaagaaagaatttaggagcttccactattaaaatgtgtaaatttcaggtcatttaaaattttacatttttgtacttttaggatttgttataacactttttttttttttgagacggagtctcgctctgtcacccaggctggagtgcagtggtgcgatctcggctcactgtaagctccgcctcccgggttcaagccattctcctgcctcagcctccctaagagctgggactacaggtgcctgccaccttgcctggctaatttttttttttttttggatttttagtagagatggggkttcaccgtgttagccaggatggtctcgatctcctgacttcgtgatccacccgcctcggcctcccaaagtgctgggattacaggcatgagccaccgcgcccagccaacgctttcttaaaatagttatttactattttaaaaccagaaagaatacaactgggggaggtcccagatccctgtagatgacttgatgacttaaagtcaattttccacgtaaggcaagtcaacactcttcttttctcctaaaactgtgctattccaaatggaatggtttttttaattttgcttttggattgtttat

SEQ ID NO: 124186 - DNA, 601 bp, Human
accttgacttttaatactcggccaatacactttggggcttttaaaagaaagaatttaggagcttccactattaaaatgtgtaaatttcaggtcatttaaaattttacatttttgtacttttaggatttgttataacactttttttttttttgagacggagtctcgctctgtcacccaggctggagtgcagtggtgcgatctcggctcactgtaagctccgcctcccgggttcaagccattctcctgcctcagcctccctaagagctgggactacaggtgcctgccaccttgcctggctaatttttttttttttttggatttttagtagagatggggtttcaccgtgttagccaggatggtctcgatctcctgacttcgtgatccacccgcctcggcctcccaaagtgctgggattacaggcatgagccaccgcgcccagccaacgctttcttaaaatagttatttactattttaaaaccagaaagaatacaactgggggaggtcccagatccctgtagatgacttgatgacttaaagtcaattttccacgtaaggcaagtcaacactcttcttttctcctaaaactgtgctattccaaatg

SEQ ID NO: 124187 - DNA, 601 bp, Human
tatgccatgaggacacaagagcagtagccccagcctccatgtgctctcctgcatacagcaccagcctcccaggcaagcaggccatgcaggctggcatgagaactctgccttgtgcccacgaagcagtgaatgcttgaggatgcagctggcatgaggagtaaaccttgacttttaatactcggccaatacactttggggcttttaaaagaaagaatttaggagcttccactattaaaatgtgtaaatttcaggtcatttaaaattttacatttttgtacttttaggatttgttataacactgtttttttttttgagacggagtctcgctctgtcacccaggctggagtgcagtggtgcgatctcggctcactgtaagctccgcctcccgggttcaagccattctcctgcctcagcctccctaagagctgggactacaggtgcctgccaccttgcctggctaatttttttttttttttggatttttagtagagatggggtttcaccgtgttagccaggatggtctcgatctcctgacttcgtgatccacccgcctcggcctcccaaagtgctgggattacaggcatgagccaccgcgcccagc

SEQ ID NO: 124188 - DNA, 601 bp, Human
ctatgccatgaggacacaagagcagtagccccagcctccatgtgctctcctgcatacagcaccagcctcccaggcaagcaggccatgcaggctggcatgagaactctgccttgtgcccacgaagcagtgaatgcttgaggatgcagctggcatgaggagtaaaccttgacttttaatactcggccaatacactttggggcttttaaaagaaagaatttaggagcttccactattaaaatgtgtaaatttcaggtcatttaaaattttacatttttgtacttttaggatttgttataacactttttttttttttgagacggagtctcgctctgtcacccaggctggagtgcagtggtgcgatctcggctcactgtaagctccgcctcccgggttcaagccattctcctgcctcagcctccctaagagctgggactacaggtgcctgccaccttgcctggctaatttttttttttttttggatttttagtagagatggggtttcaccgtgttagccaggatggtctcgatctcctgacttcgtgatccacccgcctcggcctcccaaagtgctgggattacaggcatgagccaccgcgcccag

SEQ ID NO: 124189 - DNA, 601 bp, Human
cccagtcttaaccactgcaccctgtggtccccagagagggtgcttagtttgttagaaccatagaccctggctttaacaacctggggaggacagagatgggaccataggcttgggcaatgtggaaacggtgggggaccctgacgagccccggtattttgtgcagtggatgggagtgggctgggagtgagccagtgatggccatggcaggcagcttgttctgccggctttgccataaaggggagcagagaagtgggtggtggctggaggggatgtggactcaggggagaggcatcagtgcackcatgttggcctaataggaaggggaaagagaagaatgcgtgagatgcatgagaaaggctgcctgcagaggcacagttccatgggggattgactgtcccctcaaagctgccctgggacatgggtagggctcgttgtattcggctcatgatacagagtaaagatcacaggtctagagtgttgaatggtgtgcccggtttccagggctatgccatgaggacacaagagcagtagccccagcctccatgtgctctcctgcatacagcaccagcctcccaggcaagcaggccatgcaggctggcat

SEQ ID NO: 124190 - DNA, 601 bp, Human
attcacccgcctcggcctcccaaagtgctggaattacaggcatgagccaccatgcccagcccaaagctatttacattaatgtggaaagcaagaaagaggcagtttgggagtttgtctaaggtgcacaagctcagagccagttagacccatgcccagaagcaggaggctgctgcagagcaggtctgggtgcaagagggcagggagaggcagctttgggcaccaccagcaggtacaaggtgctcagtgtcacggggctggatgagatccctggatgggaacaaagagcagaggacccaggagygcgtgcaggggtatgtgcgagaggatcagccaacgagatgcacaaggggcagcctgtgaggtggagagggcccccaggtgtggcatcactgcagctgtgcaagagggcacttctagagggggtgagctgccaacgtcgctgtgtgccgggccctgctctcggtatccagcctgtcttacctgatttcatcccaccgcaacccagtaacttgcgtactatccccattttctagataagaagaccaaggcctagaaaagctaagtgacttgccaaggtcacaggtatttgtaagagttagag

SEQ ID NO: 124191 - DNA, 601 bp, Human
aggatggtctcgatctcctgaccttgtgattcacccgcctcggcctcccaaagtgctggaattacaggcatgagccaccatgcccagcccaaagctatttacattaatgtggaaagcaagaaagaggcagtttgggagtttgtctaaggtgcacaagctcagagccagttagacccatgcccagaagcaggaggctgctgcagagcaggtctgggtgcaagagggcagggagaggcagctttgggcaccaccagcaggtacaaggtgctcagtgtcacggggctggatgagatccctggaygggaacaaagagcagaggacccaggagtgcgtgcaggggtatgtgcgagaggatcagccaacgagatgcacaaggggcagcctgtgaggtggagagggcccccaggtgtggcatcactgcagctgtgcaagagggcacttctagagggggtgagctgccaacgtcgctgtgtgccgggccctgctctcggtatccagcctgtcttacctgatttcatcccaccgcaacccagtaacttgcgtactatccccattttctagataagaagaccaaggcctagaaaagctaagtgacttgcca

SEQ ID NO: 124192 - DNA, 601 bp, Human
gatatattctggaagcagatggtgaaggagacaaagaagaattaaaggttcactcctgggatttggccaagcaatggagtgcaaggtgaagcttttttttttttttttttttgagttggagtcttgctctatcatccaggctggagtgcagtggcgcaatctcagctcactgcaagctccacctcccaggttcacaccattctcttccctcagcctcccaagtagctgggactacaggcgcccgccaccatgcctggttaactttttgtattgttagtagagatggggtttcaccatgttrgccaggatggtctcgatctcctgaccttgtgattcacccgcctcggcctcccaaagtgctggaattacaggcatgagccaccatgcccagcccaaagctatttacattaatgtggaaagcaagaaagaggcagtttgggagtttgtctaaggtgcacaagctcagagccagttagacccatgcccagaagcaggaggctgctgcagagcaggtctgggtgcaagagggcagggagaggcagctttgggcaccaccagcaggtacaaggtgctcagtgtcacggggctggatgagatccct

SEQ ID NO: 124193 - DNA, 601 bp, Human
aggctaagagatttgggttttgctctaagagctgtgggaggtcattaaagttagcaggggtgcatcattttctgaattatattttaaaaggatcattggatgctgggtggagagtggctctagccagtaggggttgaggcaggggggccagtggaatgaggaggtaagacactataggggactgaactgaggcagtgggcagactgagatatattctggaagcagatggtgaaggagacaaagaagaattaaaggttcactcctgggatttggccaagcaatggagtgcaaggtgaagcttttttttttttttttttttgagttggagtcttgctctatcatccaggctggagtgcagtggcgcaatctcagctcactgcaagctccacctcccaggttcacaccattctcttccctcagcctcccaagtagctgggactacaggcgcccgccaccatgcctggttaactttttgtattgttagtagagatggggtttcaccatgttggccaggatggtctcgatctcctgaccttgtgattcacccgcctcggcctcccaaagtgctggaattacaggcatgagccaccatgcccagccc

SEQ ID NO: 124194 - DNA, 601 bp, Human
gatgtctgcagagctcaccccctcatcttctttgagctttactcaaatgtcccttccctgaggccttcccggtacaccctgaaatgcccttgtcaccctgccctgcttcatttttctccttagagcttctcatcatctaatggacaacagcttcctgcctggtaatcttgtttcacggcctcctctgccttccagaatgtaagcttagcatctgttttgttcaccagtgcatccccagtgcttagaacttggtaaatgctcaataagtatctgttgagtgaaggctgtgttcttggagggkagtattctttgaataaactgatgaattccacttcctaatgttttatttaagacttccgtatccctattcaaatttgcctatagttctttctctctcttttttttttttttttggcatattgatcaatttctcttcactcttatttccctctagtgatctggaaggttggcatcctgttttaaatcttgattatctctctattataggaagatatttgagtttatatgtctctatcagtgctaagagtaagacataatccatcacccctcccactaaatgtggaatcagaatctcagcaaa

SEQ ID NO: 124195 - DNA, 601 bp, Human
ctattctgctcctcttcccactgccccctgcagcctcgggggcctctctgctgtgcctggaacacaccagacacactcctgcccgggggccttagcatcccctggaacacaccagacacactcctgcccgggggccttagcatcccctggaacacaccaggcacactcctgcccgggggccttagcatcccctggaacacaccaggcacactcctgcccaggggccttagcatcccctggaacacaccaggcacactcctgcccgggggccttagcatcccctggaacacaccaggcacastcctgcccgggggcctcagcatcccctgaacgctttgcttggaatgcccttttcccagatgtctgcagagctcaccccctcatcttctttgagctttactcaaatgtcccttccctgaggccttcccggtacaccctgaaatgcccttgtcaccctgccctgcttcatttttctccttagagcttctcatcatctaatggacaacagcttcctgcctggtaatcttgtttcacggcctcctctgccttccagaatgtaagcttagcatctgttttgttcaccagtgcatccccagtgctt

SEQ ID NO: 124196 - DNA, 601 bp, Human
gtgacttccaaccaagtccctgtgagggctgacaaagcccagtgcgatctggtccctatgctctcaatgcctggtcctgtcctattctgctcctcttcccactgccccctgcagcctcgggggcctctctgctgtgcctggaacacaccagacacactcctgcccgggggccttagcatcccctggaacacaccagacacactcctgcccgggggccttagcatcccctggaacacaccaggcacactcctgcccgggggccttagcatcccctggaacacaccaggcacactcctgcccrggggccttagcatcccctggaacacaccaggcacactcctgcccgggggccttagcatcccctggaacacaccaggcacactcctgcccgggggcctcagcatcccctgaacgctttgcttggaatgcccttttcccagatgtctgcagagctcaccccctcatcttctttgagctttactcaaatgtcccttccctgaggccttcccggtacaccctgaaatgcccttgtcaccctgccctgcttcatttttctccttagagcttctcatcatctaatggacaacagcttcctgcctgg

SEQ ID NO: 124197 - DNA, 601 bp, Human
cagatcacctctgtcctctgcctaaaatctctcagtgacttccaaccaagtccctgtgagggctgacaaagcccagtgcgatctggtccctatgctctcaatgcctggtcctgtcctattctgctcctcttcccactgccccctgcagcctcgggggcctctctgctgtgcctggaacacaccagacacactcctgcccgggggccttagcatcccctggaacacaccagacacactcctgcccgggggccttagcatcccctggaacacaccaggcacactcctgcccgggggccttagcatcccctggaacacaccaggcacactcctgcccaggggccttagcatcccctggaacacaccaggcacactcctgcccgggggccttagcatcccctggaacacaccaggcacactcctgcccgggggcctcagcatcccctgaacgctttgcttggaatgcccttttcccagatgtctgcagagctcaccccctcatcttctttgagctttactcaaatgtcccttccctgaggccttcccggtacaccctgaaatgcccttgtcaccctgccctgcttcatttttctccttagagctt

SEQ ID NO: 124198 - DNA, 601 bp, Human
cgcctttgttcctctcccaccctcacttccgtctattctgaccagctgtcagcctattaacacagaagttcagatcacctctgtcctctgcctaaaatctctcagtgacttccaaccaagtccctgtgagggctgacaaagcccagtgcgatctggtccctatgctctcaatgcctggtcctgtcctattctgctcctcttcccactgccccctgcagcctcgggggcctctctgctgtgcctggaacacaccagacacactcctgcccgggggccttagcatcccctggaacacaccagrcacactcctgcccgggggccttagcatcccctggaacacaccaggcacactcctgcccgggggccttagcatcccctggaacacaccaggcacactcctgcccaggggccttagcatcccctggaacacaccaggcacactcctgcccgggggccttagcatcccctggaacacaccaggcacactcctgcccgggggcctcagcatcccctgaacgctttgcttggaatgcccttttcccagatgtctgcagagctcaccccctcatcttctttgagctttactcaaatgtcccttccc

SEQ ID NO: 124199 - DNA, 601 bp, Human
gatattgcaatgaccttctaactggcttccccgcctttgttcctctcccaccctcacttccgtctattctgaccagctgtcagcctattaacacagaagttcagatcacctctgtcctctgcctaaaatctctcagtgacttccaaccaagtccctgtgagggctgacaaagcccagtgcgatctggtccctatgctctcaatgcctggtcctgtcctattctgctcctcttcccactgccccctgcagcctcgggggcctctctgctgtgcctggaacacaccagacacactcctgcccrggggccttagcatcccctggaacacaccagacacactcctgcccgggggccttagcatcccctggaacacaccaggcacactcctgcccgggggccttagcatcccctggaacacaccaggcacactcctgcccaggggccttagcatcccctggaacacaccaggcacactcctgcccgggggccttagcatcccctggaacacaccaggcacactcctgcccgggggcctcagcatcccctgaacgctttgcttggaatgcccttttcccagatgtctgcagagctcaccccctcatc

SEQ ID NO: 124200 - DNA, 601 bp, Human
tgctttcagaatctgactgcttcatacactccactgatgctgccccgtcggagtcaccttcacctgatattgcaatgaccttctaactggcttccccgcctttgttcctctcccaccctcacttccgtctattctgaccagctgtcagcctattaacacagaagttcagatcacctctgtcctctgcctaaaatctctcagtgacttccaaccaagtccctgtgagggctgacaaagcccagtgcgatctggtccctatgctctcaatgcctggtcctgtcctattctgctcctcttcccrctgccccctgcagcctcgggggcctctctgctgtgcctggaacacaccagacacactcctgcccgggggccttagcatcccctggaacacaccagacacactcctgcccgggggccttagcatcccctggaacacaccaggcacactcctgcccgggggccttagcatcccctggaacacaccaggcacactcctgcccaggggccttagcatcccctggaacacaccaggcacactcctgcccgggggccttagcatcccctggaacacaccaggcacactcctgcccgggggcctcag

SEQ ID NO: 124201 - DNA, 601 bp, Human
gctgaacaacaagctcagaggctggccctggaatgaagtgagcagggcaggttggggagactcagttgcaactgcagtgtcccatgtgagggccacatggatttccactgtggagagatgctggtgggacccaggctcccaggctagctctcactgtgcttggggaggatgcacagagcctgtgggtgacaggaaggcgcccgtcctccccacacacagcagggagggcttgccgtgcgtcagctgtggcaggacgcatgcctgtacttgctgtttctggaccacattcaggagtggcagytgtctacagggtaaagcttgcatggaatgaactgactccagacgcccttgcaggaatgtgcatactctctgtgatgacactggagaatgtgtccccgccccccaaattccagtaggccctagaaggtcagagctggaaggtaccacaaggtgtttattctgcacccgtctcaaccttctgaaagcaaagatccagtttctacccacgctgaggggtggagatcgacctgtgtcaagacttcatttggggctaccctcaggaagtatttcttgtatccactaatcctgtgtcctctgtagc

SEQ ID NO: 124202 - DNA, 601 bp, Human
gtttgggccctgtacatagccctggtcaaactgcctgcagggcacactcagctgggctcttggggtggaagaagtgaagaacaaggaaacacccctcacacccatgcctacccagcagacccggcatggggcaggtgtgcagacaaggtaagtgtgtgctgcatgaacaggagaacaccatgcagatgccccttagtgctgacaaagccaagctcgattcctgcagagcactttgcatgcatccggcgtgcccatgggggccccaggtcatgaggaggtgcagggaccttcctgcacctgrgggtgccgagcgggatgtggccctgggtggggaggctggcctgaccttggcaggtgcacaggctctgccttgtcgttcaggtgcaaccaccaacgtaggctccgaggcaagaagggcgggctgggaaggctcctctcttcagtgacttggtctgggtctcacttctgcacagccctatcttacaggagaggagacccagcgcagaggccagagagacaggaaaagcggaggcaggaggatccaaccccaggcctgtctgatgtctgacgtgggagaatgaagcatacatgtttctcagag

SEQ ID NO: 124203 - DNA, 601 bp, Human
gcaccttaggtaggctcctggttacaaagggagggctaggccaactcagtaaagtttgggccctgtacatagccctggtcaaactgcctgcagggcacactcagctgggctcttggggtggaagaagtgaagaacaaggaaacacccctcacacccatgcctacccagcagacccggcatggggcaggtgtgcagacaaggtaagtgtgtgctgcatgaacaggagaacaccatgcagatgccccttagtgctgacaaagccaagctcgattcctgcagagcactttgcatgcatccggcrtgcccatgggggccccaggtcatgaggaggtgcagggaccttcctgcacctgagggtgccgagcgggatgtggccctgggtggggaggctggcctgaccttggcaggtgcacaggctctgccttgtcgttcaggtgcaaccaccaacgtaggctccgaggcaagaagggcgggctgggaaggctcctctcttcagtgacttggtctgggtctcacttctgcacagccctatcttacaggagaggagacccagcgcagaggccagagagacaggaaaagcggaggcaggaggatccaaccc

SEQ ID NO: 124204 - DNA, 601 bp, Human
tagacattgatgtctcacaattctccctggcaggggaagactgtgggaggtgccccagcaccttaggtaggctcctggttacaaagggagggctaggccaactcagtaaagtttgggccctgtacatagccctggtcaaactgcctgcagggcacactcagctgggctcttggggtggaagaagtgaagaacaaggaaacacccctcacacccatgcctacccagcagacccggcatggggcaggtgtgcagacaaggtaagtgtgtgctgcatgaacaggagaacaccatgcagatgccycttagtgctgacaaagccaagctcgattcctgcagagcactttgcatgcatccggcgtgcccatgggggccccaggtcatgaggaggtgcagggaccttcctgcacctgagggtgccgagcgggatgtggccctgggtggggaggctggcctgaccttggcaggtgcacaggctctgccttgtcgttcaggtgcaaccaccaacgtaggctccgaggcaagaagggcgggctgggaaggctcctctcttcagtgacttggtctgggtctcacttctgcacagccctatcttacaggagag

SEQ ID NO: 124205 - DNA, 601 bp, Human
agtgtatttgctgtaaagcaatgaaatctttacatcgttaaatttacttgtgccatgtaaatctctcagacagtcttgcattctgacctcttcggaagaaatgtttcccatacatgtgcttttaaaaactcttcacgtaatggaaattctcaaataaacataaaatggagaaaacagtacaatgagtccccgtgccccatcacacagtcccaagaatccccaaccttttctcaatctggtttcgcccaccctcttcctactctcccactcctcacccccaccctctggaatagtttaaagyacaaatcataggcatcgtggtcatgtcttcatttgtaaataccatgatatgcatcactagcaagaataacttttcctgaaactttaattccttattatcatctaccctgattctatactgatttgtaacagcgagataaaatagcacccagtgcctgctggagaacacgtaggtgctaatcatcatcctattcctctctcgttcttttgataaattggacttctttcctagattggtgggaatctggaaataatgctgttgaaataatctggaaaaacacagcacatgtgggttgctgct

SEQ ID NO: 124206 - DNA, 601 bp, Human
gtaaggctcagcacttctcgggcactgtttcgtttaatcctcccaccatccctgggcagaggacaggttggaggctcggagcatggaaatggcctgccgaggtccgcaatgaccagtggtggaagatggatctgagaagcaggccgctctagagctcagccttgtgttacactgggtcttgaaaaggaagcataagccaatatgcaccacacacatacacacacccacatatccacatgcacacacacacagatacatgtacaagtatacacatatacctaatgcccacatatacacacayacatatccacatagacatgcacatggacacacagatacatacaagcccacatacacacatacatacttatacacaatactctccctcacacatgcacacatatatacacccaagcacacactcccatacacacgtccagtaactgtctagagcaccttcagtcaaacgtaaaagaaactacgtgtctttttacactttaaacaaagtgtaaaatccctgtctctacgtgtcccacggcacattgagcatttactcctcacaagtgaagaactgaagtgtatttgctgtaaagcaatgaaa

SEQ ID NO: 124207 - DNA, 601 bp, Human
ttcagccaagtgaggcagcctctcagcagcaacattcctcaacaccccgaccctggctggcacccagcagaggctcccagcttttaatatttcatttaatttttatcttctaattacaacactttaaacaaaaaaatccaaccagaaatatcctgaagccagacacatgaaaaccactggccacagggctaaagagatcagatcaactatgggctgcctgtactgccttggagaggcttggagacctcaccaggttgggttgaggtgagggtggccctgagcttggaagacggccctgacrccaggctctgccccttccaggcaggtgagctcagtcaggctctgggtggaggagcttggactcagctccctcttccacaaaaggagaatctaaacactcacaataagagaatcatgttcatgctggtaaggctcagcacttctcgggcactgtttcgtttaatcctcccaccatccctgggcagaggacaggttggaggctcggagcatggaaatggcctgccgaggtccgcaatgaccagtggtggaagatggatctgagaagcaggccgctctagagctcagccttgtgttacactgg

SEQ ID NO: 124208 - DNA, 601 bp, Human
gggacccctgctcttgtggactggtcaaagcaagttctcagaaggcctgctgctctcttggatttcagccaagtgaggcagcctctcagcagcaacattcctcaacaccccgaccctggctggcacccagcagaggctcccagcttttaatatttcatttaatttttatcttctaattacaacactttaaacaaaaaaatccaaccagaaatatcctgaagccagacacatgaaaaccactggccacagggctaaagagatcagatcaactatgggctgcctgtactgccttggagaggcktggagacctcaccaggttgggttgaggtgagggtggccctgagcttggaagacggccctgacgccaggctctgccccttccaggcaggtgagctcagtcaggctctgggtggaggagcttggactcagctccctcttccacaaaaggagaatctaaacactcacaataagagaatcatgttcatgctggtaaggctcagcacttctcgggcactgtttcgtttaatcctcccaccatccctgggcagaggacaggttggaggctcggagcatggaaatggcctgccgaggtccgcaatga

SEQ ID NO: 124209 - DNA, 601 bp, Human
ctgacctcgtgatccacctgccttggcctcccaaagtgctgagattacaggaatatttttctaattttatgatgttttctgccagacagaaatttctaattttatgtgtatgcatcaagataattattttctttccaaatggttggccaattatcaataactcttattcaacacttcagtcttttcccaccagtttaaaacgctatccttagcatatctctgtggctttattaacggactatccgtactgttcccttgatcggtctattccagcaccagtgccagatcattttattatagwtaaaaaacacagttaaacacctgcattcattttttcagaatttctctagctattatctgtgcccattctttcagaataggttttccttgcattcctttaattttgttgcgatgttgatgaggactgtgttaaagtgacggctaacccttctttgtgaagaagagatatctcagtgatactgaatcctcccattcaggaacatagtctataggaaaaacccttaaaaccaagcatctattccaagtacctattgcatttcaaatgttctactgcagtggttcccaacctttttggcacaag

SEQ ID NO: 124210 - DNA, 601 bp, Human
agaccagaaaacctcaaacatttactatctgaccctttacagaaaaagttttccaacccatgggctagacagaagtgaaaaggccatctgtgaatcacttgagtttgtccaaaatattttataaatatttttctaatttttttttttttttttttttttttttacagacggggtctcactctgtcgcccaggctggagtgcagtggtgcaatctcagctcactgcaagctctgcctcccgggttcatgccattctcctgcctcagcctcctgagtagctgggactacaggtggccgccacygcgcccggctaattttttgtatttttagtagagacggggtttcaccgtgttagccaggatggtcttggatctcctgacctcgtgatccacctgccttggcctcccaaagtgctgagattacaggaatatttttctaattttatgatgttttctgccagacagaaatttctaattttatgtgtatgcatcaagataattattttctttccaaatggttggccaattatcaataactcttattcaacacttcagtcttttcccaccagtttaaaacgctatccttagcatatctctgtggct

SEQ ID NO: 124211 - DNA, 601 bp, Human
tgaatgaagttctgacatatgtctttgttgtttctgtggcaaaaatattacccaatatttacgctggaaagacaactgttcatgcatggcagccatcggctggttatggaaccagaattcggcaaaaatcaatgaaagcagtctctgagaatcaactggctaaatggaatttataatacaagcaatgtatattttattatttgtaaattgttggctaacatcctttatatcagtaaaatttataatgaacttatgtgatatgtcaatatctataaataatttcccccagagcactagttgttaaatatttaccagcaagcaggacaatataacttcatgggtggtgggaaaatggggacaggatgggatgcctcatataacagccaaataaacagccctcttaactaccatgaaacagaagactcaattcaactgaacatgtaaacagggcagagtggggacagcaaactaaggccaggacctaccgcctattttataaagtgaggtcagaacacagcacggcctctcatttacataatttccatggctgttttacactataatgggagagttgagtagttgtctcagagaccagaaaacc

SEQ ID NO: 124212 - DNA, 601 bp, Human
tatattttgtcattatctgtgcttcagggttactcacatctgttctatctacacaggggaagcactatctcatggtggctactggacccctcttttaccaacccgtcttcagtgacgtcacgtgagcagcttgaaattggccatggcgggatattcccatatggaaatcgacaaatgctacaaacaagggctgggtttactgttgattttctgggcttaagaaagtgatggagaaagcattaatactgcaggtataacttaaaaatgtttcgtgtctgtaggtattacactgtgaacagcwtacaaaactgaagagatattctttcagtatttgaaaattattttccaatttagcaaggaagttgttcccatccctggtgagtgaatgaagttctgacatatgtctttgttgtttctgtggcaaaaatattacccaatatttacgctggaaagacaactgttcatgcatggcagccatcggctggttatggaaccagaattcggcaaaaatcaatgaaagcagtctctgagaatcaactggctaaatggaatttataatacaagcaatgtatattttattatttgtaaattgttggctaac

SEQ ID NO: 124213 - DNA, 601 bp, Human
cacaaattgccccttcctcatgatctcactatattttgtcattatctgtgcttcagggttactcacatctgttctatctacacaggggaagcactatctcatggtggctactggacccctcttttaccaacccgtcttcagtgacgtcacgtgagcagcttgaaattggccatggcgggatattcccatatggaaatcgacaaatgctacaaacaagggctgggtttactgttgattttctgggcttaagaaagtgatggagaaagcattaatactgcaggtataacttaaaaatgtttcrtgtctgtaggtattacactgtgaacagcttacaaaactgaagagatattctttcagtatttgaaaattattttccaatttagcaaggaagttgttcccatccctggtgagtgaatgaagttctgacatatgtctttgttgtttctgtggcaaaaatattacccaatatttacgctggaaagacaactgttcatgcatggcagccatcggctggttatggaaccagaattcggcaaaaatcaatgaaagcagtctctgagaatcaactggctaaatggaatttataatacaagcaatgtat

SEQ ID NO: 124214 - DNA, 601 bp, Human
gaatattcacaaattgccccttcctcatgatctcactatattttgtcattatctgtgcttcagggttactcacatctgttctatctacacaggggaagcactatctcatggtggctactggacccctcttttaccaacccgtcttcagtgacgtcacgtgagcagcttgaaattggccatggcgggatattcccatatggaaatcgacaaatgctacaaacaagggctgggtttactgttgattttctgggcttaagaaagtgatggagaaagcattaatactgcaggtataacttaaaartgtttcgtgtctgtaggtattacactgtgaacagcttacaaaactgaagagatattctttcagtatttgaaaattattttccaatttagcaaggaagttgttcccatccctggtgagtgaatgaagttctgacatatgtctttgttgtttctgtggcaaaaatattacccaatatttacgctggaaagacaactgttcatgcatggcagccatcggctggttatggaaccagaattcggcaaaaatcaatgaaagcagtctctgagaatcaactggctaaatggaatttataatacaagc

SEQ ID NO: 124215 - DNA, 601 bp, Human
ccgaccagcactggcttaacggaactgattgtgaacattttcagaacctttgtgagctggttgttaaacacagtctttattaaacattaaattatagaagcttacaattgaataaattatactaaaaacaaaggtaatgaatattcacaaattgccccttcctcatgatctcactatattttgtcattatctgtgcttcagggttactcacatctgttctatctacacaggggaagcactatctcatggtggctactggacccctcttttaccaacccgtcttcagtgacgtcacgtgagmagcttgaaattggccatggcgggatattcccatatggaaatcgacaaatgctacaaacaagggctgggtttactgttgattttctgggcttaagaaagtgatggagaaagcattaatactgcaggtataacttaaaaatgtttcgtgtctgtaggtattacactgtgaacagcttacaaaactgaagagatattctttcagtatttgaaaattattttccaatttagcaaggaagttgttcccatccctggtgagtgaatgaagttctgacatatgtctttgttgtttctgtggcaaaaa

SEQ ID NO: 124216 - DNA, 601 bp, Human
gccgaccagcactggcttaacggaactgattgtgaacattttcagaacctttgtgagctggttgttaaacacagtctttattaaacattaaattatagaagcttacaattgaataaattatactaaaaacaaaggtaatgaatattcacaaattgccccttcctcatgatctcactatattttgtcattatctgtgcttcagggttactcacatctgttctatctacacaggggaagcactatctcatggtggctactggacccctcttttaccaacccgtcttcagtgacgtcacgtgarcagcttgaaattggccatggcgggatattcccatatggaaatcgacaaatgctacaaacaagggctgggtttactgttgattttctgggcttaagaaagtgatggagaaagcattaatactgcaggtataacttaaaaatgtttcgtgtctgtaggtattacactgtgaacagcttacaaaactgaagagatattctttcagtatttgaaaattattttccaatttagcaaggaagttgttcccatccctggtgagtgaatgaagttctgacatatgtctttgttgtttctgtggcaaaa

SEQ ID NO: 124217 - DNA, 601 bp, Human
ttgagatattagacataaaggtgtctgcctgtgtattagaatttttttatgccaaatattactttaattttaccccttggaaaaatgactttttagcatatggagaattcagatgatcactatttactgattagcaagatttagtcagaaaaatagtttgatttattaaacagcagttaaaccaatggcaattagaccggggggcctctgagccggccctgggaagaatgaggccaatgaaaaaagaatgcctggttgcgacgtatattcctggggaggactggagagtggctggcccccrcaagcataaagaggagctgggacgggtggggagcagtgcacgttgagccttggtcctgcaatgaatacgctccccttaaagtgtgcttgtcccaagagaaagacaaccctctacccgttcaattcccaatatgcagtggtgcgctgcagccgaccagcactggcttaacggaactgattgtgaacattttcagaacctttgtgagctggttgttaaacacagtctttattaaacattaaattatagaagcttacaattgaataaattatactaaaaacaaaggtaatgaatattcacaaa

SEQ ID NO: 124218 - DNA, 601 bp, Human
attttaaggctataacacagtatagcactctgtgattatctaacctctacagttgagatattagacataaaggtgtctgcctgtgtattagaatttttttatgccaaatattactttaattttaccccttggaaaaatgactttttagcatatggagaattcagatgatcactatttactgattagcaagatttagtcagaaaaatagtttgatttattaaacagcagttaaaccaatggcaattagaccggggggcctctgagccggccctgggaagaatgaggccaatgaaaaaagaaygcctggttgcgacgtatattcctggggaggactggagagtggctggcccccgcaagcataaagaggagctgggacgggtggggagcagtgcacgttgagccttggtcctgcaatgaatacgctccccttaaagtgtgcttgtcccaagagaaagacaaccctctacccgttcaattcccaatatgcagtggtgcgctgcagccgaccagcactggcttaacggaactgattgtgaacattttcagaacctttgtgagctggttgttaaacacagtctttattaaacattaaattatagaa

SEQ ID NO: 124219 - DNA, 601 bp, Human
tatttagtgatattatttaaatatttcttagtgatctgtaagcactctacattttaaggctataacacagtatagcactctgtgattatctaacctctacagttgagatattagacataaaggtgtctgcctgtgtattagaatttttttatgccaaatattactttaattttaccccttggaaaaatgactttttagcatatggagaattcagatgatcactatttactgattagcaagatttagtcagaaaaatagtttgatttattaaacagcagttaaaccaatggcaattagacckgggggcctctgagccggccctgggaagaatgaggccaatgaaaaaagaatgcctggttgcgacgtatattcctggggaggactggagagtggctggcccccgcaagcataaagaggagctgggacgggtggggagcagtgcacgttgagccttggtcctgcaatgaatacgctccccttaaagtgtgcttgtcccaagagaaagacaaccctctacccgttcaattcccaatatgcagtggtgcgctgcagccgaccagcactggcttaacggaactgattgtgaacattttcagaacct

SEQ ID NO: 124220 - DNA, 601 bp, Human
gccaccatgcccggctaatttttgtatttttatagagatagggtttcaccacgttggccagactggtctccaactcctgacctcgtgatccacctgccttggcctctcaaagtgctgggattataggcgtgagacaacgcacctggcctttagtttatattttatttggatactacaaatgttgactatcttgtgtttactggttatttgtatgttttctttacgaattgcttttcaggattttggcctatttagtgatattatttaaatatttcttagtgatctgtaagcactctacatwttaaggctataacacagtatagcactctgtgattatctaacctctacagttgagatattagacataaaggtgtctgcctgtgtattagaatttttttatgccaaatattactttaattttaccccttggaaaaatgactttttagcatatggagaattcagatgatcactatttactgattagcaagatttagtcagaaaaatagtttgatttattaaacagcagttaaaccaatggcaattagaccggggggcctctgagccggccctgggaagaatgaggccaatgaaaaaagaatgc

SEQ ID NO: 124221 - DNA, 601 bp, Human
ctgttgcccaggctggagtgcagtggcacaatctcggctcactgcaacctccacctccctggttcaagcaattctcctgcctcagcctcccgagtagctgagactacaggtgcacgccaccatgcccggctaatttttgtatttttatagagatagggtttcaccacgttggccagactggtctccaactcctgacctcgtgatccacctgccttggcctctcaaagtgctgggattataggcgtgagacaacgcacctggcctttagtttatattttatttggatactacaaatgttgamtatcttgtgtttactggttatttgtatgttttctttacgaattgcttttcaggattttggcctatttagtgatattatttaaatatttcttagtgatctgtaagcactctacattttaaggctataacacagtatagcactctgtgattatctaacctctacagttgagatattagacataaaggtgtctgcctgtgtattagaatttttttatgccaaatattactttaattttaccccttggaaaaatgactttttagcatatggagaattcagatgatcactatttactgattagca

SEQ ID NO: 124222 - DNA, 601 bp, Human
tcatcagtcccaggtctcccagcccgtcaccggtgcagccagcgtgggacccaggctcctctgcccctgcattcccgttctttaaatcacatcactctgtggccccgagtgcagagtgccatacagattcgtttcacacatttgttctaccatctctgcaactgctgcttgttggctttctatcatgattttgccttcttgtgttttcgtttattttttttatttttattttttctgagacggagtctctgttgcccaggctggagtgcagtggcacaatctcggctcactgcaacctccrcctccctggttcaagcaattctcctgcctcagcctcccgagtagctgagactacaggtgcacgccaccatgcccggctaatttttgtatttttatagagatagggtttcaccacgttggccagactggtctccaactcctgacctcgtgatccacctgccttggcctctcaaagtgctgggattataggcgtgagacaacgcacctggcctttagtttatattttatttggatactacaaatgttgactatcttgtgtttactggttatttgtatgttttctttacgaattgcttttcag

SEQ ID NO: 124223 - DNA, 601 bp, Human
cttcaactttcaggtttctgggaaggacagaaccaaagctgggattccacagaagcacagggtagagtcaggtgcactgggctgagctccaaagaaagccaagccctgtgggaacttcctgaatggctctgccccgggggcctgcaaaagtcctgaggagccaaggcaatgcttggcttatcatctcctcctggcagtttcaacacaaagcttttggttagcaaagttttgtttgtttttctcgggaaaagtgttgcttaagaagaagaaaggaagaatagaaatgtacctgctgagttcraaagtcagaagagttttcccttagggccagccaacccaatagcagcccagctttgcctccagcgcagcaaccctggattcagtgaattccaaattcctgggttctgtagaggtcgcagccaatttgattttcctcagaggcatggaggcaggtctctaccagcttctccaggctggaattttcccagagagcaaatggaccaattcctaaaggctgtggtaaaacacacacttgcagtggcaggtagggagaggggagaggagcctgggcttctgtgacaacctacacaggctgcgtgag

SEQ ID NO: 124224 - DNA, 601 bp, Human
cttcttggtgtttctgatgttataggcactatggacaaagattgtaatcctgaaacctttgaaactcctcataaaggatttgttcatatgaaaccttcctccatttgaatctccccaggcccgttgaagtagacactattattcccatcacacacgtgcagaaacagagactgagagattccgtgaccaggccaggaagcggccagctgaactcagaccacgcctgccagctgctctgctctgggctctccctaaacaccaccctgaggtccaaatcccgttcaggggctccagtgtctgyggcagcctggtctcctcccgccaccctcctgctcctctcactcaagtcgcctggataacgggtcagatttggttttcgtaactgatctgtgccccgatagcttattctgcaagttttggcaaaagcaccacagttctgactagaccttccttgatcctgtcttggcttcaactttcaggtttctgggaaggacagaaccaaagctgggattccacagaagcacagggtagagtcaggtgcactgggctgagctccaaagaaagccaagccctgtgggaacttcctgaatggctctgcccc

SEQ ID NO: 124225 - DNA, 601 bp, Human
gcaaggcctgacgacagcagggctgggccagtctggggagacacgcagtggggccagtgtgacatttgcggagtaaaacgtcatcaaaatacatgcttcgaggtatgaagtgtgaactatcatgtttgaaaagaacctgcttccctgggctttctggagtcttccaaaggtatagcagcaccttcgtgagacaccgtcacagcacaaggcagaacacagaattcgatatgtaactgacatgtgtaattggcttcaaggaagctcaatatcaagaaacacttcttggtgtttctgatgttayaggcactatggacaaagattgtaatcctgaaacctttgaaactcctcataaaggatttgttcatatgaaaccttcctccatttgaatctccccaggcccgttgaagtagacactattattcccatcacacacgtgcagaaacagagactgagagattccgtgaccaggccaggaagcggccagctgaactcagaccacgcctgccagctgctctgctctgggctctccctaaacaccaccctgaggtccaaatcccgttcaggggctccagtgtctgcggcagcctggtctcctcccgcc

SEQ ID NO: 124226 - DNA, 601 bp, Human
ctgctcctccccggtgggaacgtcagcagccattccaacgcccaggcttcaccgtgggggaggctgggggagccgaggcaaggaagtgagggctagatctctttactgggcaacaggcaaggcctgacgacagcagggctgggccagtctggggagacacgcagtggggccagtgtgacatttgcggagtaaaacgtcatcaaaatacatgcttcgaggtatgaagtgtgaactatcatgtttgaaaagaacctgcttccctgggctttctggagtcttccaaaggtatagcagcaccttygtgagacaccgtcacagcacaaggcagaacacagaattcgatatgtaactgacatgtgtaattggcttcaaggaagctcaatatcaagaaacacttcttggtgtttctgatgttataggcactatggacaaagattgtaatcctgaaacctttgaaactcctcataaaggatttgttcatatgaaaccttcctccatttgaatctccccaggcccgttgaagtagacactattattcccatcacacacgtgcagaaacagagactgagagattccgtgaccaggccaggaagcggccagc

SEQ ID NO: 124227 - DNA, 601 bp, Human
tgggaggtgcaatcccagggcaacaggagtggagggcagcaggaggaagcgctcggggttgacaaatggaaggagctgtgtttcaagctggctgcagctccacaaagaaacggggtggttgcttagctgggggaagtcttccaaacaggccttgtgagaccaatgtgccctcagacaggaagggcatacactttatgtcctgtctttccttgggtaaaccttccttctgggttgtgttacctgccccctccaggcagccagatgctggggaggcctgataccaagcctcacctggaagtgragggaaaagccacaacccccgcccccccggggtcccgctgggtcggaccggcccgcccctacgcctccgctgctcctccccggtgggaacgtcagcagccattccaacgcccaggcttcaccgtgggggaggctgggggagccgaggcaaggaagtgagggctagatctctttactgggcaacaggcaaggcctgacgacagcagggctgggccagtctggggagacacgcagtggggccagtgtgacatttgcggagtaaaacgtcatcaaaatacatgcttcgaggtatgaagtgtga

SEQ ID NO: 124228 - DNA, 601 bp, Human
caatcaacaactgcttgtgagccatgtccaaagtgctgagcctctgggggcgggagctgagagatccagctctggacttccaaaggcagccaaagttctaaatgtggtggctttggtcatctgtccctctgcagtatttcacagagattaccaaagctcttgttcaatctgccaccggaacacgtgttttagtccaggttccctggaaaacaagggactgaagtgaagcccatgggctgaagctttattgggaggtgcaatcccagggcaacaggagtggagggcagcaggaggaagcgcycggggttgacaaatggaaggagctgtgtttcaagctggctgcagctccacaaagaaacggggtggttgcttagctgggggaagtcttccaaacaggccttgtgagaccaatgtgccctcagacaggaagggcatacactttatgtcctgtctttccttgggtaaaccttccttctgggttgtgttacctgccccctccaggcagccagatgctggggaggcctgataccaagcctcacctggaagtggagggaaaagccacaacccccgcccccccggggtcccgctgggtcggaccggc

SEQ ID NO: 124229 - DNA, 601 bp, Human
ttatcttagaaatgaagattagctcaaaagagatgtcaataaaacacagatcaagatggctagcaataaaatgagaacagttatgctcttgggaaaaaagacattgttgaaagggccactgaaaggaaatcaagaattcatggaactttttaggatgaataaagggaaaacatggtcacacagaagagactaatctcttccccttcattaaacattttactgagtatgtacagctgaagacagaactggttaaaattatgtaagctcttgatttaaacaaggttcatgcttgcacgcacaygcattcatgcagtcaatcaacaactgcttgtgagccatgtccaaagtgctgagcctctgggggcgggagctgagagatccagctctggacttccaaaggcagccaaagttctaaatgtggtggctttggtcatctgtccctctgcagtatttcacagagattaccaaagctcttgttcaatctgccaccggaacacgtgttttagtccaggttccctggaaaacaagggactgaagtgaagcccatgggctgaagctttattgggaggtgcaatcccagggcaacaggagtggagggcag

SEQ ID NO: 124230 - DNA, 601 bp, Human
cagcagttggttgcatttctccccgagataagtggggatacatacttctttttttctcaaacgaggagagttttggggaaaggcgtcactgtcacggccccgtgaaagagaaaaggaggtaaagagattgactgcaatattaatgcaaatggggttaaaaatggaactttttgacaacagtgtgtatggtgactgtttggagagtgtgccaagttcttcagctctgtttccaaggaagtgggagtgatactctataattgcactttccagaaatgagagtttagtgacaaacttgaaagcyggcacagaaggcatgtgctttaaatctgtcttcctttctagcatcaagcacaggatagattgagccatcgaacacagattgcaaaatctcaactcttatcttagaaatgaagattagctcaaaagagatgtcaataaaacacagatcaagatggctagcaataaaatgagaacagttatgctcttgggaaaaaagacattgttgaaagggccactgaaaggaaatcaagaattcatggaactttttaggatgaataaagggaaaacatggtcacacagaagagactaatctcttcccctt

SEQ ID NO: 124231 - DNA, 601 bp, Human
tgaagtattataaaaatctataaaatgctgcttacaaaggatatttaatgacatagaaacatgcttgctatgcaagtaacaaaaagaaagaacaagttatacatgcagcacagttaggactctgtgaaatgtcaggggagaaaaagaccaagtagaaatgcctgtagagacgtagtttgaacacgaagtgtttctggaaataagtaataaagtcaaatgttcgaaaatcaaacacacttatctattctggggcgaacctggctgccagaatgccgaaccatgcaggcaacaggaatgcccragcgtacctcattcctaaaactgagggcaaatctgggaaaggggtttcaagagagctctccctcttcctcagatctgtcattttcattttcatcaatgtttagtattttatttgcaaaaattagctatgaggtgagacaaaggtcatctttttgttatgctttctactggagatacagaaccgactaaacaatactgtgattcataaatgtgcacagcagcagttggttgcatttctccccgagataagtggggatacatacttctttttttctcaaacgaggagagttttggggaaagg

SEQ ID NO: 124232 - DNA, 601 bp, Human
ggaaataattatcaaaactctggaggggaaatttaaaattatttttaaaaagtcaaaagtgaaacagcaggccagaaaaaaaatttatatgaattacgacacacacagggttattacaccaatattttaccaatattttacacagactacatacttatcagcttgatagcaacactgagcgctctcgcgaaagacaaaagggaattttcttttttcttttttttgagacggagtctcgttctgtcatccaggctggagtgaggtggcaaaatctcggctcactgcaacctccgcctcccgrgttcaagtgattctcctgcctcagcctcctgagtagctgggattataggcacccaccaccatgaccggctaatttttgtatttttggtagaggcggggtttcaccctgttggccaggctggtctcaaactcctgacctcaggtgatccgcctgcctcggcctcccaaagtgctgggattacaagcgtgagccaccacgccagaaagggcaattttcaaaagaaaaaacacagtgcacaaacatttgaaaaaaggttcacctttgttagtaatgatcacaatgtaagttaaggaagggtat

SEQ ID NO: 124233 - DNA, 601 bp, Human
tttccttgggtgcccctgaggtcccagtgttatgtggtctactaggtgggctccacagatgaagcagatgccttcaagcaaaagccggaccatgattctgttcacctctttggctgtgaacatttcaaccaacatttaaaattcttttctgtgggagggagatttcaagacacttgtcttctctgttgttggaaataaaagtccacgacatcttttaacattttgatcttgactttgttttggagtaatttgttagcaacttagaaaaagttttatatatcttttatttattttttagagrcactaatatttagactgaaaaaaaggcaaacagattatgaagaaaataaaatcaaacaaattgggacttttttaaaaaaggaaataattatcaaaactctggaggggaaatttaaaattatttttaaaaagtcaaaagtgaaacagcaggccagaaaaaaaatttatatgaattacgacacacacagggttattacaccaatattttaccaatattttacacagactacatacttatcagcttgatagcaacactgagcgctctcgcgaaagacaaaagggaattttcttttttcttttt

SEQ ID NO: 124234 - DNA, 601 bp, Human
ctacatatgaagctccaataacgctttttgccataacatttctgtttggctgatgaaggactggagaatcactaactcataaataaatatctcctccctccctcctctcctgctggagtttccccttggctgaactcaactataagccacaggcaagggagtctgtggggtggaggagtggagaatggatctggtgggtaaatgaaatatacctggcactacagaaaatacttttttttaatttgtattttttgagatggagtctcactgtcgcccaggctggagggcactggcatgaactggctcattccaacctctgccttctaggttccagtgatcctcctgcctcagcctcttgagtagctgggactactattaggcacacaccaccacatgcggctaatttttgtatttttagtagagacgaggtttcaccatgtaggccaggctgctcttgaatgcctgacttcaagtgatccgcccacctcagcctcccaaatacatttttaaatacattttttaaaaaaatccaatatgacaatttttgtctctcaaggggagcaacgagtctgtatgcctttagtgaaactactgaagttat

SEQ ID NO: 124235 - DNA, 601 bp, Human
attttatgtaaacgtgtcaattttgttaagttgtattttttcttggaatttgttcatttcacttagaattcctttgtcacataattttaatgtatataggatctataatcatgcgtttttcattcctgaaatcatatagtttcagctttttccttggtctacttacaagtttatcaattttattagtttctttcaagaaccagcttatggcattttaattttctctacatatgtttgttttctattttgttaatttctgctattttaaaaattccttctttcttcattctttatgttgttrgtttttttctatcatcttaagttggatgcttagcacattaattttcaggattttctcttttctgatatatgcaattacagccataaagttgtctaactacagctttagctgtatcttccttatttgaatatgtagtatttttattatcatccagttttaagtattttctaatataaattatgtttttttcttttaacacataaattatttagaagtatttttcaattttcaaatgtatggaaactttctaattatctttttgattttgatttctaacttaagtgtaatgtcagagaatag

SEQ ID NO: 124236 - DNA, 601 bp, Human
ccgtctcaaaaaaaaaaaaaaccaaactctggcttcattcaacaaagtggggactgtttccctatttttctactatctagaagaatttacagaacactgacattatttcttccatttaaatgtttggcagaatttgctggtaaattgctctggccttgagttttcttttaaattatagaatcaatttctttaataggacaattttaattttatgtaaacgtgtcaattttgttaagttgtattttttcttggaatttgttcatttcacttagaattcctttgtcacataattttaatgtayataggatctataatcatgcgtttttcattcctgaaatcatatagtttcagctttttccttggtctacttacaagtttatcaattttattagtttctttcaagaaccagcttatggcattttaattttctctacatatgtttgttttctattttgttaatttctgctattttaaaaattccttctttcttcattctttatgttgttagtttttttctatcatcttaagttggatgcttagcacattaattttcaggattttctcttttctgatatatgcaattacagccataaagttgtct

SEQ ID NO: 124237 - DNA, 601 bp, Human
ggcacggtggctcacgcctgtaatcccagcactttgggaggctgaggcgggtggatcatctgaggttgggagttggagaccagcctggccaacatggcaaaaccctgtctctgctaaaagtacacaaattagctgggtgtggtggcgcatgcctgtaatcccagctacttgggagactaaggcaggagaatcgtttgaatctgggaggcagaagttacagtgggctgagattgcaccactgcactccagcctgggcaacagagtgagactccgtctcaaaaaaaaaaaaaaccaaactctrgcttcattcaacaaagtggggactgtttccctatttttctactatctagaagaatttacagaacactgacattatttcttccatttaaatgtttggcagaatttgctggtaaattgctctggccttgagttttcttttaaattatagaatcaatttctttaataggacaattttaattttatgtaaacgtgtcaattttgttaagttgtattttttcttggaatttgttcatttcacttagaattcctttgtcacataattttaatgtatataggatctataatcatgcgtttttcattc

SEQ ID NO: 124238 - DNA, 601 bp, Human
catgcctgtaatcccagctacttgggaggctgaagcaggagaattgcttgaacctgggaggtggaggttgcagtgagctgacattgtgccactgtactccagcctgggaaacagagtaagaccctgtctcaaaaaaaaaaaaaaaaaaaaaaaaaaaagaagattgcttaaagcaaaaagtaatatcactgttttaagaaggagtttgtaacaaatacagaagtaaaatatacaacaccattacagcacaaatgaggaagtggagggggatggaattacactgttattagatccttttatytgagaagtgtaaagctgttcaatattaattctaagtaaagtgtaataaattaaggatgcatattgtaatccctagagcaccactcaaagtacagctaaaaagccaatagaggagataaagtggaatgctgacaaatatttgattaatctaaaacaaggcaggaaaagaggaacagagtatttcatctttttaatactgttggatttagttttcttgatattgggcttagaatttttgtatttatgttcttgagtgagattggctgaaaattctccattctcatatgtgctcttgggattt

SEQ ID NO: 124239 - DNA, 601 bp, Human
cagcattttgggaggccaaggtgtatgggtcacttgaggtcaggagttcaagaccagtccggccaacatggcgaaaacctgtctctactgaaaatacaaaaattagccgggcgcggtggtgcatgcctgtaatcccagctacttgggaggctgaagcaggagaattgcttgaacctgggaggtggaggttgcagtgagctgacattgtgccactgtactccagcctgggaaacagagtaagaccctgtctcaaaaaaaaaaaaaaaaaaaaaaaaaaaagaagattgcttaaagcaaaaartaatatcactgttttaagaaggagtttgtaacaaatacagaagtaaaatatacaacaccattacagcacaaatgaggaagtggagggggatggaattacactgttattagatccttttatctgagaagtgtaaagctgttcaatattaattctaagtaaagtgtaataaattaaggatgcatattgtaatccctagagcaccactcaaagtacagctaaaaagccaatagaggagataaagtggaatgctgacaaatatttgattaatctaaaacaaggcaggaaaagaggaacagagta

SEQ ID NO: 124240 - DNA, 601 bp, Human
actgaagagtagctgtttcccttaatttatttaaaagacaacacccttataatcccagcattttgggaggccaaggtgtatgggtcacttgaggtcaggagttcaagaccagtccggccaacatggcgaaaacctgtctctactgaaaatacaaaaattagccgggcgcggtggtgcatgcctgtaatcccagctacttgggaggctgaagcaggagaattgcttgaacctgggaggtggaggttgcagtgagctgacattgtgccactgtactccagcctgggaaacagagtaagacccygtctcaaaaaaaaaaaaaaaaaaaaaaaaaaaagaagattgcttaaagcaaaaagtaatatcactgttttaagaaggagtttgtaacaaatacagaagtaaaatatacaacaccattacagcacaaatgaggaagtggagggggatggaattacactgttattagatccttttatctgagaagtgtaaagctgttcaatattaattctaagtaaagtgtaataaattaaggatgcatattgtaatccctagagcaccactcaaagtacagctaaaaagccaatagaggagataaagtgga

SEQ ID NO: 124241 - DNA, 601 bp, Human
attacaggtgtgagccgcaccgcgcctggccaaaagtgtggggtttttttttttttttttcttgacaaagtcttgctctgttatccaggctggagtgcagtggtgcaatctcggctcactgcaacctctgcctcctggattcaagtgatcctcctgcctcagcctcccaagtagttaggattagtagttgggattacaggcgcctgccaccacgcctggctaatttttgtatttttagtagagatgaggttttaccatgttggccacactggtcttgaactcctcacctcaggtgatctgsccaccttggcctcccaaagtgctgggattacaggcatgagtccccatgcccggcctaaaaatttggtatttttaaagtgctggaataaatactcccaacccagaattctatatccagtgaaaataccattcaaaaatgggttgaagtaaagacattttcaaagaaaacaaagctgagcaaagtccttgccagaagcccagtttgataagaaatggtaaaggatgtgtttcaggctaagggaaatgatagcagatgaaaattcagatctacaggaaagaataaagagcactagaaatggta

SEQ ID NO: 124242 - DNA, 601 bp, Human
gctaggattacaggtgtgagccgcaccgcgcctggccaaaagtgtggggtttttttttttttttttcttgacaaagtcttgctctgttatccaggctggagtgcagtggtgcaatctcggctcactgcaacctctgcctcctggattcaagtgatcctcctgcctcagcctcccaagtagttaggattagtagttgggattacaggcgcctgccaccacgcctggctaatttttgtatttttagtagagatgaggttttaccatgttggccacactggtcttgaactcctcacctcaggtkatctggccaccttggcctcccaaagtgctgggattacaggcatgagtccccatgcccggcctaaaaatttggtatttttaaagtgctggaataaatactcccaacccagaattctatatccagtgaaaataccattcaaaaatgggttgaagtaaagacattttcaaagaaaacaaagctgagcaaagtccttgccagaagcccagtttgataagaaatggtaaaggatgtgtttcaggctaagggaaatgatagcagatgaaaattcagatctacaggaaagaataaagagcactagaa

SEQ ID NO: 124243 - DNA, 601 bp, Human
tttttttttttttttgagacagagtcacccaggctggagtgtagtggtgcaatctcagctcactgcaacctccgcctcccaggatcaagcgattctcctgcctcagcctcccgagtagctgggattacagatgccaccaccacacccagctaaattttgtatttttagtagagacagggtttcaccatgttggccaggctggtcttgaactccgaacctcaggtgatccacctgtctcagcctcccaaagtgctaggattacaggtgtgagccgcaccgcgcctggccaaaagtgtggggtttttttttttttttttcttgacaaagtcttgctctgttatccaggctggagtgcagtggtgcaatctcggctcactgcaacctctgcctcctggattcaagtgatcctcctgcctcagcctcccaagtagttaggattagtagttgggattacaggcgcctgccaccacgcctggctaatttttgtatttttagtagagatgaggttttaccatgttggccacactggtcttgaactcctcacctcaggtgatctggccaccttggcctcccaaagtgctgggattacaggcatgagtcc

SEQ ID NO: 124244 - DNA, 601 bp, Human
tggtttcttgatgttagacattgtccagtgatgtctcacctaggaagctgagaattcagttctcttacactatcttccacatactcacatgatccctctcccgcccccacctcccaatgttctaacaaaatttcttactgggtccaatatttattgtctttcccccaccaccctttcattttctgggagatttcctcaagtttatcttctaacatatctattgaattttgaatttttgacttatatttttaattttaaggcatttatgtgcttctcccaaattttttttttttttttttgwgacagagtcacccaggctggagtgtagtggtgcaatctcagctcactgcaacctccgcctcccaggatcaagcgattctcctgcctcagcctcccgagtagctgggattacagatgccaccaccacacccagctaaattttgtatttttagtagagacagggtttcaccatgttggccaggctggtcttgaactccgaacctcaggtgatccacctgtctcagcctcccaaagtgctaggattacaggtgtgagccgcaccgcgcctggccaaaagtgtggggttttttttttttttttt

SEQ ID NO: 124245 - DNA, 601 bp, Human
ttaagatgctccagcttttccaaagtaataaattaaatgtctggaaagtcaaaaactcttacaaggtttataacaaagaaagcagtcctccttcactccattctacctcttggagtccccctgactccccacctctttttaacactttgagttatttttctggcatttgcccttacattgctagacaaaaatactcatatgctatgtcctggtttcttgatgttagacattgtccagtgatgtctcacctaggaagctgagaattcagttctcttacactatcttccacatactcacatgmtccctctcccgcccccacctcccaatgttctaacaaaatttcttactgggtccaatatttattgtctttcccccaccaccctttcattttctgggagatttcctcaagtttatcttctaacatatctattgaattttgaatttttgacttatatttttaattttaaggcatttatgtgcttctcccaaattttttttttttttttttgagacagagtcacccaggctggagtgtagtggtgcaatctcagctcactgcaacctccgcctcccaggatcaagcgattctcctgcctcagcc

SEQ ID NO: 124246 - DNA, 601 bp, Human
gaaaggaggataagaaaaagagtacatatatgtgtgctccccatgtacacacacgtccatggatgcacatggacatgtgtgcacaaggcacccataacatgcacacccacactcacgtacttacctgagcacacacacatacacacatgaactctcagacccaggctaagaaaggggagatacaaggcttccctgtgctcctatagccacaaaaaccctgaaagatggtattttaaatgccaggaaaaggatcgaagaatcctaaacaaatatcctttcgggaaagaatgatcacctgtgwgtacaatggacaacacagcacttttcttaatggcatctataaggtcattctatcttttaagatgctccagcttttccaaagtaataaattaaatgtctggaaagtcaaaaactcttacaaggtttataacaaagaaagcagtcctccttcactccattctacctcttggagtccccctgactccccacctctttttaacactttgagttatttttctggcatttgcccttacattgctagacaaaaatactcatatgctatgtcctggtttcttgatgttagacattgtccagtgatgtc

SEQ ID NO: 124247 - DNA, 601 bp, Human
ccaggcactgagctaacaacctgcggagctgagagctgggagctccaaaaacgccagcagggaagaagcagtgggaccaaagcaaccccttcctgcatgtgcctccaaaagagacctttccttttctaataggtgcgatttgtgacacttgacctaaggttaggtttagacaatggtaatttgggagacatttatctctctctctctttttttttttttagatggtgtctcgctctgttgcccggctggagtgcagtggcaccatctcagctcactgcaagctccgcctcctgggttcacrccattctcctgcctcagcctcctgagtagctgggactacaggcgcccgccaccatgcccggctaatttttgtatttttagtagagatggggtttcagaatgtttgccaggatggtcttggtctcttgaccttgtgatccgcgtgcctcccaaagtgctgggattacaggcatgagccactgcacctggcctatctcccctttctagtacttaaatgcttttttcactttctcaaccaagggagtcactttggttttcctgcctttggaagacgtaaaaatgagaattccatacctatggc

SEQ ID NO: 124248 - DNA, 601 bp, Human
cagatcttagctgcatttgtaacaagggccagtggaatgaaatggtgttttgctcacacatggtttgtatttttgttctttctctcgatctgcaagatactcatgacagcctatgaggggccaggcactgagctaacaacctgcggagctgagagctgggagctccaaaaacgccagcagggaagaagcagtgggaccaaagcaaccccttcctgcatgtgcctccaaaagagacctttccttttctaataggtgcgatttgtgacacttgacctaaggttaggtttagacaatggtaatytgggagacatttatctctctctctctttttttttttttagatggtgtctcgctctgttgcccggctggagtgcagtggcaccatctcagctcactgcaagctccgcctcctgggttcacgccattctcctgcctcagcctcctgagtagctgggactacaggcgcccgccaccatgcccggctaatttttgtatttttagtagagatggggtttcagaatgtttgccaggatggtcttggtctcttgaccttgtgatccgcgtgcctcccaaagtgctgggattacaggcatgagccact

SEQ ID NO: 124249 - DNA, 601 bp, Human
ttgataaaattaaaagcaatttataaacttgtaaatttaccaaagatatttgctaggaacaagggatgagacgtctaagatgcatagaagcagatcttagctgcatttgtaacaagggccagtggaatgaaatggtgttttgctcacacatggtttgtatttttgttctttctctcgatctgcaagatactcatgacagcctatgaggggccaggcactgagctaacaacctgcggagctgagagctgggagctccaaaaacgccagcagggaagaagcagtgggaccaaagcaacccctycctgcatgtgcctccaaaagagacctttccttttctaataggtgcgatttgtgacacttgacctaaggttaggtttagacaatggtaatttgggagacatttatctctctctctctttttttttttttagatggtgtctcgctctgttgcccggctggagtgcagtggcaccatctcagctcactgcaagctccgcctcctgggttcacgccattctcctgcctcagcctcctgagtagctgggactacaggcgcccgccaccatgcccggctaatttttgtatttttagtagagatggg

SEQ ID NO: 124250 - DNA, 601 bp, Human
aagcgatcctcccacgttggcctcccaaagtgtaggatttactggtgtgagccacgcgcccagcctgtttgactttttgttaaaaccacaacatatgttacctgttcatatataaacattaaaactttttaaaagtttaatgtttaaaatctatgaataaagtggttgtatggtcaaaaaaccccattaaaaagcagtagtactcggggttttgatttttgtctctgaataagtaatatacaaggatggctcagaaatgcaaaagtataaaagtgcatatgacgaagtctccctccccatkggcaatgttggttccccgtttcttgtgtatcatttctgaagcattttattcttattcaagcaaatatgaacatatgtttccccatcctttttggtaacacacctgctagcactttctgcaccttgagttttccattaacagtgtatccttatgatccttccatggctgcacaggagagatgtagtgttgtttacttaaacaatcccctactcatggacgtttaggttgtttataaactttggcaattatagtcatgtgtagcttaactatggggatacctcctgagaaatgcaggtgatt

SEQ ID NO: 124251 - DNA, 601 bp, Human
taggctggagtacagtggtacgatcatggctcactgcagccccaacttcccaggctcaagccatcctcccacctcagcatcccaagtggctaggactacaggtgtgcaccaccacgcccggctactttttgtatttttggtagagatagagtttcactatgtttctcaggctggtctcaaactcctgagctcaagcgatcctcccacgttggcctcccaaagtgtaggatttactggtgtgagccacgcgcccagcctgtttgactttttgttaaaaccacaacatatgttacctgttcayatataaacattaaaactttttaaaagtttaatgtttaaaatctatgaataaagtggttgtatggtcaaaaaaccccattaaaaagcagtagtactcggggttttgatttttgtctctgaataagtaatatacaaggatggctcagaaatgcaaaagtataaaagtgcatatgacgaagtctccctccccatgggcaatgttggttccccgtttcttgtgtatcatttctgaagcattttattcttattcaagcaaatatgaacatatgtttccccatcctttttggtaacacacctgcta

SEQ ID NO: 124252 - DNA, 601 bp, Human; identical to SEQ ID NO: 25293

SEQ ID NO: 124253 - DNA, 601 bp, Human; identical to SEQ ID NO: 25294

SEQ ID NO: 124254 - DNA, 601 bp, Human; identical to SEQ ID NO: 25295

SEQ ID NO: 124255 - DNA, 601 bp, Human; identical to SEQ ID NO: 25296

SEQ ID NO: 124256 - DNA, 601 bp, Human; identical to SEQ ID NO: 25297

SEQ ID NO: 124257 - DNA, 601 bp, Human; identical to SEQ ID NO: 25298

SEQ ID NO: 124258 - DNA, 601 bp, Human; identical to SEQ ID NO: 25299

SEQ ID NO: 124259 - DNA, 601 bp, Human; identical to SEQ ID NO: 25300

SEQ ID NO: 124260 - DNA, 601 bp, Human; identical to SEQ ID NO: 25301

SEQ ID NO: 124261 - DNA, 601 bp, Human; identical to SEQ ID NO: 25302

SEQ ID NO: 124262 - DNA, 601 bp, Human; identical to SEQ ID NO: 25303

SEQ ID NO: 124263 - DNA, 601 bp, Human; identical to SEQ ID NO: 25304

SEQ ID NO: 124264 - DNA, 601 bp, Human; identical to SEQ ID NO: 25305

SEQ ID NO: 124265 - DNA, 601 bp, Human; identical to SEQ ID NO: 25306

SEQ ID NO: 124266 - DNA, 601 bp, Human; identical to SEQ ID NO: 25307

SEQ ID NO: 124267 - DNA, 601 bp, Human; identical to SEQ ID NO: 25308

SEQ ID NO: 124268 - DNA, 601 bp, Human; identical to SEQ ID NO: 25309

SEQ ID NO: 124269 - DNA, 601 bp, Human; identical to SEQ ID NO: 25310

SEQ ID NO: 124270 - DNA, 601 bp, Human; identical to SEQ ID NO: 25311

SEQ ID NO: 124271 - DNA, 601 bp, Human; identical to SEQ ID NO: 25312

SEQ ID NO: 124272 - DNA, 601 bp, Human; identical to SEQ ID NO: 25313

SEQ ID NO: 124273 - DNA, 601 bp, Human; identical to SEQ ID NO: 25314

SEQ ID NO: 124274 - DNA, 601 bp, Human; identical to SEQ ID NO: 25315

SEQ ID NO: 124275 - DNA, 601 bp, Human; identical to SEQ ID NO: 25316

SEQ ID NO: 124276 - DNA, 601 bp, Human; identical to SEQ ID NO: 25317

SEQ ID NO: 124277 - DNA, 601 bp, Human; identical to SEQ ID NO: 25318

SEQ ID NO: 124278 - DNA, 601 bp, Human
ccctccctgctgtgtgaagccttcccacgctcagacaccaggcctcctcgtggggctctttgcagagcagccctctgatggggtctggtctcaccacggactccgctgctctggagccccaggtgcagcatcgcttcagcctgggtgggaggtgggttttattcctagtgtgtctgaggatgctgagcctagagctcaagcccttggtctgtaattgtaaatgtgtaaaccccacaggcaaactcacacccacgagcctttctaatattcccatccaggccgccccagaggaaaggatggrgttagaggacttgccagagggggttgtgcacttgtgggaagccccatgggtctgcccccatcatgctgccccctccccacacctgcccttgcacattctggtggcccagccaccaaaccctgatgccccagtacaggttatgactttccccacagaccctctggtttctcttacagacaatgccactggtgagacgagaaccagggccgagctgagtcatttaaagagatgtcagtggtctggaggacccaggggcccagtgcccccaggccacggctgagggctgcttcatcagtgaag

SEQ ID NO: 124279 - DNA, 601 bp, Human
catgcctgggcctccctggggggcagttctttgctttatacagatgtcccctccctgctgtgtgaagccttcccacgctcagacaccaggcctcctcgtggggctctttgcagagcagccctctgatggggtctggtctcaccacggactccgctgctctggagccccaggtgcagcatcgcttcagcctgggtgggaggtgggttttattcctagtgtgtctgaggatgctgagcctagagctcaagcccttggtctgtaattgtaaatgtgtaaaccccacaggcaaactcacacccasgagcctttctaatattcccatccaggccgccccagaggaaaggatggggttagaggacttgccagagggggttgtgcacttgtgggaagccccatgggtctgcccccatcatgctgccccctccccacacctgcccttgcacattctggtggcccagccaccaaaccctgatgccccagtacaggttatgactttccccacagaccctctggtttctcttacagacaatgccactggtgagacgagaaccagggccgagctgagtcatttaaagagatgtcagtggtctggaggacccag

SEQ ID NO: 124280 - DNA, 601 bp, Human; identical to SEQ ID NO: 25319

SEQ ID NO: 124281 - DNA, 601 bp, Human; identical to SEQ ID NO: 25320

SEQ ID NO: 124282 - DNA, 601 bp, Human
cttgtgggtttgttttgttttttgttgttgttgttgctctacaaaagatttgtcccgcagtggacgggagcctcctcacggccgcccgcccgtctccgcagttctcctcagtgaccggaggctgccgcgcgccccgttctccagagaaacaatccccggagagaaagacggccagtgtgaaatatcagctgtttcacaaattctgaggtaaaagaaaaaaaaaaaaagaaggggtcgacccccacaggtggaaacagcaagtcctaacgtcctgggctgaagcctggggtgcgggcggcaragagtggcgtgtagggtacccgccgagtgccgccgccgatttccacaggctggcccgccggcacctccgacgcgcccgcagatccggcgcggagaccgtttgccagctccgggacgtcgggcagggacgggtcccagagccccaacccccccgccgccgcctcccggccggagaccacggtccctcccgccgcgcctcggggccgcgctgccgcgcaggtagccagctggccctcgggaggtggccctcgggtacccacgggagccggagcccagcggcgtcccgggccgcctgctccgc

SEQ ID NO: 124283 - DNA, 601 bp, Human
cagtcgtgggttttttgttcttgtgggtttgttttgttttttgttgttgttgttgctctacaaaagatttgtcccgcagtggacgggagcctcctcacggccgcccgcccgtctccgcagttctcctcagtgaccggaggctgccgcgcgccccgttctccagagaaacaatccccggagagaaagacggccagtgtgaaatatcagctgtttcacaaattctgaggtaaaagaaaaaaaaaaaaagaaggggtcgacccccacaggtggaaacagcaagtcctaacgtcctgggctgaakcctggggtgcgggcggcagagagtggcgtgtagggtacccgccgagtgccgccgccgatttccacaggctggcccgccggcacctccgacgcgcccgcagatccggcgcggagaccgtttgccagctccgggacgtcgggcagggacgggtcccagagccccaacccccccgccgccgcctcccggccggagaccacggtccctcccgccgcgcctcggggccgcgctgccgcgcaggtagccagctggccctcgggaggtggccctcgggtacccacgggagccggagcccagcggcgt

SEQ ID NO: 124284 - DNA, 601 bp, Human
cctgaattaagagtttacctgaggcaactatttccctatggacagggctgtttggacctgaccctcacattttatttctccatctctcttttgtttcacattagttgaatgaaattatcatttccccaaggcagagtcctcctgtgatttgttaggctggtttataataatgagtccatgtgtagacggcaagagtgacagtctgtttgccgataactaactatgtgaggtttgagaaggcccaaaattggaccctggagaaacaagtctgttctctgtttatacccaccctcttcggctraaataggcatgtgtccgtgcagagaaatggtgccacagtggaagcttggaatttccagaattaggaaaaggacttcaaagaatgacaagatatgcagaaataaggttttcaggtggaaaccagtttaaaaggaaaaagaaatgctttccagatgcttcttttgagcagaatccagttatctttaacatctctcagagaagtcatcaaaaataaagaaacaaaaactctgcagtagaacacttggaattacgtaattaaaagaaaagtaccaactccctaaaatcttgattttagatacta

SEQ ID NO: 124285 - DNA, 601 bp, Human
agaaaaaggacaacacttccggaagctgatgtacaactagaaaagaaatttgaggtttgagtatttggtaggatcacacaaataatctgtaggagaccatcaaactaatctaactatatgaaaaaatgttagaaccctgaattaagagtttacctgaggcaactatttccctatggacagggctgtttggacctgaccctcacattttatttctccatctctcttttgtttcacattagttgaatgaaattatcatttccccaaggcagagtcctcctgtgatttgttaggctggtttatmataatgagtccatgtgtagacggcaagagtgacagtctgtttgccgataactaactatgtgaggtttgagaaggcccaaaattggaccctggagaaacaagtctgttctctgtttatacccaccctcttcggctgaaataggcatgtgtccgtgcagagaaatggtgccacagtggaagcttggaatttccagaattaggaaaaggacttcaaagaatgacaagatatgcagaaataaggttttcaggtggaaaccagtttaaaaggaaaaagaaatgctttccagatgcttcttttgag

SEQ ID NO: 124286 - DNA, 601 bp, Human
gctaggcattttcaggtgatgcggaatagggctgtttaaaactgaggtgtacagtaaatagcaacagcattacctaatccattcaagaggctaccaaaaaacaggaaatgtgggagaaaaggttttgctcttgtaaactgtacagtataatacaaaaaactccatgtgattaacactcactttaataatgcatgcattctcaagggtgatgctatcatccccaaaggaataaaaattggtcttggggggtgaaagaattactctatgtataaacacagatgtacatacatacataaacctrtatcgcaatggtgtgatcctaaaatttctttggagaggcacaattaagaaaaaatgtctaaaatctccttaggtgtggaggttaatgaaaaaaaatcaagaaacactgttctaatgacagaaactattttactttttggttacagagtttctacttgcatatacacatacaaatgtattaaatacatgaacagtatacatctatgtaagtatacctatatacataattatatagttaccttgaatgtaagttaaaggatacaagtgagtgatggttgaatttacattacacactgtcaaa

SEQ ID NO: 124287 - DNA, 601 bp, Human
tactagttagttgtcattcttaagatattaaatcagttcctgaataactctaagttacttagaggtaacactacaggccaagagagggtgaaaaataaagttaccgtgggccacccatccatgcttgcattggtcacactgacggtggtttattttcccgggtttgaaactttggcaactacagttcagagtacagctgatagcctgaaaaagaggagaaaacaggtatgtggagcatgtaagtgatgtgtgaaacattcattgtatttcaaacaaaacatattcctccattcggcagcayttattgagcaatatgtgcccactgtgtgccaggcccagaagtgtatattgtactctggaaagatgagcagccacccctgcacctggagaccgtgaacacattacacagatattccacattcaagaatgagtttaaacatcagaactttttataagaaaagattatgggttagaatgaaatctcctgcactgttattaagctcatagaaagggtaaacatattttcaccaaatttctaagttgactaaagcagcaaccctggaaagtatacagaagctgtcttggaacaagtaaaagggag

SEQ ID NO: 124288 - DNA, 601 bp, Human
agaatctgggtttgggaatctgagagacctgagtttgagcgttagttgtggggcttgacattttctagttgtggggcttaacaaattaacccccctaaggccacgctgtccaatgtaatagccatcagtcacatatggctatttacatttagattaagttaaaattaaacaaaatttaaaactccattcctcagttacactagtcacatttcaagtactcagtagccacaagtgactactgtagagttgtcagatttggcaaataaaaaaagatgcccagttaaatccaaacgtaaatttgagataaacaatgaatgggtaggatatacatatactaaaaatattcattgggatatacctaggctaaaaaacaatctgttgtttatctgaaattcaaatttaactaagcgttctgtattttatctggcaatcctagcctagaggctgtaatagatagaacagaatacttctatcattacagaatgatagcaatgaagcactagtttctacatctttagaatgaggttaataagacacttcccatatagagtagttaagattcaagactctttgaatcttagcctgttacctgggacatgct

SEQ ID NO: 124289 - DNA, 601 bp, Human
gtctagcattagacataataattttccctgctaaaattaaaatatgtatcatttgaacaatagtaacttctttatctaaagagaatagatggaacaatcaggcctagatgcagctcaagtattcatttgctgcaagtttaataatcttcctaagcaactaacatcagaaaacaaatgaactgtattgatctactgcacacattcacaaagcagggctgtaattacactggagtgttggagatctttcaaactctagcaaggcctaacttttcccaaaactacaataaatattttatcacataacatgtatttgatggcctactgagatttttcacagtgcatgtaagagttttgaagatgatgaagaatgtaacatcataaatttttcatgcactagaggttcaaggtaattgattccatatttttaatcctaacactagaaagcaagattattaggatcattaaatattgatctatgtcctaacgtaaggtcataatgctactctacataaacggttgtttctagtctgctgggggtcctgcactagaggtgagcaaacatttttacaggggaagattatggtcttttgagttaaaaaga

SEQ ID NO: 124290 - DNA, 601 bp, Human
accagaaatcacagtccctgaaacaacctgccaatcacctttattcttttataacttaatatttaaaaaaccttcaatcaagcagtgattcttcctttcaaatgtagctgggtaactagaaataaaggaaaatattttattctatggatttcatattatcaaatgaaaatgagtcacgttttgggacgctatagtggcaatttaaaaagctcccttctcactcttattcaaatagttgtttacgctttactcaacctgctaatgtgacaactagttcatgtttttttttttttttttttttgagacagagtctcgctctgtcgctaggctggagtgcagtggcatgatctcagctcactgcaatctctgcctctcgggttcaaacgtttctcctgcctctgccttcccagtggctgggacatgactacaggtgcatgccaccacgcccagctaatttttctatttttagtagagacaggatttcaccatgttggccaggatggtctcgatctcttgaccttgtgatctgcccgccctggcctcccaaagtgctgggattacagggatgagccaccgcgcctggccatagttcatgatttct

SEQ ID NO: 124291 - DNA, 601 bp, Human
tgttgaactgcttcaagtcaagcttgtttctgcaaatgtagcattttaatattcagtgtaccatttaacatttatcatattccatttcatcaggcagctgatcttttccataagcctcctggggccatcttttggtatgcttgctcttccatttataggctagggaggaaggtgacctgaagagtggttaggtgactcaagttcatgaagaaaagcacaagcaagacagtaacaccactgctatccccacggtgatgagatatgctctatagcgggggactttgtaaacagtttgcctgcrtgtgtgtgtcatgaaaactcaggatctttcaaccagaaatcacagtccctgaaacaacctgccaatcacctttattcttttataacttaatatttaaaaaaccttcaatcaagcagtgattcttcctttcaaatgtagctgggtaactagaaataaaggaaaatattttattctatggatttcatattatcaaatgaaaatgagtcacgttttgggacgctatagtggcaatttaaaaagctcccttctcactcttattcaaatagttgtttacgctttactcaacctgctaatgtgaca

SEQ ID NO: 124292 - DNA, 601 bp, Human
tctacctctcccctccaactcttcctcttggcttctattttgattagttgagaccagtggttctcaaagtgtggtctgagcacccctagtgatctctgaggccctttcagggggttcctgaagtcaaagtttcataatactaagatattatttgcctttttcactttcattgtctcatgagtgaacagtggagtttttcagaggctacgtaacacaattttgcaacagagcatatgcagaagcagatatgagaatctagctgtcttctacgaagtcagacattaatgagatttacaaaaaygtaaaacaaagccactcatctcactaaatttttgctttggaaaatgtagggtttttttcataaacatatgttaatatataatttaaagttttacaatttttaaatttttaatttctaatatgataaattttgatagatataacccaaatagagaaaagctcttgagtaaccttaggttttaagtatttgtaaaggggttataagaccaaaacgtttcagagttactggtgtagacatatcccttcttccaggaagctttccttaacttctcaaggtgccctcccacaacagcctacattt

SEQ ID NO: 124293 - DNA, 601 bp, Human
gaaaggataatattttggatatactgaagttaaatgttattaaattttactgcatctgcttttttacagtggctataatatttaaaatttcatatgaagcttgcatcgtatttctattggatagcactggtcaagagcattgacatacacttcatcccaaaaattctaaaagtgtggttgagaatccaattggctagaattgtgtgtgtatgtagtttagttcatatttgtaacgtttcactatcctataccagacagaagttttgcaaatgcagcagaataagcataccaccaatcttcyacccaatgattactctcgaaggacagataatgagtatccattatgacacatgccttttagtcatatgttatcatttggaattaacttgtaaatcaatgttggtcttcctcagaaatcctctgctaacttttgacaagcaaaagtccttaccaagggggttacaatcttaaaggtgataggagaattattccaaatagagaaaacactcccccaatacatatcagaatgtatggcagagtcaagttgggaaaacaccttcaccaaaataactaagaattgaactttttaaatccccaaaga

SEQ ID NO: 124294 - DNA, 601 bp, Human
gtccaatgatagccactagccatatatggatactgaacacctgaaatgtggctagtatcatatgttgaaaggataatattttggatatactgaagttaaatgttattaaattttactgcatctgcttttttacagtggctataatatttaaaatttcatatgaagcttgcatcgtatttctattggatagcactggtcaagagcattgacatacacttcatcccaaaaattctaaaagtgtggttgagaatccaattggctagaattgtgtgtgtatgtagtttagttcatatttgtaacrtttcactatcctataccagacagaagttttgcaaatgcagcagaataagcataccaccaatcttccacccaatgattactctcgaaggacagataatgagtatccattatgacacatgccttttagtcatatgttatcatttggaattaacttgtaaatcaatgttggtcttcctcagaaatcctctgctaacttttgacaagcaaaagtccttaccaagggggttacaatcttaaaggtgataggagaattattccaaatagagaaaacactcccccaatacatatcagaatgtatggc

SEQ ID NO: 124295 - DNA, 601 bp, Human
atttttaaattaaattgaagaccattatttaagtgcatgagatatttttcccctagcttcttgaatgcatgttacagaacaagaattaacaaggaacatgttagaggccaacccaatcctctgagaactccctggggtaacatatgagacctctggtgcagggctgaggggagggacaattatccactccaaacacagggatggtctcaaaaaatcagtcttccaaactcaggtctggatttcaaactaattgaagaaggaactgaaaatgctgttttggggactggtatcttgtccacatagtcttcttccccaggacccttcttatccaagacctttaacactgcaagcctcatttaaagccacccccaggtcctgggcccactggtgtcgatctgcagacctggatctgtcccagggaacatgtaaacaaatctgggaaaaatcacatttctgcaagttttccttgtatcagtgaaagacctcttgggctaagaaaaataataggaagggctgccccagtgtcatcttcccacgaggtttgtcttttgctcattgtgctgtggaaaactataaagtcaaatcaaatacttttgcctga

SEQ ID NO: 124296 - DNA, 601 bp, Human
tccattgctaggccaaggcctgagagtgcaaccattattccaatataagtaagagccagaggtcttcaaatgaccttcagtgataacctctattaaatttctccagaccactaagctcttaactttctgatctgtcatgagaggagatgggaaacaattttcaatatcccttatgctgaacctgtgtgcccctgaagtagcctgcttttattcatccatttcacttctaaattgtgaagccccacctcttaacctctcaatgggaaatcattttcagtgcaaactgctgaatcatacctarttcctctccagccttcttaacccatggcacctcagttgggcataataaagacctggctcttggcaagttgaatacaaaagttacctctcattccttctctgctgcagttcagtttctaaaccacataactggattgcccaggaaaagaaaatgtggtagtcgcgagaaccaatttatgctaagacaaggaggtgtatttcacagggtgtgtctgttcatgacatccataccactctcacagcatttttgccagctgccttggcactataaaaacaagcaagcaggcttggagtgctatgt

SEQ ID NO: 124297 - DNA, 601 bp, Human
gcctgagagtgcaaccattattccaatataagtaagagccagaggtcttcaaatgaccttcagtgataacctctattaaatttctccagaccactaagctcttaactttctgatctgtcatgagaggagatgggaaacaattttcaatatcccttatgctgaacctgtgtgcccctgaagtagcctgcttttattcatccatttcacttctaaattgtgaagccccacctcttaacctctcaatgggaaatcattttcagtgcaaactgctgaatcatacctagttcctctccagccttcktaacccatggcacctcagttgggcataataaagacctggctcttggcaagttgaatacaaaagttacctctcattccttctctgctgcagttcagtttctaaaccacataactggattgcccaggaaaagaaaatgtggtagtcgcgagaaccaatttatgctaagacaaggaggtgtatttcacagggtgtgtctgttcatgacatccataccactctcacagcatttttgccagctgccttggcactataaaaacaagcaagcaggcttggagtgctatgtaaaccaattgaaaaaaa

SEQ ID NO: 124298 - DNA, 601 bp, Human
tttgcaagtaacttctagaaaattgtccaaccctttgttcacagtataattaaaaataagaaagtattaggttctttttctgactttcctccaaactgaaagttaaatgtctctaaaaaatagaaaaaaaaaaccttatctcctcttcaaaaatacctttgtcttttgataaatttaaacttaataagatagatatttcctgatatttctggccaccagctgtagaactgattttaagtctgaaggtaagttacaaagcaaataagattactgatattttgatgaagggttaaggtaaacraagaaagaaaaacaaggatgagaagaagagagaccctctcttgattatctttccattgtgcaaatggcagatggattcaaatgaaaaggcatatatatataataagctacttttctatcctcctttcttttcaaaatgttatacctgactctgtgtgtgtgtgagtgtgtgtgtgtgtaggtgttgggggggcctgtctatgaataggaactttgatgcataaagcctttaccatgaagttgagtcaccactacagcagtgctgtgcctctgtgcctcattcaaacatgtgtcactcagg

SEQ ID NO: 124299 - DNA, 601 bp, Human
ttcctaccactgcaataagaacccttgtgcccatttagaaatactctccattccaatctccaggattttttttttttttttgagacagggtcttgctctgtcacccaggccggagtgcagtggcatgatcttggctcactgcagcttgagcttagaggctcaagcaatctcccacctcatcctcccaagtagctgggactagaggcatccaccaccatgcccgactaatttttgtattttttgtagagacatggccatgttgcccatggctggtctccaacttgtgagctcaagtgatggkctcacctcagcctcccaaagtgctggcattacaggtgtaaaccaccatacctggcctgtcatctactttctatctctcaagatttaccttttctggtacagatattcaaatgctaaaattttgtgttacactaaatatttttattttctacatgtatgatctagttcaataatctaaatacccagttatttaatgtatagtaacttcatgtcttttttcctgttgaattttagggcagttttatggcttctgtataccctgcttcagctttgttattatactccactgctgcagaacagg

SEQ ID NO: 124300 - DNA, 601 bp, Human
atttctaatatagcacatagcatttcttatataaaataaaatgaagatcttgagtattgaaattttcttgttcattttccctttttaggaattttgagagtaaaaccagtgtggtataagcatccataatctttgttttttgagaacagttatataattacagaaaaatgtgaagatagtacagaaaattcctatatacgctgaacccaattacccctattattgacaacttacgttagtatggtacatttagttaatgaaccaatattaatgctttattattattattattattattatagtaaacttttttttaagttctggagtacatgtgcaggatgtgcatgtttgttacataggtaaacatgtaccatgatggtttgctgcacctatcaacccatcgcctggtattaagtcagcatgcattagttatttctcctgatgctctctgccaacacccccagctctcccccgacagaccccagtgtgtgttgttcctccccctgtgtccatgtgctcacattattcagctcccacttataagtgagaacatgcgctgtttggttttctgttcctgcgttagtttgctgaggataatggc

SEQ ID NO: 124301 - DNA, 601 bp, Human
ttctccttgcagtattcaagcaatcgggtatctcaaacccctaacacatggaggtccctgggaagtgcctaggaaaatgtcagtgaggctttggctgttctcccaaatcacatgcctagcataagttaagcttaaaggtaatagaaatattgttcagtttatctcacagtccatgagttagtcgattccgttaaactctgatttgcaaagtatcaatcactatgcatttaattggttttgtattcagctgaagggaagcagcatatactggaaatagcttgggccaaaaaaaaacctgaayatgaatccatttctgccacttgatagctctgtgaccttgggaaagataggaatcatttttggaaatcagtttgttcctctgaaaaagcaacatttgatttgccctattcagtagagattgctgggtacaagcagagtccatcaatgaatgcccatttggtggtgcgttttcatttaggatcataataactgtggtatctggtattatcctcagctagaactagggctcagagcagttaagcaactagcccgagagagactagttgcttagactgagagggactaagtggagtcagaattc

SEQ ID NO: 124302 - DNA, 601 bp, Human
tattaagcctccaagtcttcccagttattagagagtaaagtttgaggtcaaaggaactaaagccatcatgcttgtttgagaagaaaaacaaacggttttcaaaatctcctgaaaaaatcttgttacaattttttttctctttaaactgtagggagggaaaattctgcaaggttaaaaagaagaaatgaatacagtcagtactgaagaaataacagtctgcagtctcagcagagactagggtccaccactcaagctaaaaattagaaatgttaacaacaggtgctggagaggatgtggagamataggaacacttttacactgttggtgggactgtaaactagttcaaccattgtggaagacagtgtggcgattcctcacagatctagaactagaaataccatttgacccagccatcccattactgggtatatacctaaaggattataaatcatgctgctataaagacacatgcacacgtatgtttattgcggcactattcacaatagcaaagacttggaaccaacccaagtgtccaacaatgatagactggattaagaaaatgtggcacatatacaccatggaatactatgcagccataaaa

SEQ ID NO: 124303 - DNA, 601 bp, Human
tcatgcttgtttgagaagaaaaacaaacggttttcaaaatctcctgaaaaaatcttgttacaattttttttctctttaaactgtagggagggaaaattctgcaaggttaaaaagaagaaatgaatacagtcagtactgaagaaataacagtctgcagtctcagcagagactagggtccaccactcaagctaaaaattagaaatgttaacaacaggtgctggagaggatgtggagaaataggaacacttttacactgttggtgggactgtaaactagttcaaccattgtggaagacagtgtrgcgattcctcacagatctagaactagaaataccatttgacccagccatcccattactgggtatatacctaaaggattataaatcatgctgctataaagacacatgcacacgtatgtttattgcggcactattcacaatagcaaagacttggaaccaacccaagtgtccaacaatgatagactggattaagaaaatgtggcacatatacaccatggaatactatgcagccataaaaaatgatgagttcatgtcctttgcagggacatggatgaagctggaaaccatcattctcagcaaact

SEQ ID NO: 124304 - DNA, 601 bp, Human
ttctctttaaactgtagggagggaaaattctgcaaggttaaaaagaagaaatgaatacagtcagtactgaagaaataacagtctgcagtctcagcagagactagggtccaccactcaagctaaaaattagaaatgttaacaacaggtgctggagaggatgtggagaaataggaacacttttacactgttggtgggactgtaaactagttcaaccattgtggaagacagtgtggcgattcctcacagatctagaactagaaataccatttgacccagccatcccattactgggtatataccyaaaggattataaatcatgctgctataaagacacatgcacacgtatgtttattgcggcactattcacaatagcaaagacttggaaccaacccaagtgtccaacaatgatagactggattaagaaaatgtggcacatatacaccatggaatactatgcagccataaaaaatgatgagttcatgtcctttgcagggacatggatgaagctggaaaccatcattctcagcaaactatcgcaaggaccaaaaaccaaacaccgcatgttctcactcataggtgggaattgaacaatgagaacaca

SEQ ID NO: 124305 - DNA, 601 bp, Human
aacaacaggtgctggagaggatgtggagaaataggaacacttttacactgttggtgggactgtaaactagttcaaccattgtggaagacagtgtggcgattcctcacagatctagaactagaaataccatttgacccagccatcccattactgggtatatacctaaaggattataaatcatgctgctataaagacacatgcacacgtatgtttattgcggcactattcacaatagcaaagacttggaaccaacccaagtgtccaacaatgatagactggattaagaaaatgtggcacatakacaccatggaatactatgcagccataaaaaatgatgagttcatgtcctttgcagggacatggatgaagctggaaaccatcattctcagcaaactatcgcaaggaccaaaaaccaaacaccgcatgttctcactcataggtgggaattgaacaatgagaacacatggacacaggaaggggaacatcacacactggggactgttgtggggtggggggagggggaagggaaagcattaggagatatacctaatactaaatgacaagttaatgggtgcagcacaccaacatggcacatgtatac

SEQ ID NO: 124306 - DNA, 601 bp, Human
gacacatgcacacgtatgtttattgcggcactattcacaatagcaaagacttggaaccaacccaagtgtccaacaatgatagactggattaagaaaatgtggcacatatacaccatggaatactatgcagccataaaaaatgatgagttcatgtcctttgcagggacatggatgaagctggaaaccatcattctcagcaaactatcgcaaggaccaaaaaccaaacaccgcatgttctcactcataggtgggaattgaacaatgagaacacatggacacaggaaggggaacatcacacacyggggactgttgtggggtggggggagggggaagggaaagcattaggagatatacctaatactaaatgacaagttaatgggtgcagcacaccaacatggcacatgtatacatatgtaacaaacctgcgcgttgtacacacgtaccctagaacttaaagtataataataataaaattttaaaaaaaagataaaaaaaattagaaatgtttgtggattagaactaaggaggaagaatataaaggcccatataaccctatttttggccatctttactgaaataaaattggaaaagaagttttttt

SEQ ID NO: 124307 - DNA, 601 bp, Human
actgaaaacaagatgtaacatgaatttgagcgaatagcatatgaaatttatacatgtctgaatctgtaaagtttaatccactttattcccattttcactgcatgttgatgaccactaaatgttgccccaagggtctatgctcaaaacattacccaaattggaatggaaagaatcccaagaaaccctctttgtccataatcattatgattaatccatttcaagggagagattagcgccttagtttcttctattaaaatcctattcatgagccattggcttcttttccccatgtgtgggcttagatctctctcattctgacaaaattttgagcttggcaaatcaaaactataatctgggccccccaaaattgcacacttgtaaaagacagtaatgtttataatctttgttttcttgtttgcaatttacagactgtacagaacatttaaggacagcaaatatttgtatatgttgatggaagcttgtctaggtggagagctctggaccattctcagggataggtaggagatttaagaaatttctatgatatctctaaaaacagttgcccatgttggtctataagaagagttaatatgataaagta

SEQ ID NO: 124308 - DNA, 601 bp, Human
taactagcaaattatctaattatcttctaatataatttatcctataaaatgtctcaggagatcattatctaccctgtgtttttttaaaaacacacttttattttcctatgaataatcttttgattattttccatgaatgatttattgatcatacaaaagtcatctttgttcttttgaacactcacatttagacatctgtatttttcttatttgtttgagtcctgcctcccagactctccttcacagggtagcatccttctgaaacttagctataggtagccctgatgtatataaccatgtratgtttttatatttgttactttgcagataccccagaataaaacaagtggttccttatgaactgttgatttaaattctcattcctaatggtgttcttatggtaccttcatatctttgtacaacaggccctttcgtgttattcccatggcctttcttatatatgccaaatggatttcttgttaccacattgtatcctattgcatcggtattttatttcaattcttaaatttaaggttaaaaaagcataaaagggaatgtaatcatgttggcattaggcgataaggttaacatctatactaag

SEQ ID NO: 124309 - DNA, 601 bp, Human
ggtctgtttgcttcgtggtgaaaaagggagagctttgattggcaggcaataaaagggtaattttggcccatgtgagaagcatggggaaagtgaaaagaacagagattagcaaaggattcttcagagttgatttgtggcagttagccttggcagtcagaagcacttaaataacagagaggattggtgttccaaacccccaacctccaccctgaaaatacttcatccctattctatactatgttagttaattttactatattaagacatagtagctaaaaaatagttttctggtgctcaatcrtagtggctactattacatttagtgagcacaagttgtgtaccaggcacttattttcagtacatgcattattaattctttggatcttcacaacaacccagtgagatagttactgttattagccccattttgcacatgagaacacagaaacacagagacatatagttaattgctcaagaacaaacagtaaatggagtctggagttgagcccaggattcttgcttcagggtccatattctaacatatagcctcctcccatgaatttgagtttgtattagcatttttccatctttctgctaatga

SEQ ID NO: 124310 - DNA, 601 bp, Human
ttagtagctgaaatgaagacattctctttctggaagacactacctatttctgaaagcctgaaaagtggctgctttagccttgattcacttatgaattttgtaaaaatgtaaccatattccactgcccagtttgttaaactttactccacaattttgaaaaaaaaataagtgtcaccaaaatgcaaacaggcatcagagactcatgaaagcaagctctgaagctatcatttgttgtacactgtctattaataaaatcacttgtgtgcttgtcactcatgttatatctcaaccacctcaggcrctgatgttcacactaatatttttgaattatgaaatgaaattattaaattgtgcttactactcgggaaagaaaaaaaaagtacatggtttatctctttaagaagtaccatgaaaaaaaaaaagaaaaatagttaaagttaagacgttctgccctagaacaaagggtttaaccttagatgccaaggttttttctaaattatttcattcaatcaatcaatcaacatatatatgcccatatatcatatatatgagacagagagagccttcttgctaaacataataatcaagattactaataaac

SEQ ID NO: 124311 - DNA, 601 bp, Human
acaaaacacacctgccaaacactatgaagtatggcatgtgactaggaatgatgcttggaccacaagcatgactccaaagtattttggtcctgaatgtcatatctaatgatcttcgatagtaataatgacatttagaggactggctggaccttgaaaaagcaaagactgttcatgcagagacctaattaagcactacagaatgaaagaggaactgaggtgaaggaagattcatacaaatgtaccaattctgccttttaaggcttataatgttggtcagtgaagcagggagtgaaaagggggagagaggcagtgattaatgatttcagagaatgtggtggggctttgtatgagccacatgacctccctgaatgttttaaattgagggcaaaggaaataaatgatctggttataaggcaacaaacagtagtgaaggctggtgaatttctcattgcttccttccctccaactttccctgttctattcttcatggtaggcggcccaatctaaggataagtaatggtcagaaagggtcccagggaagccagtccctgcccctcttacaaccccagcccccttccatgcatacacaccaactcctttc

SEQ ID NO: 124312 - DNA, 601 bp, Human
gttttaaattgagggcaaaggaaataaatgatctggttataaggcaacaaacagtagtgaaggctggtgaatttctcattgcttccttccctccaactttccctgttctattcttcatggtaggcggcccaatctaaggataagtaatggtcagaaagggtcccagggaagccagtccctgcccctcttacaaccccagcccccttccatgcatacacaccaactcctttcttactgattttgctcaaggatccatctcccccaccaacttaggaaaagatgaatttatctccagttttargttttgattcagctcgtctattccagtcacatggcattcctctagtgattggcatttattggactgggtacataaattagaggaataattttaaaatacattattggaggagaattcttttttcctacagtagctactcagtaaataattactgaatgaatataagtccttatttccactggtagacttcctataactatgaggggaaacagccatgatgaaactaatagtgactatggcagaatgaaaagctggaaccactgatcctaccagtctagaatttgccctacctctggaaag

SEQ ID NO: 124313 - DNA, 601 bp, Human
tggaggagaattcttttttcctacagtagctactcagtaaataattactgaatgaatataagtccttatttccactggtagacttcctataactatgaggggaaacagccatgatgaaactaatagtgactatggcagaatgaaaagctggaaccactgatcctaccagtctagaatttgccctacctctggaaagtgcttttgtgagttcaatgtttttcttattttaatcagtttgagctgatgttttccatttatgtcagctgaaagatgcaaaagtaaaagaaagctaaagaacacmcaagaaaaatgaatcaaggaaatataggaggaagtgtttagataaactcttatctataatttctttgaggctatcaaaagcatgatctccctaaaaagtaacctctaagatatttgcaagtgttcataaatgagaagacaagtaactagcagagctcaggaccattacagaactgaaagtcatgctgtaagtaagagaaaataaaatagtaacaattaaaaatgcagcaagggagatagtagacaggcttggaaaatataatgaaaaaagaaaaaatacatagatatgatttcagaaaga

SEQ ID NO: 124314 - DNA, 601 bp, Human
aaattcaaacacgacatataaagtgtggaccccaggcctttctcaaaaacactactattcaatcaagcccacaaaaagatgaatcaaaataaagcattcaggaatagaaaaactagtaaaaagattgatgagctttgggtctaattaattagaacttagatcaaataatttaaatttgggtaattgaacagaatgtaaatattgtagtctttggcaatcttaaaataacactaaaaccaacaaaaattaaggtgggaggtaaagcaggtataactataggtatacttatttctcatcattwataattagtaatcttacatatattttatagttaaaacatgtcattacagaagagaaatctctaaattcagtttgattttttttttaattttagagaaatattttaggaattaatattggttaagaagcacacatatctgaaatttagcatttctctccattttactcctcagtttagctaaagtaaaattaaatcgaatacttctaaatttaaaaatatgcataatataatcctgtgtgtctacaatctacatatagaagtctatgaaattatgttcatcaaatgtagagcattctgaat

SEQ ID NO: 124315 - DNA, 601 bp, Human; identical to SEQ ID NO: 18336

SEQ ID NO: 124316 - DNA, 601 bp, Human; identical to SEQ ID NO: 18337

SEQ ID NO: 124317 - DNA, 601 bp, Human; identical to SEQ ID NO: 18338

SEQ ID NO: 124318 - DNA, 601 bp, Human; identical to SEQ ID NO: 18339

SEQ ID NO: 124319 - DNA, 601 bp, Human; identical to SEQ ID NO: 18340

SEQ ID NO: 124320 - DNA, 601 bp, Human; identical to SEQ ID NO: 18341

SEQ ID NO: 124321 - DNA, 601 bp, Human; identical to SEQ ID NO: 18342

SEQ ID NO: 124322 - DNA, 601 bp, Human
gctgaggcaggagaatttctggaacccgggaggcggaggctgcagtgagccaagatcgcaccactgcactccagcctgggcaatagagtgagactctgtctcaaaacaacaacaacaacagcaacaaaaccccaaaaaacaaaaacaaaaaaacccgcttttctgaaaaagaaatgtctatggattaggaaggtctgcctcccataggaagatgcaggtattgcacgtagcccaaatatttgatgattccaggaccggcagatacacaagttatgaaactgtttgtaccttgaagaataasgagaagaggaggagaccaagaggaatagaagaaaaagaatagaaggaggaggaggaagaagggaaggaggactagaagaaaactacaataataacaacattgttgagaccacaagatcacgccactgggttttgctttatattttggaaaacactgtcacatccattttactaaaagccatgtatcattattgtagtccccagattgtcagggatccaaatattactgccttcttggtttctacaaacagagcacaggctggctgtgttcccattggtgtacactattgtgtcctggtcc

SEQ ID NO: 124323 - DNA, 601 bp, Human
caagactctgtctcgaaaaaaaaaaaaattcagcatcacttatacccgtttcacaaagacagaaaggaagcccagagggaccagcattgtaatttgcccaaagacacagcatgagtacgtgtggcctccaggatccacacccacacctgcccaaatcttatcacctaaatctcatcatcacccaaccccattgccacccactgcctagcactgcctgcccaagcagtcagttactccactcactcacagcatcctctcagtcagtggatagaaaaccgtaaaaggctaacaaagaactaarcacaaattaaattataaatatattgtaaaataaatttgtaaagttgaattaacttagtgttgtaattcttaacaagaataacaagaagctttcagtagaggttagatattaatgttttccccaaaacttaaagcacttttcggggctgggcatggtggctcacgcctgtaatcccagcactttgggaggctgagtgaggtggatctcctgaggtcagaagttcgagaccagcctggccaaaatggtgaaaccctgtctctactaaaaatacaaaaattagccaggtgtcctggcgcatgc

SEQ ID NO: 124324 - DNA, 601 bp, Human
tacaaaaattcacggccaggcgggcacggtggctcacacctgtaatctcagcactttgggaggccgaggtgggtggatcacctgaggtcaggagttcgagaccagcctggccaacatggagaaaccccgtctctactaaaaatacgaaaattagccgggcctcgtgccacatgcctgtaatcccagctactcagaaggttgaggcaggagaatcgcttgaactcgggaggcggaggttgcagtgagccaagatcgtgccactgaactccagcctgggcaacagggcaagactctgtctcgaaaaaaaaaaaaattcagcatcacttatacccgtttcacaaagacagaaaggaagcccagagggaccagcattgtaatttgcccaaagacacagcatgagtacgtgtggcctccaggatccacacccacacctgcccaaatcttatcacctaaatctcatcatcacccaaccccattgccacccactgcctagcactgcctgcccaagcagtcagttactccactcactcacagcatcctctcagtcagtggatagaaaaccgtaaaaggctaacaaagaactaagcacaaattaaattat

SEQ ID NO: 124325 - DNA, 601 bp, Human
gcaagcacctggtctaacctgtttctataactgaatctagcgcaaggcccagctcacaggagaagcaaaacagtgatgcgtacaacaagggatccacgcatgaatgcaactgccatttattcagaattatctcatgcttggctgcgtgattaaaaatttacagagcgtcggccgggagcggtggctcaaacctataatcccagcactttgggaggccaaggtgggtggatcacgaggtcaggagtttgagaccagcctggccaacatggtgaaacccccatctctactaaaaatacaaaaaaaataaataaataaataaataaataaataaataaataaaaattagctgggcgtggtggtgcacacctgtaatcccagctactcaggagactgaggcaggataatcgcttgaacccgggaaggctgaggttgcagtgagttgagatcacgccactgcactccagcctgggcaataagagtgagactccatctcaaaaaaaaaaatttacagagtatctctcatctttacaaaaattcacggccaggcgggcacggtggctcacacctgtaatctcagcactttgggaggccgaggtgggtg

SEQ ID NO: 124326 - DNA, 601 bp, Human
ctctccctggaattctcttccccagatgtgtccttggacatcaccatccactcatccaagtctcagctgaaacagcacctgctcctacaggctgccttggggggcttacaggccactgcccctgggcaggccatctatgacagcattcagctgttgtgaatattttgttgttctttgcagcaatgaccactttctcatacctctgatatatctttagtcttgttctttgtgtccttcattagaaaataaggtccacaggagcaagcacctggtctaacctgtttctataactgaatctagygcaaggcccagctcacaggagaagcaaaacagtgatgcgtacaacaagggatccacgcatgaatgcaactgccatttattcagaattatctcatgcttggctgcgtgattaaaaatttacagagcgtcggccgggagcggtggctcaaacctataatcccagcactttgggaggccaaggtgggtggatcacgaggtcaggagtttgagaccagcctggccaacatggtgaaacccccatctctactaaaaatacaaaataaataaataaataaataaataaataaataaataaataaaa

SEQ ID NO: 124327 - DNA, 601 bp, Human
ccttacttttcaatcatctgactcctctgggagtcacctccggcatcttctgaatttatccatctttaacctacctctccctacccacagcctcccctcaacctctgagccagaggacgtttctcccacttaagggaaagcaccctttccctcctttggccttccagagcccttcatccatctctctctgcacctctcctttcccgtccgggcttatagtctcctgtgtgtgtctccccaggcctctcagaggtacagagggtcacaggtctcttctgacaattgagtgagtatgaaaaaygcaccaccgtcacgtgcatcttgggtgtgtgtgtaaggggaagggggttcttccttggttgctgtagactccccatggaagctacagcctctcctttcctcagccccatttcagaaaggagaggccagaaagcgtttctgatgcttgcggtctctttagaggattcaccctgttcccttcactcaatcccaaccccgtgtcaccagatgtattcacccctacgcagggggaggtcagtctttgcaagcttctgacacattttgggacactgagctggaatatgggggtgctggggtggat

SEQ ID NO: 124328 - DNA, 601 bp, Human
gcactttgggaggccaaggtgggcggatcacttgagcccaggagttcgagaccagcctgagcaacatggcgaaactctgtctctaccaaaaatacaaaaatatagctgggcgtggtggtgtgcgcctgtaatctcggctactggaaaggctgaggcaggaggatcgcttgaactcaggaggcagagggtgcagtgagccaagatggcaccactgcactccagctggggcgacagagcaagaccctgttccaaaaaaaaaaaaaaatcataaaaccaaaaaacctctgaggaaaggggaacrctgaaaaaaaatcaaatacacatggatcaaaacacagaactttgttttcaaacttaaaagttttagcttatatctgaatagttactcaaatattttagagaatattatgtggaagccgagtttcagtagtgtcgaacagtcctagtggtccttggagtttaccataaatacatttttttattattcaaaaataatggctaccagctgacatctggatagcacctgctttgtgccaagcactgttctcaggactttccactttttacttgtgaatcacagcaattctatgactgttcccat

SEQ ID NO: 124329 - DNA, 601 bp, Human
cctataatcccagcactttgggaggccaaggtgggcggatcacttgagcccaggagttcgagaccagcctgagcaacatggcgaaactctgtctctaccaaaaatacaaaaatatagctgggcgtggtggtgtgcgcctgtaatctcggctactggaaaggctgaggcaggaggatcgcttgaactcaggaggcagagggtgcagtgagccaagatggcaccactgcactccagctggggcgacagagcaagaccctgttccaaaaaaaaaaaaaaatcataaaaccaaaaaacctctgargaaaggggaacgctgaaaaaaaatcaaatacacatggatcaaaacacagaactttgttttcaaacttaaaagttttagcttatatctgaatagttactcaaatattttagagaatattatgtggaagccgagtttcagtagtgtcgaacagtcctagtggtccttggagtttaccataaatacatttttttattattcaaaaataatggctaccagctgacatctggatagcacctgctttgtgccaagcactgttctcaggactttccactttttacttgtgaatcacagcaattctat

SEQ ID NO: 124330 - DNA, 601 bp, Human
gaggctagttgtggtagttcatgcctataatcccagcactttgggaggccaaggtgggcggatcacttgagcccaggagttcgagaccagcctgagcaacatggcgaaactctgtctctaccaaaaatacaaaaatatagctgggcgtggtggtgtgcgcctgtaatctcggctactggaaaggctgaggcaggaggatcgcttgaactcaggaggcagagggtgcagtgagccaagatggcaccactgcactccagctggggcgacagagcaagaccctgttccaaaaaaaaaaaaaaaacataaaaccaaaaaacctctgaggaaaggggaacgctgaaaaaaaatcaaatacacatggatcaaaacacagaactttgttttcaaacttaaaagttttagcttatatctgaatagttactcaaatattttagagaatattatgtggaagccgagtttcagtagtgtcgaacagtcctagtggtccttggagtttaccataaatacatttttttattattcaaaaataatggctaccagctgacatctggatagcacctgctttgtgccaagcactgttctcaggactttccacttttta

SEQ ID NO: 124331 - DNA, 601 bp, Human
tagcttgaattaatcatttcagaatgtatatatacatcaaaacatataaaccataaataaatataatttttatttgtcaatttaccttagtaaagctgggtaaaaaattaaaaaatatatgtaaacatgttcaataaattggaactggtttctgggaagattaatatggtaatactaagtagaagatgcttgggtgataagttatttgtaaattatttcaataaaactctgaggctagttgtggtagttcatgcctataatcccagcactttgggaggccaaggtgggcggatcacttgascccaggagttcgagaccagcctgagcaacatggcgaaactctgtctctaccaaaaatacaaaaatatagctgggcgtggtggtgtgcgcctgtaatctcggctactggaaaggctgaggcaggaggatcgcttgaactcaggaggcagagggtgcagtgagccaagatggcaccactgcactccagctggggcgacagagcaagaccctgttccaaaaaaaaaaaaaaatcataaaaccaaaaaacctctgaggaaaggggaacgctgaaaaaaaatcaaatacacatggatcaaaacac

SEQ ID NO: 124332 - DNA, 601 bp, Human
atgagatcttaaatgttcttatcacaaaaaaaacaagtgtgtgagatgatggtgtgttaattagcttgaattaatcatttcagaatgtatatatacatcaaaacatataaaccataaataaatataatttttatttgtcaatttaccttagtaaagctgggtaaaaaattaaaaaatatatgtaaacatgttcaataaattggaactggtttctgggaagattaatatggtaatactaagtagaagatgcttgggtgataagttatttgtaaattatttcaataaaactctgaggctagtygtggtagttcatgcctataatcccagcactttgggaggccaaggtgggcggatcacttgagcccaggagttcgagaccagcctgagcaacatggcgaaactctgtctctaccaaaaatacaaaaatatagctgggcgtggtggtgtgcgcctgtaatctcggctactggaaaggctgaggcaggaggatcgcttgaactcaggaggcagagggtgcagtgagccaagatggcaccactgcactccagctggggcgacagagcaagaccctgttccaaaaaaaaaaaaaaatcataaaacc

SEQ ID NO: 124333 - DNA, 601 bp, Human
ctgctcataggatgatggctgtgagattcaaaggggcttacaacagtgcccgtcatttaggaactggtgtagaattgtttttcattcatattttattgaacatttcctgaaagttgctaaacaatgagatcttaaatgttcttatcacaaaaaaaacaagtgtgtgagatgatggtgtgttaattagcttgaattaatcatttcagaatgtatatatacatcaaaacatataaaccataaataaatataatttttatttgtcaatttaccttagtaaagctgggtaaaaaattaaaaaatrtatgtaaacatgttcaataaattggaactggtttctgggaagattaatatggtaatactaagtagaagatgcttgggtgataagttatttgtaaattatttcaataaaactctgaggctagttgtggtagttcatgcctataatcccagcactttgggaggccaaggtgggcggatcacttgagcccaggagttcgagaccagcctgagcaacatggcgaaactctgtctctaccaaaaatacaaaaatatagctgggcgtggtggtgtgcgcctgtaatctcggctactggaaaggctg

SEQ ID NO: 124334 - DNA, 601 bp, Human; identical to SEQ ID NO: 26535

SEQ ID NO: 124335 - DNA, 601 bp, Human; identical to SEQ ID NO: 26534

SEQ ID NO: 124336 - DNA, 601 bp, Human; identical to SEQ ID NO: 26533

SEQ ID NO: 124337 - DNA, 601 bp, Human; identical to SEQ ID NO: 36833

SEQ ID NO: 124338 - DNA, 601 bp, Human; identical to SEQ ID NO: 36832

SEQ ID NO: 124339 - DNA, 601 bp, Human; identical to SEQ ID NO: 36831

SEQ ID NO: 124340 - DNA, 601 bp, Human; identical to SEQ ID NO: 36830

SEQ ID NO: 124341 - DNA, 601 bp, Human; identical to SEQ ID NO: 36829

SEQ ID NO: 124342 - DNA, 601 bp, Human; identical to SEQ ID NO: 36828

SEQ ID NO: 124343 - DNA, 601 bp, Human
ggacatttgggttgcttccaccctttggctattgtgaataatgctgctataaacatggttgtacaaatttttttttgagtccctgttttcaattcttttgaatatatactcagaagtggaattatttaatcatacgataattctatttttaatgttctgatgaaccatacaattttccatagtggccgtaccattttacattcccaccagcagcacacaaaggttataatttttccacatccttgccaacactcatatttattttctgttctgctttgtttataatcatcattttaatgaktgtgaagttgtatctcatggttttgagttgcatttccctcatgattagtgaccttgagtctcttttcatgtgctcatcggccatttgtataccttctttggagaaatgtctattcaagtcatttgccaactttttaattgttttttttcttttctcagaaagggcatcagtacgttactcaagtttaagagatactgccaaccaaatcctagagataaatctgttagctacttgatattaaatttcttacaaatactattgctattataggtaaaataatctccactaatttttaaaatt

SEQ ID NO: 124344 - DNA, 601 bp, Human
attaaaaaccaccaaaggaggcatgatgagggagagtcatcgagtgcaacaaaaaagaattggaaataatggaacaatagcaaagggactaaaataattatgttcaaaagaattaaagcaatgcaggccaggcacagtggctcacacctgtaatcccagcactttgggaggccaaggtgcacggatcacgaggtcaggtattcgagatcagcctggccaacatggtgaaaccctgtctctactaaaaatacaaaaattagctgggcatgggtggtggcatgtgcctgtaatcccagctacycgggaggctaaggcaagagaattgcttgaacctgggaggcagaggctgtagtgagccaagatcgcaccactgcactccagcctgggcaacagagcgagattcagtctcaaaaaaaaaataaataaataaaaaaagaattaaagtaatgcaaaaaaagattaaaaagcctaatgaatacaataatttgactacaggagaaaagaaattttaacaaaacagagaacatgtggaaaattttaaatgtagttcattgagattataaactcaggtaaatttaaactgtagaatagaaatagatgg

SEQ ID NO: 124345 - DNA, 601 bp, Human
gatcctgaatggggaaatgtttctgggaggaatcaaggcccaaaacctacaccatggatggacatgttttctgaatttatgctacctatgtgatgtgggcattccaagctgagaatttaaatgctgttcccacatctttgaacattctgaagccctggctttgacaaaagcaaatatcaaaagcagatatcaagccattgtacaggggctaagcatatagaagtcccatagaaaaggcagccctcatgaagatgacttcacattcctaaattaaaaaccaccaaaggaggcatgatgagggagagtcatcgagtgcaacaaaaaagaattggaaataatggaacaatagcaaagggactaaaataattatgttcaaaagaattaaagcaatgcaggccaggcacagtggctcacacctgtaatcccagcactttgggaggccaaggtgcacggatcacgaggtcaggtattcgagatcagcctggccaacatggtgaaaccctgtctctactaaaaatacaaaaattagctgggcatgggtggtggcatgtgcctgtaatcccagctactcgggaggctaaggcaagagaattgcttgaac

SEQ ID NO: 124346 - DNA, 601 bp, Human
caggatcctgaatggggaaatgtttctgggaggaatcaaggcccaaaacctacaccatggatggacatgttttctgaatttatgctacctatgtgatgtgggcattccaagctgagaatttaaatgctgttcccacatctttgaacattctgaagccctggctttgacaaaagcaaatatcaaaagcagatatcaagccattgtacaggggctaagcatatagaagtcccatagaaaaggcagccctcatgaagatgacttcacattcctaaattaaaaaccaccaaaggaggcatgatgagggagagtcatcgagtgcaacaaaaaagaattggaaataatggaacaatagcaaagggactaaaataattatgttcaaaagaattaaagcaatgcaggccaggcacagtggctcacacctgtaatcccagcactttgggaggccaaggtgcacggatcacgaggtcaggtattcgagatcagcctggccaacatggtgaaaccctgtctctactaaaaatacaaaaattagctgggcatgggtggtggcatgtgcctgtaatcccagctactcgggaggctaaggcaagagaattgcttg

SEQ ID NO: 124347 - DNA, 601 bp, Human
cccaggatcctgaatggggaaatgtttctgggaggaatcaaggcccaaaacctacaccatggatggacatgttttctgaatttatgctacctatgtgatgtgggcattccaagctgagaatttaaatgctgttcccacatctttgaacattctgaagccctggctttgacaaaagcaaatatcaaaagcagatatcaagccattgtacaggggctaagcatatagaagtcccatagaaaaggcagccctcatgaagatgacttcacattcctaaattaaaaaccaccaaaggaggcatgatgagggagagtcatcgagtgcaacaaaaaagaattggaaataatggaacaatagcaaagggactaaaataattatgttcaaaagaattaaagcaatgcaggccaggcacagtggctcacacctgtaatcccagcactttgggaggccaaggtgcacggatcacgaggtcaggtattcgagatcagcctggccaacatggtgaaaccctgtctctactaaaaatacaaaaattagctgggcatgggtggtggcatgtgcctgtaatcccagctactcgggaggctaaggcaagagaattgct

SEQ ID NO: 124348 - DNA, 601 bp, Human
gtgcaagcctctgacaagtcttgtgcaactatggaaaagagaaggaaatctttaatttaaagactgacattgggtatcttacgacccctggcaagtgatgtctcagatcagaattaatttgcaataaaaaataaagcaagactccctgttcctgtaacgatgctaactgaactgatatcaaccctcccactagatatgcacagccttgataagcgtagataaacatatacactaagataaactgtaacaacaacaaaaaatacaatagcctatgtcaaaacaaagaaaggggaatccccartggtcctgacaggccaagaaagtgccccacctgaggaccaaaacagaaggttgaatgctcccaagtgattgaagagatgtcctggtctagatgaaagagaaggctggaagtgagacacagacataaaaacaaggcactagaatacgcaccaattcagtgaaaagggagctagaaaaattttgtcaaggagaacagggaagcgacaaggaagattaccatcccccaggatcctgaatggggaaatgtttctgggaggaatcaaggcccaaaacctacaccatggatggacatgttttctga

SEQ ID NO: 124349 - DNA, 601 bp, Human
ttttttcccttagggattctacctggaatatactaatattttcaagcactcatagaaaatggtgtaaataaaattgttacacatggaaatacacatttataattttgatatattttgccaaattgctctctaaaagggttaattccatttacgttccaacaaaatatttgttttcccacatccttccccatattaaatgttaacctgttcaatttgtcaatcagacacaaggaaaattatatccttattgtttaatttgcattttctgaattgtgaagatattaaatatactcatgtcaayaggctattatctttcatttcagtatctggatgtgagtggtttttgcctatttgttgcttattgacttgtaagagatctttgtatattaaagaaatttagccctttatctgtcatatattgagagtatttttttctcagtttgtaatttgtttttgcatcattatttgtaattcaaggtgagtttttgagataagtatttaccaagtagaataaagtaatccctttcccctccctaccacaggaagagaaacctaacattgtatttttaaaaaggtctgagctcattacaccttccctagg

SEQ ID NO: 124350 - DNA, 601 bp, Human
attaagttcattgtactagtggttttttttttttcccttagggattctacctggaatatactaatattttcaagcactcatagaaaatggtgtaaataaaattgttacacatggaaatacacatttataattttgatatattttgccaaattgctctctaaaagggttaattccatttacgttccaacaaaatatttgttttcccacatccttccccatattaaatgttaacctgttcaatttgtcaatcagacacaaggaaaattatatccttattgtttaatttgcattttctgaattrtgaagatattaaatatactcatgtcaataggctattatctttcatttcagtatctggatgtgagtggtttttgcctatttgttgcttattgacttgtaagagatctttgtatattaaagaaatttagccctttatctgtcatatattgagagtatttttttctcagtttgtaatttgtttttgcatcattatttgtaattcaaggtgagtttttgagataagtatttaccaagtagaataaagtaatccctttcccctccctaccacaggaagagaaacctaacattgtatttttaaaaa

SEQ ID NO: 124351 - DNA, 601 bp, Human
cattttccctagcgtttgggataattaagttcattgtactagtggttttttttttttcccttagggattctacctggaatatactaatattttcaagcactcatagaaaatggtgtaaataaaattgttacacatggaaatacacatttataattttgatatattttgccaaattgctctctaaaagggttaattccatttacgttccaacaaaatatttgttttcccacatccttccccatattaaatgttaacctgttcaatttgtcaatcagacacaaggaaaattatatccttattrtttaatttgcattttctgaattgtgaagatattaaatatactcatgtcaataggctattatctttcatttcagtatctggatgtgagtggtttttgcctatttgttgcttattgacttgtaagagatctttgtatattaaagaaatttagccctttatctgtcatatattgagagtatttttttctcagtttgtaatttgtttttgcatcattatttgtaattcaaggtgagtttttgagataagtatttaccaagtagaataaagtaatccctttcccctccctaccacaggaagagaa

SEQ ID NO: 124352 - DNA, 601 bp, Human
tatatttggaagtaaccaactataacttaggatgaaaagaagaaaagcattgaatgctttgctcagaccataaattccatatccattttccctagcgtttgggataattaagttcattgtactagtggttttttttttttcccttagggattctacctggaatatactaatattttcaagcactcatagaaaatggtgtaaataaaattgttacacatggaaatacacatttataattttgatatattttgccaaattgctctctaaaagggttaattccatttacgttccaacaaaatayttgttttcccacatccttccccatattaaatgttaacctgttcaatttgtcaatcagacacaaggaaaattatatccttattgtttaatttgcattttctgaattgtgaagatattaaatatactcatgtcaataggctattatctttcatttcagtatctggatgtgagtggtttttgcctatttgttgcttattgacttgtaagagatctttgtatattaaagaaatttagccctttatctgtcatatattgagagtatttttttctcagtttgtaatttgtttttgcatcattattt

SEQ ID NO: 124353 - DNA, 601 bp, Human
atgccaaagctttagcctttatatttggaagtaaccaactataacttaggatgaaaagaagaaaagcattgaatgctttgctcagaccataaattccatatccattttccctagcgtttgggataattaagttcattgtactagtggttttttttttttcccttagggattctacctggaatatactaatattttcaagcactcatagaaaatggtgtaaataaaattgttacacatggaaatacacatttataattttgatatattttgccaaattgctctctaaaagggttaattccayttacgttccaacaaaatatttgttttcccacatccttccccatattaaatgttaacctgttcaatttgtcaatcagacacaaggaaaattatatccttattgtttaatttgcattttctgaattgtgaagatattaaatatactcatgtcaataggctattatctttcatttcagtatctggatgtgagtggtttttgcctatttgttgcttattgacttgtaagagatctttgtatattaaagaaatttagccctttatctgtcatatattgagagtatttttttctcagtttgtaatt

SEQ ID NO: 124354 - DNA, 601 bp, Human
ttttgcggaacttgttttgtcttgcattcattctatcttccttaaataatgtctcttgaaaaaaagaaatctttggaagaaattcaagacagattatcttctttaatagaagaatttctgaatctctgaaaacatggtaatgccaaagctttagcctttatatttggaagtaaccaactataacttaggatgaaaagaagaaaagcattgaatgctttgctcagaccataaattccatatccattttccctagcgtttgggataattaagttcattgtactagtggttttttttttttcccttagggattctacctggaatatactaatattttcaagcactcatagaaaatggtgtaaataaaattgttacacatggaaatacacatttataattttgatatattttgccaaattgctctctaaaagggttaattccatttacgttccaacaaaatatttgttttcccacatccttccccatattaaatgttaacctgttcaatttgtcaatcagacacaaggaaaattatatccttattgtttaatttgcattttctgaattgtgaagatattaaatatactcatgtcaataggctatt

SEQ ID NO: 124355 - DNA, 601 bp, Human
acgcttgttttgttttgcggaacttgttttgtcttgcattcattctatcttccttaaataatgtctcttgaaaaaaagaaatctttggaagaaattcaagacagattatcttctttaatagaagaatttctgaatctctgaaaacatggtaatgccaaagctttagcctttatatttggaagtaaccaactataacttaggatgaaaagaagaaaagcattgaatgctttgctcagaccataaattccatatccattttccctagcgtttgggataattaagttcattgtactagtggttgtttttttttcccttagggattctacctggaatatactaatattttcaagcactcatagaaaatggtgtaaataaaattgttacacatggaaatacacatttataattttgatatattttgccaaattgctctctaaaagggttaattccatttacgttccaacaaaatatttgttttcccacatccttccccatattaaatgttaacctgttcaatttgtcaatcagacacaaggaaaattatatccttattgtttaatttgcattttctgaattgtgaagatattaaatatactcatgt

SEQ ID NO: 124356 - DNA, 601 bp, Human
cgatgtctataaccatcattaatacaacaacggaacgcttgttttgttttgcggaacttgttttgtcttgcattcattctatcttccttaaataatgtctcttgaaaaaaagaaatctttggaagaaattcaagacagattatcttctttaatagaagaatttctgaatctctgaaaacatggtaatgccaaagctttagcctttatatttggaagtaaccaactataacttaggatgaaaagaagaaaagcattgaatgctttgctcagaccataaattccatatccattttccctagcrtttgggataattaagttcattgtactagtggttttttttttttcccttagggattctacctggaatatactaatattttcaagcactcatagaaaatggtgtaaataaaattgttacacatggaaatacacatttataattttgatatattttgccaaattgctctctaaaagggttaattccatttacgttccaacaaaatatttgttttcccacatccttccccatattaaatgttaacctgttcaatttgtcaatcagacacaaggaaaattatatccttattgtttaatttgcatt

SEQ ID NO: 124357 - DNA, 601 bp, Human
ggcctcccaaagtgctgggattacaggcgtgagccgccacgcccagtccctaaaattttaatttttaaacttacaaatttgaggaccagaatctggactcatcaacgtggctctgaaactcgatgtctataaccatcattaatacaacaacggaacgcttgttttgttttgcggaacttgttttgtcttgcattcattctatcttccttaaataatgtctcttgaaaaaaagaaatctttggaagaaattcaagacagattatcttctttaatagaagaatttctgaatctctgaaaacayggtaatgccaaagctttagcctttatatttggaagtaaccaactataacttaggatgaaaagaagaaaagcattgaatgctttgctcagaccataaattccatatccattttccctagcgtttgggataattaagttcattgtactagtggttttttttttttcccttagggattctacctggaatatactaatattttcaagcactcatagaaaatggtgtaaataaaattgttacacatggaaatacacatttataattttgatatattttgccaaattgctctctaaaagggttaat

SEQ ID NO: 124358 - DNA, 601 bp, Human
cccttggtaaaattttaattttatttttattttttttgacggagtcttactctgtcacccaggctggagtgcagtggcgcgatctcagctcactgcaacctccgcctcagttcaagtgattctcctgcctcagcctcctgagcagctgggattacaggcacgcgccaccacacctggctaattttttgtatttgtagtagagatggggtttcaccacattggtcaggctggtctcgaactcctgacctcatgatccgcctgcttcggcctcccaaagtgctgggattacaggcgtgagccrccacgcccagtccctaaaattttaatttttaaacttacaaatttgaggaccagaatctggactcatcaacgtggctctgaaactcgatgtctataaccatcattaatacaacaacggaacgcttgttttgttttgcggaacttgttttgtcttgcattcattctatcttccttaaataatgtctcttgaaaaaaagaaatctttggaagaaattcaagacagattatcttctttaatagaagaatttctgaatctctgaaaacatggtaatgccaaagctttagcctttatatttggaag

SEQ ID NO: 124359 - DNA, 601 bp, Human
gctcacccaacaactttctgacttacaatttggtgtcctaactgtatgtgcacaacaaaaagaaaacattcagggaagaagaacagggagagggcaagaaggaggagtctgctatttgtaagaaagagaaggtgttttgtgacaagtttaaatctggttatcatgcttgctatatatcctattacaggttaataaattagcattctgatttatgtatataaggctcttgaaagatggttggtttcctggtacctaaccatcccttggtaaaattttaattttatttttattttttttgacrgagtcttactctgtcacccaggctggagtgcagtggcgcgatctcagctcactgcaacctccgcctcagttcaagtgattctcctgcctcagcctcctgagcagctgggattacaggcacgcgccaccacacctggctaattttttgtatttgtagtagagatggggtttcaccacattggtcaggctggtctcgaactcctgacctcatgatccgcctgcttcggcctcccaaagtgctgggattacaggcgtgagccgccacgcccagtccctaaaattttaatttttaaacttacaa

SEQ ID NO: 124360 - DNA, 601 bp, Human
tctttgctagtatttctcctgtactagccagagaaagagtattctgattcttgatctgtggccagctttttaggaagaaatacctctaatatgtggaaggacaattccttagtacttctcagtttgctggaaatccatcccaaaagcatccaattccatttgttttaactgtgtgctcacccaacaactttctgacttacaatttggtgtcctaactgtatgtgcacaacaaaaagaaaacattcagggaagaagaacagggagagggcaagaaggaggagtctgctatttgtaagaaagrgaaggtgttttgtgacaagtttaaatctggttatcatgcttgctatatatcctattacaggttaataaattagcattctgatttatgtatataaggctcttgaaagatggttggtttcctggtacctaaccatcccttggtaaaattttaattttatttttattttttttgacggagtcttactctgtcacccaggctggagtgcagtggcgcgatctcagctcactgcaacctccgcctcagttcaagtgattctcctgcctcagcctcctgagcagctgggattacaggcacgcgcca

SEQ ID NO: 124361 - DNA, 601 bp, Human
atggaaactagagaaagaagaattagaaaatatatctttgctagtatttctcctgtactagccagagaaagagtattctgattcttgatctgtggccagctttttaggaagaaatacctctaatatgtggaaggacaattccttagtacttctcagtttgctggaaatccatcccaaaagcatccaattccatttgttttaactgtgtgctcacccaacaactttctgacttacaatttggtgtcctaactgtatgtgcacaacaaaaagaaaacattcagggaagaagaacagggagagrgcaagaaggaggagtctgctatttgtaagaaagagaaggtgttttgtgacaagtttaaatctggttatcatgcttgctatatatcctattacaggttaataaattagcattctgatttatgtatataaggctcttgaaagatggttggtttcctggtacctaaccatcccttggtaaaattttaattttatttttattttttttgacggagtcttactctgtcacccaggctggagtgcagtggcgcgatctcagctcactgcaacctccgcctcagttcaagtgattctcctgcctcag

SEQ ID NO: 124362 - DNA, 601 bp, Human
acaacttggagtagatacccttttgtgtttcataagttaggtctatgtaagaagaaaaatataactacacatctatttttaattgtttttgctcttttacaattttttttactgtatcatcattgaaattcagtgaatccagacaccaaagagaccttagaccagcccttacctccattcctgcctaatgacttttcatctaaagagctaagtctgtgtttgaaagaaatttagtctatccttcaaattgagaattacttatcacatatagatgtatgtagcatttggcagaaaatcatayatctatttattcgtacacactaaaattctggaagaataaataagaaattgttaacagagggccagagatggcggcttacatgtgtaattccaatactttgggaggccaaggcgggaggatcacttgagcccaggagattgagtccagcctgggcaacattgtgagatcctgtctgtataaaaaataataattttaaaaattagttgtgctgtagtactgtgcacctgtggtcctagctactagggaggctgaagcagaaggatcgaatcacttgagcccatgtgtttaaggttacagtga

SEQ ID NO: 124363 - DNA, 601 bp, Human
agccataaaattaataatcctcagttagtagctgttatcttcaacttttctaaacaggagtttaattaatatctcacacgctggagaataccaacagtgatgctagtgcaatgacaatactaaatgagctagtattgaaaatttgaaaataacacaacttggagtagatacccttttgtgtttcataagttaggtctatgtaagaagaaaaatataactacacatctatttttaattgtttttgctcttttacaattttttttactgtatcatcattgaaattcagtgaatccagacaccmaagagaccttagaccagcccttacctccattcctgcctaatgacttttcatctaaagagctaagtctgtgtttgaaagaaatttagtctatccttcaaattgagaattacttatcacatatagatgtatgtagcatttggcagaaaatcatatatctatttattcgtacacactaaaattctggaagaataaataagaaattgttaacagagggccagagatggcggcttacatgtgtaattccaatactttgggaggccaaggcgggaggatcacttgagcccaggagattgagtccag

SEQ ID NO: 124364 - DNA, 601 bp, Human
tacttttttggctctgaccctcctgcttccctcttataaagactccttatgcttgcactgggcccacttggataatccagcacaatctccccatctcacaattcttaaccacatctgcaaagtcctttttgccatgcaaggtacatacataatcacaggtttcaaggataagatgtggacaactttggggtggtagaagagattggggcattatcttgcctatcacagatgctaaagtgacactatgtttgcatgaagcacaagtgtctttgaatttcattaatccagtcctacatttaarcatttttttcatttttttttttttgaaatggagttttgctcttgttgcccaggctggagcgcagtggcgcgatctcagctcactgcaatctccccctcctgggttcaagtgattctcctgcctcagcctcctgagtagctggaattacaggcatgtgccagcaaacctggctaattttttgcatttttagtagagatggggcttcaccatgttggccaggctggtcttgagctcctgatctcacgtgatctgcttgccttggcctccgaaagtgcggggattacagccatgagccaccgt

SEQ ID NO: 124365 - DNA, 601 bp, Human
gtagtgctctaagacaacacaaattaattactttttcattctagaggtcagaagtccaaaatcagtctctctgggctaaaatcaaagtggaagtagggttggttctttctggaggctctagaggagaatccttgtgcttggctcttccaacttctggaggccacttgcattccttgacttgtagcccccttctccatcttgaaagccagcagcacaacatcttcaaatctctctctcttctccacccctctttctgacctctgcttctgtgtcacatctacttttttggctctgaccctcytgcttccctcttataaagactccttatgcttgcactgggcccacttggataatccagcacaatctccccatctcacaattcttaaccacatctgcaaagtcctttttgccatgcaaggtacatacataatcacaggtttcaaggataagatgtggacaactttggggtggtagaagagattggggcattatcttgcctatcacagatgctaaagtgacactatgtttgcatgaagcacaagtgtctttgaatttcattaatccagtcctacatttaagcatttttttcattttttttttt

SEQ ID NO: 124366 - DNA, 601 bp, Human
gccatggtggctcacacctgtaatcctagcactttgggaggccaagtcaggctgatcacctgaggtcaggagttcgagaccagtctggccaacatggtgaaaccccatctctactaaaaatacaaaaattagccgggtatggtggtgcacgcctgtagtcccagctactcagaatgtggaggcaggagaatcgcttgaactcaggaggcagaagttgcagtgggctgagatcatgccactgtactccagcctggacgacagagtgagaccttgtctcaaaataaaaaaaaaataaaaaaakaaaaaagaaaaacagggaatacattgtgggatatagagagacgtgtgactagacagcacgacaaaggcaaggtcatactaaggagcttgacaataatatgtcaaagaagagttattcaaggctgttaagcagaaaatttagaaatatcattctgctttattagtcttgctagcggtctctcaattttgttgatcttttcaaaaaaccagctcctggattcattgattttttgaagggttttttgtgtctctatctctttcagttctgctctgatcttagttatttcttgccttctgctag

SEQ ID NO: 124367 - DNA, 601 bp, Human
aaatataaaagaagtggtaaaactagaaggagaggagaaaaaaatgccaggaaagaaaacagcattttcaaaggtacagagacattaaatagcatgatacgtattgggaactataacaaattcaatgtagcagaataagaggaacacgccagccatggtggctcacacctgtaatcctagcactttgggaggccaagtcaggctgatcacctgaggtcaggagttcgagaccagtctggccaacatggtgaaaccccatctctactaaaaatacaaaaattagccgggtatggtggtgcaygcctgtagtcccagctactcagaatgtggaggcaggagaatcgcttgaactcaggaggcagaagttgcagtgggctgagatcatgccactgtactccagcctggacgacagagtgagaccttgtctcaaaataaaaaaaaaataaaaaaagaaaaaagaaaaacagggaatacattgtgggatatagagagacgtgtgactagacagcacgacaaaggcaaggtcatactaaggagcttgacaataatatgtcaaagaagagttattcaaggctgttaagcagaaaatttagaaatatca

SEQ ID NO: 124368 - DNA, 601 bp, Human
aaaatataaaagaagtggtaaaactagaaggagaggagaaaaaaatgccaggaaagaaaacagcattttcaaaggtacagagacattaaatagcatgatacgtattgggaactataacaaattcaatgtagcagaataagaggaacacgccagccatggtggctcacacctgtaatcctagcactttgggaggccaagtcaggctgatcacctgaggtcaggagttcgagaccagtctggccaacatggtgaaaccccatctctactaaaaatacaaaaattagccgggtatggtggtgcrcgcctgtagtcccagctactcagaatgtggaggcaggagaatcgcttgaactcaggaggcagaagttgcagtgggctgagatcatgccactgtactccagcctggacgacagagtgagaccttgtctcaaaataaaaaaaaaataaaaaaagaaaaaagaaaaacagggaatacattgtgggatatagagagacgtgtgactagacagcacgacaaaggcaaggtcatactaaggagcttgacaataatatgtcaaagaagagttattcaaggctgttaagcagaaaatttagaaatatc

SEQ ID NO: 124369 - DNA, 601 bp, Human
tttgtattttttgtagagatgggatttggggtctcgccatgttgcccaggctggtctccaattcctgaactcaagtgatccatccccctttgcctcccaaagtgctgaaattataggcatgcatcactacacatggcctaaacaaattcttacaaaatataaaagaagtggtaaaactagaaggagaggagaaaaaaatgccaggaaagaaaacagcattttcaaaggtacagagacattaaatagcatgatacgtattgggaactataacaaattcaatgtagcagaataagaggaacaygccagccatggtggctcacacctgtaatcctagcactttgggaggccaagtcaggctgatcacctgaggtcaggagttcgagaccagtctggccaacatggtgaaaccccatctctactaaaaatacaaaaattagccgggtatggtggtgcacgcctgtagtcccagctactcagaatgtggaggcaggagaatcgcttgaactcaggaggcagaagttgcagtgggctgagatcatgccactgtactccagcctggacgacagagtgagaccttgtctcaaaataaaaaaaaaataaa

SEQ ID NO: 124370 - DNA, 601 bp, Human
tggcatttaaacaaatttttttggagacaaggttttgctctgtcgctcaggctggagtgaagtggcgcaatcttggctcaatgcagcctcgacctccccaggctcaggtgatcctcccccaacctgagcctcccgagtagctgagaatacaggcatgcgccaccacaccctgctaatttttgtattttttgtagagatgggatttggggtctcgccatgttgcccaggctggtctccaattcctgaactcaagtgatccatccccctttgcctcccaaagtgctgaaattataggcatgcrtcactacacatggcctaaacaaattcttacaaaatataaaagaagtggtaaaactagaaggagaggagaaaaaaatgccaggaaagaaaacagcattttcaaaggtacagagacattaaatagcatgatacgtattgggaactataacaaattcaatgtagcagaataagaggaacacgccagccatggtggctcacacctgtaatcctagcactttgggaggccaagtcaggctgatcacctgaggtcaggagttcgagaccagtctggccaacatggtgaaaccccatctctactaaa

SEQ ID NO: 124371 - DNA, 601 bp, Human
aatacatagttctgcatagtttagtattaaaacagtaatctagtaattccatactcctccccctccccccaattcttgtttccaaagactttcaacacttttttcggtttcttttggtatttacagccatttctatccttgctaatactgctattttttaaagtttttttttttctgcttgccattccttcagcagtttcctgaaaaagttttcagttttacacatctatcaacttcctatcatgaagaggagaatctgctttttttattttttgttttttaaaacagggtctcactctgycatccaggctggagtgcagtgatgtgatcatagctcactgtaatctcaaactcctaggctcaagtgatcctccagtctcagcctcctgagtagctgagacaacaagtgcgtgcaaccacattcagctaatttttcttttttctttttttctttttttttttttttgagacagagtctcgctctgtcgcccaggatggagtgcactggcgcaatctcggctcactgcaagctccgcctcctgggttcacgccattctcctgcctcagcctcccgagtagctgggactacaggtgcccacca

SEQ ID NO: 124372 - DNA, 601 bp, Human
actccatctcaaaaaaaaaaaaaaaaaatacatagttctgcatagtttagtattaaaacagtaatctagtaattccatactcctccccctccccccaattcttgtttccaaagactttcaacacttttttcggtttcttttggtatttacagccatttctatccttgctaatactgctattttttaaagtttttttttttctgcttgccattccttcagcagtttcctgaaaaagttttcagttttacacatctatcaacttcctatcatgaagaggagaatctgctttttttattttttrttttttaaaacagggtctcactctgccatccaggctggagtgcagtgatgtgatcatagctcactgtaatctcaaactcctaggctcaagtgatcctccagtctcagcctcctgagtagctgagacaacaagtgcgtgcaaccacattcagctaatttttcttttttctttttttctttttttttttttttgagacagagtctcgctctgtcgcccaggatggagtgcactggcgcaatctcggctcactgcaagctccgcctcctgggttcacgccattctcctgcctcagcctcccga

SEQ ID NO: 124373 - DNA, 601 bp, Human
cctgtagtcccagctacttgggaggttgaggcaggagaatggcgtgaacccgggaggcagagcttgcagtgagccgagatcgtgccactgcactcagcaagactccatctcaaaaaaaaaaaaaaaaaatacatagttctgcatagtttagtattaaaacagtaatctagtaattccatactcctccccctccccccaattcttgtttccaaagactttcaacacttttttcggtttcttttggtatttacagccatttctatccttgctaatactgctattttttaaagtttttttttttctgcttgccattccttcagcagtttcctgaaaaagttttcagttttacacatctatcaacttcctatcatgaagaggagaatctgctttttttattttttgttttttaaaacagggtctcactctgccatccaggctggagtgcagtgatgtgatcatagctcactgtaatctcaaactcctaggctcaagtgatcctccagtctcagcctcctgagtagctgagacaacaagtgcgtgcaaccacattcagctaatttttcttttttctttttttctttttttttttttttgagacaga

SEQ ID NO: 124374 - DNA, 601 bp, Human
ggccaaggagggcggatcacgaggtcaggagatcgagaccatcctggctaacatggtgaaaccccatctctactaaaaatacaaaaaattagccaggcgtggtggcgggcgcctgtagtcccagctacttgggaggttgaggcaggagaatggcgtgaacccgggaggcagagcttgcagtgagccgagatcgtgccactgcactcagcaagactccatctcaaaaaaaaaaaaaaaaaatacatagttctgcatagtttagtattaaaacagtaatctagtaattccatactcctccccmtccccccaattcttgtttccaaagactttcaacacttttttcggtttcttttggtatttacagccatttctatccttgctaatactgctattttttaaagtttttttttttctgcttgccattccttcagcagtttcctgaaaaagttttcagttttacacatctatcaacttcctatcatgaagaggagaatctgctttttttattttttgttttttaaaacagggtctcactctgccatccaggctggagtgcagtgatgtgatcatagctcactgtaatctcaaactcctaggctca

SEQ ID NO: 124375 - DNA, 601 bp, Human
attacctcagatacaaatccagatcagattacatcattgcctaattataatgtaaggagcctggacttttcaaggctccaaataaagcccagatagcaacactggtttaaaaaaagagaaaaagaggcacatgatatgttactaatcttcctctgagagttaagtaaatacacaccctgagacgtcatacagtaagaactttaaaattgtttataccatattaggaaaaaagcttacactatgattaacatgtttttccttctgatttggtaaccatcatattggtttggaaaaacatgaygcaatttaagtcaattgtaagttattttatttccattttttagccacaaaacataattttttagtattaaattattgttcttaaaaataacctaatttaaattacaataattccctcacaaaacattgttagtagattaaaaaaatcaaaatggctcactgttttctgttttatttatttaaaagcaattttcaaacacaaaataaatgtaaatctacattttattggcaggaaatttttaatgctttattgcttttaatgtgttttaacatgaaggaagtttttaggtatttttattta

SEQ ID NO: 124376 - DNA, 601 bp, Human
aatgaggaagacaattttaaaattaattttttcttatgtgaacaaaagttctctgaaaaggaatttggaagaaagagactttattccagtgaacagtttgcaaactgggagatacagcctttggtgcaaaatgaaggtgcatttcgttaaacaaagagagggttcaagttcctgcccagcttccggcaaataaaggattcaaacttgcttagttctgattggttggtgcagctaagttctgatcggtcaatatggctggtttctgattggctgcggtaggtgagctctgattggtcgtttyccaagcccaaactcagacgtcacaggcttgattgcagaaagggagatccagtgatacttctacatctttctgagaacagaatatgtgactgcttcctcgtccagctatggctgcatagttctgtttttgagcacctcagccatgaggagtccattctatctgtcagccaggggtatactttaacaggtataattaaagctacagcatagaatgcataattaggccctttgaattacatagaagtcagaagctactttcaggttctcccacaacctcggcaacttacaggaaatgttggaa

SEQ ID NO: 124377 - DNA, 601 bp, Human
cgtttcagggagtttttagaattcctcaaggagttcagaaactttggttttgaaaactgctgcagtgttgcagggcaaatacccacaggcatgaaaacagaaattaagcaatttttttttttttttgagatggagtttcgctcttatcacccaggctgggctcacctcaacccctgccactcgggttcaagcgattctcctgcctcagcctccggagtagctgggattacaggcatgcgccaccacgcccagctaattttgtatttttagtggacacggggtttaatccatgttgttcagrctggtctcgaactcccgacttcaggtgatccacctgccctggcctcccaaagtgctaggattacaggtgtaagccaccgcgcccagccaacaaaattgtattcaatggaaaagaacactattttcatataaagccttagctgaaccaatttttaatgaggaagacaattttaaaattaattttttcttatgtgaacaaaagttctctgaaaaggaatttggaagaaagagactttattccagtgaacagtttgcaaactgggagatacagcctttggtgcaaaatgaaggtgcatttcgt

SEQ ID NO: 124378 - DNA, 601 bp, Human
cagttcttccctgccgggagccatccctgcagcctgtacctgaggcatctgcacacatatcaactaactcactgacctgagcagagtgagaggagctgcctatgctcaggaagtgacttagcaaacgtgttccataattaatacgaaataaaagcatagagacatggcaataaaacgtttcagggagtttttagaattcctcaaggagttcagaaactttggttttgaaaactgctgcagtgttgcagggcaaatacccacaggcatgaaaacagaaattaagcaatttttttttttttttgagatggagtttcgctcttatcacccaggctgggctcacctcaacccctgccactcgggttcaagcgattctcctgcctcagcctccggagtagctgggattacaggcatgcgccaccacgcccagctaattttgtatttttagtggacacggggtttaatccatgttgttcaggctggtctcgaactcccgacttcaggtgatccacctgccctggcctcccaaagtgctaggattacaggtgtaagccaccgcgcccagccaacaaaattgtattcaatggaaaagaacactattttc

SEQ ID NO: 124379 - DNA, 601 bp, Human
ccacatagagaacatttgcatctcttctgcagcagctataaatgagaatttatactattacagcagtttttgctatttctcatgggtgcctttgacatttacctagtgctcaaaatacaccaaaaataattttgctctgaataagcctcaactataactctgtaatttatttcataatactttttaatcttccttcaaagcttactcattgatggataattattaagcactttacaaattcccaaaattatgtgtggtataaaaacagagccttgaaatttgacaagccctaaaactcatyacaatctatctaggcccgagaaatgatgaataatcatatacaactcagtcaatgtcacccctagatgttatggcaatgaaggagggctagcctgaaagggataaacctagttgcccagccacgtaggaaagacgatggatactctaggtgcaggcaatcaagaaatcaagtccaggccgggcgcggtgtggctcacgcctgtaatcctagcactttggaaggccaaggcgggcggatcacgaggtcaggagatcaagaccatcctggctaacacggtgaaaccccgtctctactaaaaat

SEQ ID NO: 124380 - DNA, 601 bp, Human
caaacattgaattatatgctatattaactaatatactgtactcagtgtcttgattttttttagtctcattattctttctggatttcagaatgaaactcatgctcacccactagtcagggctacaaatgtatccagaatgacagtttatttttaaaagcccaaatagtaggattcccttctaggggaaatcctttgagtcatacagaaattagttgccaaaggtttctaggccatatcaaaaggaaacctcaagattctttaaattattacttgaaaatttttagtgtccaaaatgacaacytaagataggattttgatagtcccatgaaacacctcctcacacagagcaaccacatagagaacatttgcatctcttctgcagcagctataaatgagaatttatactattacagcagtttttgctatttctcatgggtgcctttgacatttacctagtgctcaaaatacaccaaaaataattttgctctgaataagcctcaactataactctgtaatttatttcataatactttttaatcttccttcaaagcttactcattgatggataattattaagcactttacaaattcccaaaattat

SEQ ID NO: 124381 - DNA, 601 bp, Human
aaagacttctttcttccacaactgacctaatatgcataataaagaaaaattgctcagcaaatgtgaaggggaaaatatgctttttgcagaagcagggaaggaaaggaaaagctagtttagattttcactccttaagcatgtcacatcctagatgcaaatgtttttggagaattattttaaaaatttgtggtgtcagagtctagcctttcaaatttgcatgttttcataattgtcctgtgatcatggttcaaagctaactaaatctgtttccccagtatattaacgtggtttccaaagtagrgcaatgaggtcgccagcagttctgcagagaacaatgtgctaataagcaaattgacttgtgtgttgttcaataaattctgttattttgaagtaatacattaaggatattaaacggaaatcactaactcactgtaaggtagctttcaaacattgcattttatctcaaactgctattgaggcaggagaatagggtctggaggcagggagcctaaggctcattcatgctgactggatatcagaggctactcccttttcagcccctcctttttccgaggggaagttgaaaaatgaaactacctct

SEQ ID NO: 124382 - DNA, 601 bp, Human
aaaaagacttctttcttccacaactgacctaatatgcataataaagaaaaattgctcagcaaatgtgaaggggaaaatatgctttttgcagaagcagggaaggaaaggaaaagctagtttagattttcactccttaagcatgtcacatcctagatgcaaatgtttttggagaattattttaaaaatttgtggtgtcagagtctagcctttcaaatttgcatgttttcataattgtcctgtgatcatggttcaaagctaactaaatctgtttccccagtatattaacgtggtttccaaagtrgggcaatgaggtcgccagcagttctgcagagaacaatgtgctaataagcaaattgacttgtgtgttgttcaataaattctgttattttgaagtaatacattaaggatattaaacggaaatcactaactcactgtaaggtagctttcaaacattgcattttatctcaaactgctattgaggcaggagaatagggtctggaggcagggagcctaaggctcattcatgctgactggatatcagaggctactcccttttcagcccctcctttttccgaggggaagttgaaaaatgaaactacct

SEQ ID NO: 124383 - DNA, 601 bp, Human
aatacctaatacatatttgctgagtaagtgaatgaataaactcccagatttcaaatctgaagcactagaaaaatgacacatattgtctgaatcagtgttcacatattgaagaaatagcaatatttgtaaaaccaaataattaaagacttagggaatgaaaaaccagtcaaggtatatcaattgtctggtgcagtgtccaggcacacaggactaggtcaataaactaacaattgttccattcgttcatctctcaggatgtgtgctccaaaccaccagatgaacaatctaagccacagtggaacttgcactaacacaggaagatacacatttagatactggtcctcccaacagcaggaaggccaagaactagttcaggcagggtgtagtaatgccatgggtgtcaggctcatgacagagccaacaccccaccttgcagtcacaatattccatttaaattcttccctcaggtctaggtccttaaactcagtgtgccatctccagtctccatcctatttgtagctccaagcctttgaccagcacgttagcataggtattctttttttgtttgtttgtttgtgagacgcagtttcactcttgttac

SEQ ID NO: 124384 - DNA, 601 bp, Human
ttattgataaaagtatgatttttttaaaaatcttgtctatatgatctgtaaatggatcaaggagagaaacgaaatggaggcagataactcagttacaaatctgacacagaaatttagcttcaatgtaataggagcctgagtttgggggtaggaaagaaacagaaaagaagacatggctgggaggaagattataagagagaaataaaaacaactacaggttgagtatccttcatttgaaatgcttgggacaagaagtgtttcagatttatgatttttttcagattttggaatatttgcgttrtatcagttgagaatcacaaatctaaaaacccaaaatttgacatgctgcagtgagcatttcctttggatgtcatatcagtgctcaaaaagtttttaattttggagcatttaggatttggggttttaagatttgggatgctcaacctgtaatttgatgtgatgagtgaaaacgggaaagagtcaaatactacttcatcttttaccactttttgctcgcccaccaagttccagttgctttcagtatcttgaacccactgagccatctcccacctcaggatatttactcatgcccttccttctg

SEQ ID NO: 124385 - DNA, 601 bp, Human
gcctacagagttaattttagttgaacactctcctttccctggctaaacttcagctttgttcttggctctctgcactcttgagtcacaggaatgtaaacatggggaacctcatcctctttctcttgtctgtttctttcaatgttgtctttattctaatatttctatttctaataactactaaacccaatacctttctttccttccataaacagatctgctttctgatcaatacaacccacagtggaaaaggcaacaggatgagatgaggcatccataatgagaggttcaaggattggaaaasaacagagctgcagtgagaatgccagtttggccaatttattaacatgcatgtcagtacagagttgcaattaagaaggcaagagcaaggccgggcacagtggctcatgcctgtaatcccagcactttgggaggccgaggcaggcagcccacctgaggtcaggagttcgagatcagcctggccaacatggcaaaaccccgtctccactaaaaacacaaaaaatagccagacatggtggcgtgtgcctgtaatcccaactactttggaggctgaggcaggagaatcccttgaacccgggaggca

SEQ ID NO: 124386 - DNA, 601 bp, Human
atggactaatgattttccagtttatccttagacttaaccaaaatcaggccagtagcatattaacaagcccacagtccccaagaagcattaaagtttctgaatttagtataaactttctgatttatagaccatagtttatagtcttgcactcatgatctcctccttgctctgatccaaacccttccaaaactgcctctgagatcattctctaaatggagctaccatttagagataccacagatcactttagccctaattacaccggtttctttgcccctaactactgtttatttttttttttaacttgcatgttgtttttcttaggaaattgaggaggggatcctgaaactcaaacaactgggaatgctgcctacagagttaattttagttgaacactctcctttccctggctaaacttcagctttgttcttggctctctgcactcttgagtcacaggaatgtaaacatggggaacctcatcctctttctcttgtctgtttctttcaatgttgtctttattctaatatttctatttctaataactactaaacccaatacctttctttccttccataaacagatctgctttctgatcaataca

SEQ ID NO: 124387 - DNA, 601 bp, Human
tttatttctgtaactgggtacagggaaaaggcctggaaaatatcgccaggccaactcaaagttacaaagttttccagagcttatataccttctaagctatatgtctgtgtgttagtgtgcattcatctgaagacataagtgattaacttcttctaatctataactaagatctgaatcctgaagaccttcctctggagcctccgtaaatttacttaatcctaatgggtccaggtgctgggtgattacccttatcttgtctcctgctaaatcatggaggtttggggagtttcttcagacccccaataaacttgtttgtggaggtctggggagtttcttcagacctccaataaaacttgtttaatcctaaacaggcctctgttaagaattcatttgttatcttgtcacacttcaaggcccaggaaaggcctgagcaaaactcctggtgggcttttgttacattccagcctttgtataagggcactagctcgatcagcttttaatatttaacttggccactccgtcagtgctgaaacagttgttacagaggcctgtgttagtgagacccggcctgccacaaaactgtccttgtgctcaaagagta

SEQ ID NO: 124388 - DNA, 601 bp, Human
aattgaggtgaccaaactgtttccggaccaagctgagggtcaggctgcctattctcgcagcccaataatgagatgcagacgaactgggaaagaagacagtttatttctgtaactgggtacagggaaaaggcctggaaaatatcgccaggccaactcaaagttacaaagttttccagagcttatataccttctaagctatatgtctgtgtgttagtgtgcattcatctgaagacataagtgattaacttcttctaatctataactaagatctgaatcctgaagaccttcctctggagcctcsgtaaatttacttaatcctaatgggtccaggtgctgggtgattacccttatcttgtctcctgctaaatcatggaggtttggggagtttcttcagacccccaataaacttgtttgtggaggtctggggagtttcttcagacctccaataaaacttgtttaatcctaaacaggcctctgttaagaattcatttgttatcttgtcacacttcaaggcccaggaaaggcctgagcaaaactcctggtgggcttttgttacattccagcctttgtataagggcactagctcgatcagcttttaata

SEQ ID NO: 124389 - DNA, 601 bp, Human
tttttgtatttttagtagagacagggtttcactgtgttagccaggatggtcttgatctcctgacctcgtgatccgcctgcctcggcctcccagagtgctgggattacaggtgtgcaccaccacacccggcccaatggagagtaattctaataatcaactatggatcctcggcagtatggagaaggcctagaagccaagaagagatcaaaaggtgaattaaataaaggaattgaggtgaccaaactgtttccggaccaagctgagggtcaggctgcctattctcgcagcccaataatgagakgcagacgaactgggaaagaagacagtttatttctgtaactgggtacagggaaaaggcctggaaaatatcgccaggccaactcaaagttacaaagttttccagagcttatataccttctaagctatatgtctgtgtgttagtgtgcattcatctgaagacataagtgattaacttcttctaatctataactaagatctgaatcctgaagaccttcctctggagcctccgtaaatttacttaatcctaatgggtccaggtgctgggtgattacccttatcttgtctcctgctaaatcatgga

SEQ ID NO: 124390 - DNA, 601 bp, Human
attgatcattggaaataggatggaaatatagggatgcaagtaaattgagagtaattcttttttttttttttttgagatagagtcctgctctgttgcccaggctggagtgcagtggcgggatctcagctcactgcaagctctgcctcccgggttcacgccattctcctgcatcagcctcccgagtagctgggactacaggtgcccgccaccatgcctggctaattttttgtatttttagtagagacagggtttcactgtgttagccaggatggtcttgatctcctgacctcgtgatccgccygcctcggcctcccagagtgctgggattacaggtgtgcaccaccacacccggcccaatggagagtaattctaataatcaactatggatcctcggcagtatggagaaggcctagaagccaagaagagatcaaaaggtgaattaaataaaggaattgaggtgaccaaactgtttccggaccaagctgagggtcaggctgcctattctcgcagcccaataatgagatgcagacgaactgggaaagaagacagtttatttctgtaactgggtacagggaaaaggcctggaaaatatcgccaggcc

SEQ ID NO: 124391 - DNA, 601 bp, Human
gtacatctaatgtgtgtgtgtgtgtgtgtgtgtgtatgtgtgtgtgtgtgcgtgtctaaattgcttttaaaaatttgtttactcagcatttaagcccccttagggcatttcacactgcactgtgtaatagataaagaatcacactagaggagacataattcattaattctcttttgaaaagcgcttggtgctatcagtgaaatgaatataaattatgccattcctatacttaagggcttaaaaaagtctagtagtgtcttattcatatttgtatctgccataatagccttgaagtttttttatgatcattctaactagatgttctctttcctgcctttacaagttcacgaatttctgtattatgcttatgatttaaatgggacattgctgtatattgtggttatttgtgtttacattcttatcaactttatcactccctccccaaccagtgtaaaaatggagaaggcaggttgtggcaatgacctaacattgatcattggaaataggatggaaatatagggatgcaagtaaattgagagtaattcttttttttttttttttgagatagagtcctgctctgttgcccaggctggagtgcagt

SEQ ID NO: 124392 - DNA, 601 bp, Human
ataatacataatatagccctgtagggtgatggtgaggggtaaataaggtggcatatgcctgacatatggtagggcctcaggaaatgcaagtattattgtttctatcacctttggccaaaaacaagttaattgtctttttcccccaagtaatattttatttttgctgttttgctgcacaattttacattacaaaaggtgtgggtacttacctcatcacaactgtaatcagtatgctgatggataaagcaagacagtatttatccttccaagacttttctatgcttgtacatctaatgtgtgygtgtgtgtgtgtgtgtgtatgtgtgtgtgtgtgcgtgtctaaattgcttttaaaaatttgtttactcagcatttaagcccccttagggcatttcacactgcactgtgtaatagataaagaatcacactagaggagacataattcattaattctcttttgaaaagcgcttggtgctatcagtgaaatgaatataaattatgccattcctatacttaagggcttaaaaaagtctagtagtgtcttattcatatttgtatctgccataatagccttgaagtttttttatgatcattctaacta

SEQ ID NO: 124393 - DNA, 601 bp, Human
aatcctgtctctactaaaaatacaaaattagccgggcttggtggtgggtgcctgtaatcccagctattcaggagcctgaggcaggagaatcgcttgaatccagcaggtggaggttgcggtgagccgagattgcgccattgcactccagcctgggcaacaagagcaagactccatctcacaaaaaaaaaaaaaaaatgcctacagatattttattctgtttcataatattttcttttttcttttaagataaaaaatacttctttcaaagattttcatctacatttttcagtgtcctgcttcmactttctcttcaagtaaatcttcaaggagaactcttgcttcaagaagatacaccagttgtttcttgtgtgcccagattgagaagcactggcccagggtggctagctgccccaagaaaaacaaaaatacctatgtgatatctgtcagaattaatttggccaattaaccaaatagataagaaagattagggtttttttccccaatgtcaaggcaactgaaactaaagggttgtggctaaaatggaattgaacaaaataggttaattgagtaatttagcagtaggtaggagactagactagca

SEQ ID NO: 124394 - DNA, 601 bp, Human
aggactaaggcagggctgctcaaacttttgctctgagacaacttaacaaaagaggaggacaaaataataacccttgggatatctagaaatataaatgaaaatgaaaatagctaacattagggagaattcactatgaacgacccactgttccaacatttaacatatactggtcacttaattctcatgataactctatgaggcagatgatattattcccattttacaaatgagaaatggagacacaaaaaggctaagcaacttgccccagggtacagttagaaaagggaggagctaggtttcrgtcttgccccaaagcctatggtttcaaccacaggttaccatgagtagtttaccaccagttcaaaattccattaaagttgtgccttaaaaatgcctacagtctgggcgcgatggctcacgcctgtaatcccagcactttgggaggccgaggcgggcagatcacctgaggtcgggagttcaagaccagcctgaccaacatggagaaatcctgtctctactaaaaatacaaaattagccgggcttggtggtgggtgcctgtaatcccagctattcaggagcctgaggcaggagaatcgcttga

SEQ ID NO: 124395 - DNA, 601 bp, Human
cttcacttcccaaattcctaaaacagctactctttgtttttaatggtgctggaaaaaaaagagacagagaagagaaaaaggaaaacagtgcattcctgaaacattacaaaagaccagccgatgagaaccaagtgcagcatactggagagaatcctggggaaggactaaggcagggctgctcaaacttttgctctgagacaacttaacaaaagaggaggacaaaataataacccttgggatatctagaaatataaatgaaaatgaaaatagctaacattagggagaattcactatgaacgayccactgttccaacatttaacatatactggtcacttaattctcatgataactctatgaggcagatgatattattcccattttacaaatgagaaatggagacacaaaaaggctaagcaacttgccccagggtacagttagaaaagggaggagctaggtttcagtcttgccccaaagcctatggtttcaaccacaggttaccatgagtagtttaccaccagttcaaaattccattaaagttgtgccttaaaaatgcctacagtctgggcgcgatggctcacgcctgtaatcccagcactttgg

SEQ ID NO: 124396 - DNA, 601 bp, Human
cccgggttcaagtgattctcctgcgtcagcctgccaagtagctgggtttacaagcgcatgccaccacacctggctaatttttgtatttttagtagagatgaggtttcaccatgttagccaggctggtctcaaactcctgacctctagtgatccacctgccttggcctcccaaagtgcttgggattacaagtgtgagccaccatgcctggcctacctatttacattcttactggcactaatgagagtatctgtcttaatatactactttctgtagcattgactgacattttttataaatttctttttttttttttttttgagacggagtcttgctctatcgcctaggctggagtgcagtggcgcaatctcggctcactgtaagttctgcctcctgggttcacgcccttctttctgggactacaggcgcccgcccgccaccatgcccagctaatttttttatttgtttttagtttttagtagagacggggtttcactgtgttagccaggatggtcttgatctcctgaacttttgatctgcccgcctcagcctcccaaagtgctgggattacaggcgtaagccaccacacctggccatttttta

SEQ ID NO: 124397 - DNA, 601 bp, Human
aatcacttgaacccaggaggcggaggttacagtgagctgagatcgcgccactgcactccagcctggcaacagagggagactccgtctcaaaaaatatatatagagagagagagcatgcacttggcactcaatgtttttattgtatttcattatttcctctgaatccattttgttttttattgtatgttatttattctttatttgtgtttttttaaattgttattttttttttttttttttttttttttgaggcagagtctcaccctgtctctcaggctagagtgcagtggttcgatcttgrctcactgcaacatctgcctcccaggttcaagcgattttcctgcctcagcctctggagtagcgggattacaggcattcaccgccacgcccagccaattttgtatttttagtagagacgggctttctccatgttggtcaggctggtctcaaaactcccgacctcaggtgatccgcccaccttggcctcccaaagtgctgggattacaggcgtgagccaccgcgcccagccacgccaggctaatgtttgtattttcagtagagacagggtttcaccatggcggccaaactggtctcgaactcc

SEQ ID NO: 124398 - DNA, 601 bp, Human
aggttacagtgagctgagatcgcgccactgcactccagcctggcaacagagggagactccgtctcaaaaaatatatatagagagagagagcatgcacttggcactcaatgtttttattgtatttcattatttcctctgaatccattttgttttttattgtatgttatttattctttatttgtgtttttttaaattgttattttttttttttttttttttttttttgaggcagagtctcaccctgtctctcaggctagagtgcagtggttcgatcttggctcactgcaacatctgcctcccrggttcaagcgattttcctgcctcagcctctggagtagcgggattacaggcattcaccgccacgcccagccaattttgtatttttagtagagacgggctttctccatgttggtcaggctggtctcaaaactcccgacctcaggtgatccgcccaccttggcctcccaaagtgctgggattacaggcgtgagccaccgcgcccagccacgccaggctaatgtttgtattttcagtagagacagggtttcaccatggcggccaaactggtctcgaactcctgacctcaggtgatccacctggc

SEQ ID NO: 124399 - DNA, 601 bp, Human
cacagctccctacagcctccaagtcttgggctcaagtgatcctcccgcctcagcctaccaatagttgagactataggcgtgtgccagcacacccaactttttttttttttttttttgagacggagtctcactgtcgcccgggctggagtgcaatggcgcaatcttgggtcactgcaacctctgcctcctggattcaagcaattctcctgcctcagcctcccaagtagctgggactacaggcatgcatcaccatacctggctaatttttgtttttgtttttgttttgttttgagtctagctstgtctcccaggctggagtgcagtggcacaatctcggctcactgcaacctccgcctcctgggttcaagtgattctcctgcctcagcctcccaagtagctgggattacaggtgcccgccactatgcccagctaattttttgtgtttttagtagagacagggtttcaccatgttggctgggctgctcttgaactcctgacctcgtgattcgcctacctcggcctcccagaatgctgggattacagacgtgagccaccacgcctggccaatttttgcatttttaatggagatagggtttcacct

SEQ ID NO: 124400 - DNA, 601 bp, Human
tcagcctcccaagtagctgggactacaggcatgcatcaccatacctggctaatttttgtttttgtttttgttttgttttgagtctagctgtgtctcccaggctggagtgcagtggcacaatctcggctcactgcaacctccgcctcctgggttcaagtgattctcctgcctcagcctcccaagtagctgggattacaggtgcccgccactatgcccagctaattttttgtgtttttagtagagacagggtttcaccatgttggctgggctgctcttgaactcctgacctcgtgattcgccyacctcggcctcccagaatgctgggattacagacgtgagccaccacgcctggccaatttttgcatttttaatggagatagggtttcaccttgttggccaggctggtcttgaactcctcaagtgatccacctgccttggcctcccaaaataataggattacagcatgagccactgctcctggtctaatttttaaaatcccttcttaaattcacaagtcattcaaacgtgtggattaaacattatctattctgctgatttaacattttaatataaaaaacaggaagctattaatttgtaatgt

SEQ ID NO: 124401 - DNA, 601 bp, Human
gtcttggaccgggtgtggtggctcatgcctgtaatcccagtactttgggaggccaaagtgggaggattgcttgaggccaggagttcaagaccaacctggtcaacatagtgagaccccatctatttaaaaaagaaaaaaaaaaaagaaagctcattctggtggcaatggggagaatggtttggaaggaaagattggagtcaggaaaatcaattcagcccagcctttcttctctagactgcactgccagctctcatatatcagatttccatgtaattctggtctatacactttagtcatctcmacaaccctgtcttaattactgtagcttataaaagctacactaggccagaagtgttggttcacgcctgtaatcccagcactttgggagacagagacgggtggatcactagttcaagagagcaggaccatcttggccaacgtggtgaaaccctgtctctactaaaaatacaaaaattagctgggcatggtgatgtgcgcctgtagtcccagctactcaggaggctgaggcaggagaatcacttgaacctgggaggcggaggttgcagtgagccaagattgcgccactgcactccagcctctt

SEQ ID NO: 124402 - DNA, 601 bp, Human
attttggtatttttgtagagccagggtttcaccatgttggccaggctagtctcaaactcctgacctcaagtaatccgcctgccttggcctcccaaagtgctgggattacaggcgtgagccacctcacccagtgaaaggtagcaatttcattagtaagagtcgatatgaatgcaatccttttgggaataatgagaaatgacactactcgcaagtatggctatattggctgataatatagcatgtgacaatgtttcttgatctgcagagatatgagctcatttttctttttaattttcttttttttttttttttttttttttgagatggagtttcactcttgttgcccaggctggagtacaatggcatgatctcggctcactgcaacctctgcctcccaggttcaagcgattttcctgcctcagcctcccaagtagctgtgattacaggcatgtgccaccatgcccggctaattttgtatttttagtaaagactgggtttctccatgttggtcaggctggtctcgaactcccgacctcaggtgatccacccaccttggccccccaaagtttgggattacaggcatgagccactgcacccagcc

SEQ ID NO: 124403 - DNA, 601 bp, Human
taatatagcatgtgacaatgtttcttgatctgcagagatatgagctcatttttctttttaattttcttttctttttttttttttttttttgagatggagtttcactcttgttgcccaggctggagtacaatggcatgatctcggctcactgcaacctctgcctcccaggttcaagcgattttcctgcctcagcctcccaagtagctgtgattacaggcatgtgccaccatgcccggctaattttgtatttttagtaaagactgggtttctccatgttggtcaggctggtctcgaactcccracctcaggtgatccacccaccttggccccccaaagtttgggattacaggcatgagccactgcacccagcctttttaatttttttctcttagtgatcttttaaagacaacttctgttttatagggataacgcctataatcccagcaatttcataattgaaagattttattcattgaaaatccagtttttaatattatttaaattgtggtaagacatacataacaagaacttaccattttaaacttttttttttttttttttgagatggagtttcactcttgttgcccacactagagtgcaa

SEQ ID NO: 124404 - DNA, 601 bp, Human
ttttttttttttttttgagatggagtttcactcttgttgcccaggctggagtacaatggcatgatctcggctcactgcaacctctgcctcccaggttcaagcgattttcctgcctcagcctcccaagtagctgtgattacaggcatgtgccaccatgcccggctaattttgtatttttagtaaagactgggtttctccatgttggtcaggctggtctcgaactcccgacctcaggtgatccacccaccttggccccccaaagtttgggattacaggcatgagccactgcacccagcctttytaatttttttctcttagtgatcttttaaagacaacttctgttttatagggataacgcctataatcccagcaatttcataattgaaagattttattcattgaaaatccagtttttaatattatttaaattgtggtaagacatacataacaagaacttaccattttaaacttttttttttttttttttgagatggagtttcactcttgttgcccacactagagtgcaatggcatgatctcggctcactgcaacctccgcctcccaggttcaagcaattctcctacctcagccccctgaatag

SEQ ID NO: 124405 - DNA, 601 bp, Human
ctcccaaagtgctaggattacaggcgtgagccactgcgcccagcgattttattttattttatttctttatttattttattttatttttttgagacggagtcttgctctgtcgcccaggctggagtgcagtggcgcgatgtacgctcactgcaagctccgcctcccgggtttacttacaccattctcctgcctcagcctcccgagtagctgggactacaggctcccgccaccacgcccggctaattttttgtatttttagtagagacggggtttcaccgtgttagccaggatggtctcgatytcctgacctcgtgatccgcccgccttggcctcccaaagtggtgggattacaggcgtaagccaccacgcccggcgattttaaacatttttaagtgttcaattccatggcagtaagcactttcatagtattatgtaaccatcaccactatttcatcatcccaaatagaaactctatacctgtttagcattccttttcccctcctctcccaagcctctggtaaccaccattctttctatctctatgaatttgtctattctaggtaactcgaataagtggaatcatacaataattgttatttta

SEQ ID NO: 124406 - DNA, 601 bp, Human
gccaccgtggccagcctcataatcacatttaatacaaaataaagtcacgttgtaaagactcaaatttatacatcacaatgtataaaggtaaaaattttatttttaaagaataaaattacaaaaattaaagaatttctccaaattcatatagttagtaaaaagacagatagtgttgggaccatgatgccttcatgcccagtccatttcttgttctaacaaattaaaacttcccgggttggagtgggagaggagcttttttcctttatatggttttttttttggttttggtttttcttttttytttttttttttttttggtagagagaggtcttgctatattccccagcctggtcttgaattcctggccttaaacagtgtgcccgccttccaaagtgctaggagctgggattacaggcatgagccaccacacccagcttcttactgatttattttcttttcttttttttttttttttttgagacacagggtctcacattgtcacccaggctgtagtgcagtggtgtggtcatggttcactatagcctcaaaatcccaggctcaagcgttcctcccacttcagcctcccgagtcagtgggacta

SEQ ID NO: 124407 - DNA, 601 bp, Human
aaaaatcaagtaatctagggagaaaaaatgggagagggtatgtgtagagatttgagggaaacccaaaatatacacaaaatagtttatgacttaaaaaaaaaaaaaacgcaaaaaaaggtatgatgaggacaatacaaaactaaacctgtaaactaaacctgtttgctgggcgcagtggctcacacttgtaatcccagcactttgggaggctgaggcggatggatcacaaggtcaggagttcaagaccagcctgtccaacatggtgaaaccccatctcaaataaaaatacaaaaattagccsggtgtggtggcgggtgcctgtaatcctaactactgagctgaggcaggagaatcgcttgaactctggaggcagaggttgcagtgagccaagatcgcgctgctgtactccagccagggcgacagagcaagactcttaaaaaaaaaaaaaaatggccattatctccacttaactggtgaagaaactgtggctcaagaaagttaagtaacttgcacaaatcagacctgcaattatttattggagagttgaagtaacaggtgcattagctggacagttgctcaaaatgagtccaacttaagtgat

SEQ ID NO: 124408 - DNA, 601 bp, Human
aaactaaacctgtttgctgggcgcagtggctcacacttgtaatcccagcactttgggaggctgaggcggatggatcacaaggtcaggagttcaagaccagcctgtccaacatggtgaaaccccatctcaaataaaaatacaaaaattagccgggtgtggtggcgggtgcctgtaatcctaactactgagctgaggcaggagaatcgcttgaactctggaggcagaggttgcagtgagccaagatcgcgctgctgtactccagccagggcgacagagcaagactcttaaaaaaaaaaaaaaatggccattatctccacttaactggtgaagaaactgtggctcaagaaagttaagtaacttgcacaaatcagacctgcaattatttattggagagttgaagtaacaggtgcattagctggacagttgctcaaaatgagtccaacttaagtgataccaaaatgtcactgtattattatttgtaaggttacagaggagttttatttaccagaactatttttagggaatatagtatatgttttgggaaaataaagaatatataagttgtttggggtgccaatgggatcaagatccccttggggta

SEQ ID NO: 124409 - DNA, 601 bp, Human
taatctcagctacttgggaagctgaggcaggagaatcgcttgaacctgggaggcagaggttgcagtgagccaagatcacaccattgcacttcagcctggatgagagagcaagactccgtctcaaaaataataataataataacttcacatttgtttttaaatgacagcgtgattgaaataaattttttaacttctgttcggattttttttcctgacatgggtacttctctttacatctatagctttaaaaagttttattataaatttcaaaaacatacaaaagtataaagaatagtatcayaaacccccatttgcctattacctaaacccactgattatcgagactttactatacagtgcttgtttcttcacctatccctaacttaacatcttttgtgtatatgaaacattttaaagaaaactccaaccaccaggttttttaccccaaggtacttaggtctgcatctcttaagaagatgggacacttttcatctagctacagacagccattatcattacatctaacaatattaacaataacagtaattctttggtgtccaccaacacccagtccatatcagaatttcttcaggtagctcaa

SEQ ID NO: 124410 - DNA, 601 bp, Human
ttttttttttgagacggagtctcactctgttcccgcccagcctggagtgcagtggtgccatctcggctcactgcaacctccacctcctggattcaagcggttctcccccctcagtctcccaagtagttgagattacaggcatccaccaccacacctggctaattttttgtatttttagtagagatggggtttcaccatattggccaggccaggctgatcttgaactcccgacctcaggtgatccacctgcctcggcctcccaaagtgctgtgattatagccatgaaccactgtgtccggtttttttttttttttttttttgcacacggcaaatcagatttgggtctaactttttggggggcaagaatatttcataggctgtaccatgtactttgcatcatatcaggagacacgtactatctgttagacctatagtgaatctacagttgatcagtgagttcagatggcaatgactccctttattttaaagacccccatcaaactttcatatgttctcatgcctattgcctgaatcattaattacctagaagttgcaaaatgcttagtttccaatagtctcacatattctatgtgtactatct

SEQ ID NO: 124411 - DNA, 601 bp, Human
ctcctggattcaagcggttctcccccctcagtctcccaagtagttgagattacaggcatccaccaccacacctggctaattttttgtatttttagtagagatggggtttcaccatattggccaggccaggctgatcttgaactcccgacctcaggtgatccacctgcctcggcctcccaaagtgctgtgattatagccatgaaccactgtgtccggtctttttttttttttttttttgcacacggcaaatcagatttgggtctaactttttggggggcaagaatatttcataggctgtacyatgtactttgcatcatatcaggagacacgtactatctgttagacctatagtgaatctacagttgatcagtgagttcagatggcaatgactccctttattttaaagacccccatcaaactttcatatgttctcatgcctattgcctgaatcattaattacctagaagttgcaaaatgcttagtttccaatagtctcacatattctatgtgtactatctataattcttttgtaaaacagaatcttcactattaattaaggctacttagttaccctgctatgtataataatttgaaacaaaaa

SEQ ID NO: 124412 - DNA, 601 bp, Human
actatcttgtatactttcctgctccaattctgaaatcagccatttctccaaagagcctttgtttgtcttagtagggaatggtatttagagtccataaccagcatagtaggagtgttcattgcaatagtgttatttatttatttttttagacagagtcttgctctgttgcccaggctggagtgcagtggtgcgatcttggctcactgtagcctctgcctccctggttccagcgagtctcctgcctcagcctcctgggtagctgggattacaggtacacgccaccatgcccagctaatttttrtatttttagtagagacaggggtttcaccatgttggtcaggctggtctcgaactcctgacctcaggtgacctgcctgcctcagcctcccaaagtgttgggattacaggcatgagccaccacgcctggccgctatagtgttattatttctcattgctacttgacctttatagtggacagagctaagatgtatgttttttatgtgcttttgtattttttagagacaggatctcactgttacccagggtggagtgaactggcgtgatcacacttcactgtagccttgaactcctgggttcaggc

SEQ ID NO: 124413 - DNA, 601 bp, Human
caaagagcctttgtttgtcttagtagggaatggtatttagagtccataaccagcatagtaggagtgttcattgcaatagtgttatttatttatttttttagacagagtcttgctctgttgcccaggctggagtgcagtggtgcgatcttggctcactgtagcctctgcctccctggttccagcgagtctcctgcctcagcctcctgggtagctgggattacaggtacacgccaccatgcccagctaatttttatatttttagtagagacaggggtttcaccatgttggtcaggctggtctygaactcctgacctcaggtgacctgcctgcctcagcctcccaaagtgttgggattacaggcatgagccaccacgcctggccgctatagtgttattatttctcattgctacttgacctttatagtggacagagctaagatgtatgttttttatgtgcttttgtattttttagagacaggatctcactgttacccagggtggagtgaactggcgtgatcacacttcactgtagccttgaactcctgggttcaggcaatcctcctgtgtcagcctcccgagtaactgggactacaggcactcac

SEQ ID NO: 124414 - DNA, 601 bp, Human
actatcctccttggtactgtccttgtcagtgagttctggcaagatctgcttgtttagaagtgtatagtacttcctccctctctctcttgctcctgcctctgccatgtaggatgcttgctccccctttgccttctgccatgattggaagcttcctgaggcctcctcaaaagtggaaactgctatgcttcctttatagcctgcagagccatgagccaattaaacctcttttccttataaattacccagtctcaggtatttctttatagcaatgtgagaaggaactaatgaacccaggctggtytggaactcctaggctcaagcaatcctcccacctcagcccctcaaagtgctgagattatggatgtgagccaccacgcgcagccccagccccaaggttttgttttcttttgtttttttcattttatttgagacagagttttgctctgtcacccaggatgaatgcagtgacacaatcacggctcactgcagcctaactcccgggtgcaagggatccttccacctcagcctcccgagtaactgggaccacaggcatgcaccaccttgccagctaccttttttttttttcggtagagatggagtc

SEQ ID NO: 124415 - DNA, 601 bp, Human
tttgagctcctgagctcaagcaacccacccacctcagccttccaaagtgctgggattacaggtgtgagccatcacacccagactagagtgtgttttttgttgttcttgtttttttgagacggagtttcgctcttgttgcccaggctggagtgtaatggtgcaatctcggctcactgcaacctccacctcctggattcaagcaattttcctgcctcagcctcccaggaagctaggattacaggtgcccaccaccacgcccagctaatttttgtatttttagtagagacgaggtttcaccacrttggccaggatggtctcaatctcttgacctcgtgatccacccgcctcggcctctcaagaagctgggattacaggcgcctgccactatgcccagctaaatttttgtatttttagtagagacgggattttgccgtgttggccaggctggtcttgaagtcctgaactcagatgatccacctgcctcggccttccaaagtgctgggattacaagcatgagccactacacccggcctagagtgtgttttttacttatgatattttcaatttaggatgggtttattgggacgtagccagattgtaa

SEQ ID NO: 124416 - DNA, 601 bp, Human
gacctcgtgatccacccgcctcggcctctcaagaagctgggattacaggcgcctgccactatgcccagctaaatttttgtatttttagtagagacgggattttgccgtgttggccaggctggtcttgaagtcctgaactcagatgatccacctgcctcggccttccaaagtgctgggattacaagcatgagccactacacccggcctagagtgtgttttttacttatgatattttcaatttaggatgggtttattgggacgtagccagattgtaagccagggagtatatatatatatataattgagatggagtcttgctctatcgccaggctggagtgcagtggctaattttttgtatttttagtagagacggggtttcaccatgttggccaggatggtctcgatctcttgacctcatgatctgcccgcctcagccctccaaaatgctgagattacaggtgtgagccactatgcctggcctatatatatatacacacatatatatatacacacacacatatatatacacacacatatatatatacatacacacacacatatatatatatatacacacacacacatatatatatatatattt

SEQ ID NO: 124417 - DNA, 601 bp, Human
cctcgtgatccacccgcctcggcctctcaagaagctgggattacaggcgcctgccactatgcccagctaaatttttgtatttttagtagagacgggattttgccgtgttggccaggctggtcttgaagtcctgaactcagatgatccacctgcctcggccttccaaagtgctgggattacaagcatgagccactacacccggcctagagtgtgttttttacttatgatattttcaatttaggatgggtttattgggacgtagccagattgtaagccagggagtatatatatatatatatttgagatggagtcttgctctatcgccaggctggagtgcagtggctaattttttgtatttttagtagagacggggtttcaccatgttggccaggatggtctcgatctcttgacctcatgatctgcccgcctcagccctccaaaatgctgagattacaggtgtgagccactatgcctggcctatatatatatacacacatatatatatacacacacacatatatatacacacacatatatatatacatacacacacacatatatatatatatacacacacacacatatatatatatatattttt

SEQ ID NO: 124418 - DNA, 601 bp, Human
tgatccacccgcctcggcctctcaagaagctgggattacaggcgcctgccactatgcccagctaaatttttgtatttttagtagagacgggattttgccgtgttggccaggctggtcttgaagtcctgaactcagatgatccacctgcctcggccttccaaagtgctgggattacaagcatgagccactacacccggcctagagtgtgttttttacttatgatattttcaatttaggatgggtttattgggacgtagccagattgtaagccagggagtatatatatatatatatttgagayggagtcttgctctatcgccaggctggagtgcagtggctaattttttgtatttttagtagagacggggtttcaccatgttggccaggatggtctcgatctcttgacctcatgatctgcccgcctcagccctccaaaatgctgagattacaggtgtgagccactatgcctggcctatatatatatacacacatatatatatacacacacacatatatatacacacacatatatatatacatacacacacacatatatatatatatacacacacacacatatatatatatatatttttttttg

SEQ ID NO: 124419 - DNA, 601 bp, Human
aggctagagtgcaatggcgtgatctcagctcaatgcaacctctgcctcccgggttcaagcgattctcctacctcagcctcccgagtagctgggattacaggcatgcgccaccacacctggctaattttgtatttttagtagagatgaggtttctccatgttgttaaggctggtctcgaactcgcgacctcaggtaatccgcccacctcggcctcccaaagtactgggattacaggcgtgagccaccgcacctggcatatacatgaatttttttgtttgtttggttggttgtttttttgtttgttttttttgagatagagtcttgctctgtcacccaggctggaatgcagtggcgctatctcgactcactgcaagcttcgcctcccaggttcacgccattctcctgcctcagcctcctgagtagctgggactacaggcgcccaccaccacgtccggctaattttttgtatttttagtagaaacggtttcactgtgttagccaggatggtctcaatctcctgacctcatgatccacccgcctcggcctctcaaagtgctgggattacaggcttgagccaccatgcctggcccatatacactag

SEQ ID NO: 124420 - DNA, 601 bp, Human
ttcgttttatttaaagttacccttgacttacatagttttaaccttctggaaagttcttcttttttctctctctcttcctgttcctgattgccacactggatagaaagttctaaatgaatacttaggtttgaaagtatttttctacatctatttattttgccattctacagatttggctccattgtcctaaggtttcagcacaataaaaatctcgtttctcccagtgcttgtcttgacatcaatgtagcattaaaaagtccaagacttttacagactaatttaagctgaacaaggaaatatmatctggtacctactaagaaacataaatgggcctgggttgctagcagttcctggaagtcactgtgttttccaataaatccatgcaaatcgtaacagggaaagagaagccacaaagcagaggctgggactgttgggatcatgttagtaattaaactctctctcctcttgagactcagtgagagccttccccttacaaaaaaacaaaaaagaccatagcttgctgccaaagcggatctgaccacgcgtcctctcactctaagagattaaaataaagcctcctgcagtccttttctccaaatac

SEQ ID NO: 124421 - DNA, 601 bp, Human
atttttgtgtttttagtagagatgagttttgccatgttgcctaggctggtcttgaactctttgggctcaaatgatctgcccacttcagcctcctaaagtgctaggattgcaggcgtgagccaccatgccagccagtctctttttaagaccctcttcctgatcatttgagcccaggaagtcgaggccgcaatgagccatgcactccactgccactgcactctagcctggacaacagagatcctgtctcaaaaaaaattaatgtccttaaaaaacaaacaacagaccaggcacggtggctcaygcctgtaatcccagcactttgggagactgaggcaggttgatcacctgaggtcaggagttcgagactagcctggccaacatggtgaaaccccgtctctactaaaaatacaaaaattagccaggcctggcggcgggcgcctgtaatcccagctactcaggaggctgaggcaggagaatcgcttgaacccaggaggcggaggttgcagtgagttgagatcacaccattgcactccagcttgggcgacaagagtaaaactccatctaaaaaaaaagaaaaacccaaacaaaaagaacactagtt

SEQ ID NO: 124422 - DNA, 601 bp, Human
acaaacaacagaccaggcacggtggctcacgcctgtaatcccagcactttgggagactgaggcaggttgatcacctgaggtcaggagttcgagactagcctggccaacatggtgaaaccccgtctctactaaaaatacaaaaattagccaggcctggcggcgggcgcctgtaatcccagctactcaggaggctgaggcaggagaatcgcttgaacccaggaggcggaggttgcagtgagttgagatcacaccattgcactccagcttgggcgacaagagtaaaactccatctaaaaaaaaagaaaaacccaaacaaaaagaacactagttgcctctgaagatggtgagcctctgaagatgcctctgaggctcaattttgagggaattctatatcctgttaaaagtccaaggtgcagcatgtaccagatggctgtatgccctcctctttctggggcagggttgacagtaataggcaggaatgtatcatatatatgtatcatatattttgtggttttcagcagtgggttttttttttcctttcttaatagaaattgatgctatttaatttttataccttttgttgttgtttttaatggggttt

SEQ ID NO: 124423 - DNA, 601 bp, Human
aagttgcagctgtttgtgtgtgttgtaattcaagatgatgtgttgctacatctactagtttggtacaactgttatgatcagatagacctagttccttaaggctgagacacaacagtctggtttctgtaatggaaggatgagtaggctttattctgttttgttgctttttttctttctttcttttaaataatacattctaagcctcgatcctggactttgcaggaaaaaaaaaaaaaagaataatacattctaccctcacatatagtcaattgattttcaacaatggtgccaagacaattcatggggaaagaatactcttttcaacaaatggtgatggaacatccacatgcaaaataatgaagttgactttgggaggccgaggcaggaggatcatttgaacctagggagtttgagaacagccaaggcaacagagtgagaccctgtctctattcaaaaaaacaaaaagaaagaaagaaaaaagaatgaagctggactcctccctcacaccacacacaaaaattatctcaaaaaaaaatctaaatataaagactaaaactataaaattcttaaaagaaaatataggaatcttcttgagcttgga

SEQ ID NO: 124424 - DNA, 601 bp, Human
ctgttgcgttgcctgctgggctgagtgggcagaacaaacccagtgggtgcaagcaatactcaggcagaaggcatcactggccacagaggtttctagctggcgaagcaacaccccaaggatcctgtgacaatttattgaatatgacaccaaaacagtaatcaacaaaagaaaaaatagataaattggacttcgtcaaaattaaaaacttttatgcatcaaaggacactatcaagagtgaaaagacaatctaaagaatgggagaaaatgtttacaagccacatagctcatcagggattgataytcagaatatataaagaagtcttacaacaaaaagacaaaaaatagggtgggcacagtggttcacacctgtaatcccaatactctggaggcagagagaataataatacattattattattgcttgaagccaggagtttgagacccgcctggaatttgagacagggatgatccctccacctcagtgcctcccaagtagctgagactacaagtgcgcaccaccatgcctggctaatttttttgtattttttgtagatatgaggtttcaccatgttgcccaggctggtctcgacctctgaggctc

SEQ ID NO: 124425 - DNA, 601 bp, Human
tcaagactgcccatggtggagtattagtccccacaacctaactggcatcaagaatcagggaaaccagaccaggcgtggtggctcatgcctgtaatcccagcactttgggaggctgaggtgggcagatcatgaggtgaggagttcgagaccaacctggccaacatagtgaaacccctctctactaaaaatacaaaaattagctgggaatcgtggcacgtgcctgtagtcccagctacttgggaggctgaggcaggagaatcgcttgaacccaggaggcagaggttgcaatgagccaagatcrcaccactgcactcgtagcatgggcaacagagcgagactccgtattaaaaaaaaaaaaatcaaggaaactttcttagaaacagctgggtcttaatagtctcaacaagttaaggagagtttctgggcttcagaccccgcatttccccccatgccctgaagagcattatagaccctgtactttaagaagagtaaaagtcctgagtatcctgttaggaatcatcccatccctgggcagcttctcctcagtactaaccatgaggaaggggaactgagggccctttcacccagagaggactcttca

SEQ ID NO: 124426 - DNA, 601 bp, Human
acacatattttgtatctttatcatatactgtatttttacaataaagtaagctagagaaaagaaatgttattaagaaaatcataaggaagagtaagtgtatttactattcatgaagtggaaatggatcatcatgaaggtcttcatccctgtcttcacattgagtaggctatcttgctgtctcaggggtggcagaggcggaagaggtggaggaagtggatggggaggcggaagaggtggaggaagtggatgggaaggcgggagaggcaggcacacttggtgtaacttttgttgaaaaaatatmtttgtataagtggacccacgcagttcaaacgtgttgttcaagggtcaactgtggtcatattgtcggggttctttagccattaggtctcagaaattagcctgaatttagccagacatagtagcacacgcctatagttccagctgcttgagaggctgaggcgggaagatcacttgaacccagactgcagtgggctatgatggtgtcactgcactccagcctgggtaacacagtgagactccatatcaaaaaaaagaaaaaaagaaaaaaaaaagaaaaggaaagaaattaacccgaatttgt

SEQ ID NO: 124427 - DNA, 601 bp, Human
ataatcttacacttcattcatctgtctttacaaagttacagagctgaagccatatcctgtttcttcagcactcatctatactttaaaaattctaggccaggcatggtgggtcacgcctgtaatctcagcactttgggaggccgaggcgggcagatcacctgaggtcaggagttcgagaccagcctgcccaacatctgcgaaatgctgtctctactaaaaatacaaaaaattagctgggcatggtggtgggcacctgtaatcccagctactcaggaggctgaggcaggagaattgcttgaayccaggaggcggaggttgcagtgagccgagcttgcaccactgcactccagcctgggtgacaagagcgaaactccatgtcaaaaaaaaaaaaaaattctaatcagatgccagtctcactgtcattctccaatcttcccactataacatatttagttcattgtcctgcccgtgttctaattttgcagttttcctagactgatcctctgtgatccaacaattaattataaattattaattataaattaattaattataaattaataaaaattgtgatcccacaattaatttcaaatttattaaa

SEQ ID NO: 124428 - DNA, 601 bp, Human
actttgggaggccgaggcgggcagatcacctgaggtcaggagttcgagaccagcctgcccaacatctgcgaaatgctgtctctactaaaaatacaaaaaattagctgggcatggtggtgggcacctgtaatcccagctactcaggaggctgaggcaggagaattgcttgaacccaggaggcggaggttgcagtgagccgagcttgcaccactgcactccagcctgggtgacaagagcgaaactccatgtcaaaaaaaaaaaaaaattctaatcagatgccagtctcactgtcattctccartcttcccactataacatatttagttcattgtcctgcccgtgttctaattttgcagttttcctagactgatcctctgtgatccaacaattaattataaattattaattataaattaattaattataaattaataaaaattgtgatcccacaattaatttcaaatttattaaatagaacctgagaaaaaattatgcagtatttttttcattagatgattgtcagcctcctaccaacaagcatatgctagatgttacccatgaaaacttaagtagtcaggccaggcacagtggctcacgcctg

SEQ ID NO: 124429 - DNA, 601 bp, Human
aaaaaaaaaaaagagaaaaggaaaagtagtcatgatccctcccttggactcatttccagtgtaaaggttattaacctttttgtaattgggatgtattatgaatgactgctcaattcaacaatgtacctttttcctcagtaattcctaaagaagtcatagaatgtatgtatttctttattgaataaagtctattaaaattattgtgattctaaggcatcttagggaatttcattatgtctcctaaagctagactcaaaaatagaattaggaattattcttctttagcaaccttcattatgtstcttaaagctagactcaaaaatataattaggaattattcttctgtagcaacctcaagcagtccaggatcagtcctcagctccaccttttgtgacagtgggcaggcacattcatgctctgaccctcaggcttctcttcatcaaataggagccttgtgttagattatctctgaggttttttcacaactagcattttgtggttcaataaacagaataattgtcctgcaaataggtacgtaccctaaatagggttacagataaaatacaaagtgcctaactaaattttagtttcagataaacaa

SEQ ID NO: 124430 - DNA, 601 bp, Human
acaagtaggaattagccaggtgcattccatatgagttcttccagatagctggagtccacatgcctgagggaatatgacagaagatcaagtgagggagccaggcaaatgccagatcacaaagaccatgtgtcaggtgaaggttatggaattgaaatgtcttaaaactataaggagctttgaagtacgtcaaaatgggcaataaattgatctgattttcattttagaaagacttcttttgacaacactgtggaaagcagcttgggaagggggctccagacttggtgcagtggaaccaataggyatggtcacgtgagaaatcagagtcagaaaaaaaagcagtggcaggggaaattgagagaaggagatagtttctagtgctgctacagaggtagctattctaaggcttgatgaccaattggttgtcaaagataagagggaggaaaaaaaacaaagggtctcccagatgtgtgcatttagtgactgcataatgcatcacctccactaaatgattcatctgttcttcatccctgttagtctggacaccaaaaatatcactctgcctaaaggggggaaacatttctttgagggaaaacccttttgc

SEQ ID NO: 124431 - DNA, 601 bp, Human
gattcatctgttcttcatccctgttagtctggacaccaaaaatatcactctgcctaaaggggggaaacatttctttgagggaaaacccttttgccctatagctaaactaagccattggaaactttttagggcagaaatgtcagaggcatgaacagggcttctggaggagggtgaggtctccaggttctcctggctagtgaagaggctcatgttctcattagcaaactgatggcctccatcgatggccgtgatactcacagggcgtggttcaaagccccagatcatcagggcttctagagtstacttaatcaggacaggcatttatttaaagtgctctgaagctaactgtcacaaatagggaaccttagtactggtcagttgggaaccaaggttattaccaagaagatagtgtcaggtgtcaagtgtggaagtcaggacaaggccagatgtaggagataagagtgaaaccagacgtgagaaggttggagcgtgtaaaggaaatgggtcacaggacaagcagttcagacctgaggccaagaagaggaaggcaagagttctcttgcggatctcagctagaaaacattgctgtagaacataggtc

SEQ ID NO: 124432 - DNA, 601 bp, Human
tctgattatactctaaacaagggctggcttattgagttttctgggaaagaggtgggcaattcccagaactgagggttcctcccattttagaccatagagcgtaacttcctgacgttgctatggcatttgtaaactgtcagtggcactggtgggagtgtcttttagcatgctgatgcattataattagcgtataatgagcaatgagaaccaccagaggtcactttcattgccatcttggttttggtgggattttggtgggatttttattgcaggttgttttatcagtaaggtctttatgacstgtattttgtgctgacctcctatctcatcctataagtaagaatgctaacctcctgggaatgcaacccagtaggtctctgccttattttagccagcccctattcaagatggaattgctgtggttcaaatgcctctgacatatttcaccccttccttttataagagaacccttaatcctaagggctgtagagggatgaagatccatcttctgtgacttcttcaggctgaataggggcaatgatattactgcctattagggtctcttgtatttggggtagagaggagctctgtcagaaagtgt

SEQ ID NO: 124433 - DNA, 601 bp, Human
ttggtgaaaaaaaagtttctccaattgtgttctgatacaaaagaaaacattcttattgcatttatgcaaataattatattgccataagttaaaaatgctcacaaatggtttctgaattttggagaaattgggcagagagaaacaaatatgcttcaaattttgttcacaggagtatactttactcaattgttaaaagctgttaatagctcaaaagaaaaatttccttggctctgaaaaacaaaagaaaggatcagcaacgttttaagccaaaagttaaaaaaagattgcttcagtcttctgtaggtcaatccatgcagttaactcctgttttgcttgatattcatgaacatttcagctcttcatgagtcctgaaagttttttcctctattttaatgtcacaatttacaaagttattagaaacctacattcaataacacctgttagagttctataattgattataaaaccaccttctaaagaggacaaagacaagacaacaattgtccgtgggtgacaaaacaccttaggatagcctctattaaagccacagttgactaagaattttggttacttctgtggcatacaacaatttttacataac

SEQ ID NO: 124434 - DNA, 601 bp, Human
ctagcctggtaggcgtgtatattttctgctgcaatatttaatgcttagttccttgcctacatctaagaaatattaattttagaaggaattggatactgatattggcaaatttttatgagactggctaaaggagaaagaagaaggggacctgtgatagaatcttccatgacaagggggaaatactggcctcagtctcctgcagaagcaggagctctggtacacaggtggggtgcccactggtacagctcccatctgacatgaagcaggcaagccaaaggggagcaagagcaatgcaacctgkaagacccatcctcagacattctgctattgcccccagacaatggaaggggggcgacagctgtccatgggggcactgctaagagggtgttgatcagcagatcaggactgtaactcaccatagtggtggactgccctgatctggagaccactgcctttcgagaataattcaccctacagaagctatctgagcatcaccagacagggtcttcctgggaattagcacatatcccaaatttccttcagctttgcctgcccacagtcccctgaaagccctccctttttctgggtgtgagaggaatgg

SEQ ID NO: 124435 - DNA, 601 bp, Human
aacaccttgacaaaggaatcattttacctcccaaacatagtcagtgttgatttcacaaaatatccctagaattactctttctgaggctaacaggactacttagatggttcctaaagtcccttctaactcctgcattctctggttaatgaatcagcattagtcatgtggaaggaaggtatcctcctcaaactctttttaagaatgatctcaaggaatccagagtgctcattaagttggtgaaagagtcagtgcagaatgcagctcatacatatatcctgatgtgatgttggcacctctcaaraagctgggaaagatgtccaggctggtcataggactcagcccctattatgggtccagcagccagtaatagtaagcaatgtctacttcaaaagatatctctggccaggtgcagtggctcaatcccagcactttgggaagctgaagcgggagcatcacttgagcccaggagtacaagaccagcctgggcaacatggcgagaccccatgtctaccaaaaaagaatttttttttttttttagacagattctcactctgttgcccatgttggagtgcaatggcatgatcttggctcactgcaactt

SEQ ID NO: 124436 - DNA, 601 bp, Human
ccatgttggccaggatggtgtctaacttctgacctcaggtgatctgccagtctcagcctcccaaagtgctgggattacaggcgtgagccactgtgcctggccaaaacaattgttttaattagctggccgtggttgtgcatgcctgtagtcccagctactcaagaggctgaggaaggaggattgcctgatcctaggaggttgaggctgcagtgagctgtgtttgcaccactgcactccagcctggatgacagagcaagaccctatttcaaaaaaaaaaagatatttctgaggagccatgctyattcaagactcactgctcttagaagaggtgttaatctggccaggtgccgtggctcacacctgtaatctgagcactttgggagggtgaggtgggaggatcatctgagacctggagttcaaggtcagcctaagcaacagactgagaccctgtctcttaaaaaaaataagagagagatgttaatctatattaaacaattgaatagtgtgaagattttgtaaaactttttaaatcaccgattatacaaaagctcttattgaattattaaggagttagcaattactattaatgctgttgaatatg

SEQ ID NO: 124437 - DNA, 601 bp, Human
tgaatagtgtgaagattttgtaaaactttttaaatcaccgattatacaaaagctcttattgaattattaaggagttagcaattactattaatgctgttgaatatgagtaagaacccacttaacttcaatcagaatccatcgatcaagcttaaagccttatctcatagttcccttcctggtctgtcagcattgcctcatagagagggaaatacatcccgcatctgcctcatcatgaacttgggtggccaccaggatattgctcatgaaagctgcttttctttctttttttttttttgagacrgagtttcactcttgttgcccaggttggagtgcaacggtgcgatctcggctcactgcaacctccgcttcccaggttcaagcgattctcctgcctcagcctcctgagtagccgggattacaggcgcccgccaccacacccaggtaattttttgcatttttagtagagacgtagtctcaccatgttggccaggctggtcttgaactcctgacctcaggtgatctacccgccttggcctcccaaagtgctgggattacaggcatcagccactgcgcctagcccaaaagttgcttttataaacag

SEQ ID NO: 124438 - DNA, 601 bp, Human
ataataatactccggtctccattacagctggctctgcatgaattaattacagccggctctgcatgaattaattactctttctctattgcaattcccgtgtattgataaatcgactctgtctaggcagcaggcaaggtgaacccactgggtggttacaacattagatagcaaattggcaattaaagaatatatctgtagagacaggatcttactaatgttgcccagctggtcttaaactcctggcctcaagcagccctcccaccacctcagcctcccaaaaggctgagattacaggggtgaracaccacacctggccaaattggcaatttttgaagaaagatttctcacaaggactttgcaagctttatgtactttatttgttgcaataatatgaaatgcatctttctgggaaggagaacacaggtaactgatttcagtgtaatacctagcactcatggcttgctaatcctttttatatcctatgagaaaggaaaaatccaggccgggcgcggtggctcaagcctgtaatcccagcactttgggaggccaaggcaggtggatcacgaggtcaggagttcaagaccagcctggccaagatggt

SEQ ID NO: 124439 - DNA, 601 bp, Human
acattagatagcaaattggcaattaaagaatatatctgtagagacaggatcttactaatgttgcccagctggtcttaaactcctggcctcaagcagccctcccaccacctcagcctcccaaaaggctgagattacaggggtgaaacaccacacctggccaaattggcaatttttgaagaaagatttctcacaaggactttgcaagctttatgtactttatttgttgcaataatatgaaatgcatctttctgggaaggagaacacaggtaactgatttcagtgtaatacctagcactcatgscttgctaatcctttttatatcctatgagaaaggaaaaatccaggccgggcgcggtggctcaagcctgtaatcccagcactttgggaggccaaggcaggtggatcacgaggtcaggagttcaagaccagcctggccaagatggtgaaaccccatttctactaaaactacaaaaattagccaggcgcggtggcaggtgcctgtaatcccagctactggggatgctgaagcaggagaatcacctgaacccgggcggcagaggttgcgccactgctctccagcctgggcgacagagtgaggctc

SEQ ID NO: 124440 - DNA, 601 bp, Human
ctactcgggaggctgaagcagaagaatcacttgaatctgggaggcggaggttgcagtgagctgagattgtgccactgtactccagcctgggcaagagagtgagactcaatctcaaaaaaaaaagaaaaaagaaaatagggctgaggcaggaggatcacttgataccaggagtttaagactagcctgggcaacatagcaagaccccatggctataaaattaaaaaaggattaaaaagtagataatattaaaacaccttagatttttcaaagtaatggagctcttttttttttttttttttttgagatggagccttgctctgtcacccaggctggagtacagtgacatgatctcggctcactgcaacctccatctcccaggttcaagcgatcttcctgcctcagcctcctgagtagctgggattacaggcacgcaccaccacacccagctaattttttgatttttagtagagatgtgcttcaccgtgttggccaggctggtctcgatttcctgatgtcaggtgatccacccgcctcagcctcctaaagtgccagcaccaatgtgcccggctggaatggagctcttaatataaattgtacttat

SEQ ID NO: 124441 - DNA, 601 bp, Human
acacactttccatctactcttcatagcagagttcttacaagagagatccacgcatgtgcttttcatttcaccattgactcagaagttacatttatgattttatcacaaagaaatattgagagaggcatacagagttatggataaggatgctcattacaacctttttacaatactaaaaaattggaaacaacctaaataattgatgatagggaggctttaaaaaattatggcatctataaatgagaatttggctttgctgcaaatagcagatgacccacaataactgtggtaggaggagggrtgctatctgggaccgtgtgatggctcactccccagagtccttgcagcttggtttcctcctttttcattactctactctgtctggcttcatacctaagattacttcacagaccaagagggcttctcctgttctagttatcagcaagagggactagacaaagaaaactggggcaactatcattcaccaactgtctcttaaggaagcatccaaaaactgacctacatgtttatctagggtagaattgttactatattagagaagacagaaactatgcttggacccaggccttgagctgattag

SEQ ID NO: 124442 - DNA, 601 bp, Human
aaaaattatggcatctataaatgagaatttggctttgctgcaaatagcagatgacccacaataactgtggtaggaggagggatgctatctgggaccgtgtgatggctcactccccagagtccttgcagcttggtttcctcctttttcattactctactctgtctggcttcatacctaagattacttcacagaccaagagggcttctcctgttctagttatcagcaagagggactagacaaagaaaactggggcaactatcattcaccaactgtctcttaaggaagcatccaaaaactgacytacatgtttatctagggtagaattgttactatattagagaagacagaaactatgcttggacccaggccttgagctgattagggttgaactttaggcaaagaacaactcagatagttagtctaaaaggagttttttctacatttatctgtttgaaatttcccagcatcaaattttatattttcctatattgaggggaaggggccccattaggatattttgcccttttgcccaatgtatacactttttaacccataatctgttttataaaattgcaatctttcggcctggcgcagtggctca

SEQ ID NO: 124443 - DNA, 601 bp, Human
tgtatgtagctattgtcattccaagacattttctctgttcccattgtccatttctccttcagctgcgtgagctcaggggcttatgttttacacactatattcagctccatttccaggaaacaaaactgaactttgtcctgatcccgctttatccctttctcctgatcctgtccctcacctgctgagctgtctgtcctgctcactgcaggagcactatgagaaccacgtggagtggccgacaggatagggctttgaaaagtacaaagctgccctctgtagaaaacaccctaaagcagaggtycccaacccccaggctgcagaccagtacaggtccgtggcctgttaggaaccaggcagcacagcaggaggtgagtgacgggcaagcaagcattactgcctgagctctgcctcctgtcagatcagcagtggaattagattctcataggactgcaaaccttattttgaactccgcgtgcgagggatctaggttgcacgcccctatgaggatctaatgccccccacccctgtccatggaaaaactatcttccatgaaactggtccctggtgccagaaaggttggggaccactgccataaggggtt

SEQ ID NO: 124444 - DNA, 601 bp, Human
gtacctgtaatcccagctactcaggagactgaggtgggagaattgcttgaacccgggaggtggaggttgcggtgagccgagattgtgccactgtactccagcctaggcgacagagcagtaatcccagcactttgggaggccaaggttgggccaatcacctgaggtcaggagttcaagaccaggctggccaacatggcgaaaccccatctctactaaaaatacaaaaattagctgggcgtggtggtgggtgcctgtaatcccagctactcaggaggctgaggcaggaaccccggaggcaaakgttgtagtgagccgagatctcaccattgcactccagcctgggtgacagagggagactccatctcaaaaagaaaaaaacaaaacaaaacaaaaaaaacctctgtcaaaagatgttcatgaggttaatgaagtaacatatctttgtactttttattaaagtactattactaatattctcataaagtgcatatcatcatgccttgtgctcaagttcatttttaacacatttgtctccccaacttgtggacagagccttgtctcattgatgttgtttcttaccctcagcaacaagcataaagct

SEQ ID NO: 124445 - DNA, 601 bp, Human
agtagctgggactacaggcgcccgccaccatgcttggctaattttttgtatttttagtagagacggggtttcgccgtgttagccaggatggtctcgatctcctgacctcatgatccgcccgcctcggcctcccaaagtgctgggattacaggtgtaagccactgcgcccggcctactaacaaatttcttgtgacacacttgctattaataaggaaactcaagttgacagtacagttgggaataatttctctggcctgcacttagtgccatagtagaagtataggatcatgctaacaccgtkgctagtgtagctataactggccatcattcgagctgagcatgggtttccattcagcccagaagtttcaactgcacacaagagatgatgaagcagcaacacagaagcacagacagaggtgtggagcacagtctaagccatggggagagattttctcacctgggctgcaccaggatgagagcataagctctccaccatcatccaaagcaaagctggctctgcagccatcaatgcaggaaactgggttctgtctggtcccagctctgtagtactgcaggaacatcataaagaccataaggaatg

SEQ ID NO: 124446 - DNA, 601 bp, Human
ctacaggcgcccgccaccatgcttggctaattttttgtatttttagtagagacggggtttcgccgtgttagccaggatggtctcgatctcctgacctcatgatccgcccgcctcggcctcccaaagtgctgggattacaggtgtaagccactgcgcccggcctactaacaaatttcttgtgacacacttgctattaataaggaaactcaagttgacagtacagttgggaataatttctctggcctgcacttagtgccatagtagaagtataggatcatgctaacaccgttgctagtgtagstataactggccatcattcgagctgagcatgggtttccattcagcccagaagtttcaactgcacacaagagatgatgaagcagcaacacagaagcacagacagaggtgtggagcacagtctaagccatggggagagattttctcacctgggctgcaccaggatgagagcataagctctccaccatcatccaaagcaaagctggctctgcagccatcaatgcaggaaactgggttctgtctggtcccagctctgtagtactgcaggaacatcataaagaccataaggaatggcagacaggac

SEQ ID NO: 124447 - DNA, 601 bp, Human
cgccgtgttagccaggatggtctcgatctcctgacctcatgatccgcccgcctcggcctcccaaagtgctgggattacaggtgtaagccactgcgcccggcctactaacaaatttcttgtgacacacttgctattaataaggaaactcaagttgacagtacagttgggaataatttctctggcctgcacttagtgccatagtagaagtataggatcatgctaacaccgttgctagtgtagctataactggccatcattcgagctgagcatgggtttccattcagcccagaagtttcaactrcacacaagagatgatgaagcagcaacacagaagcacagacagaggtgtggagcacagtctaagccatggggagagattttctcacctgggctgcaccaggatgagagcataagctctccaccatcatccaaagcaaagctggctctgcagccatcaatgcaggaaactgggttctgtctggtcccagctctgtagtactgcaggaacatcataaagaccataaggaatggcagacaggacagagttttgaaaagtacaaagctgggtgggtgcaatggctcatgcctataatcctagcac

SEQ ID NO: 124448 - DNA, 601 bp, Human
ccagcctcgctgtacagtttttaaacactatttcttcacttaaacctagcaaggaaagtagagctggcattacttttcctgatcttacacatgaggaaaccaagacattccatgttgaaataacttccagtagtaaagttttctgacttgcccaaggtgctgtaattaactagagttagagataaaagtagactttgatctcccccaaccaccaccccaccacccaccttgttctgcatggaagggtgggatcagaaccaggtgtttgagttatacgatctttttttttttttttttttttcttgagatagagtttccctcttgttggccaggatggagtgcaatggcgcgatctcagctcaactgcaacctctgcctcctgggttcaagtgattctcctgcctcagcctgccaagtagctgggattacaggcatgcgccaccaggcccagctaattttgtatttttagtagagacggggtttctccatattgatcaggctggtctcgaacccccgacctcaggtgatctgcctgcctctgcctcccaaagtgctgtgattacaggcgtgagccaccgcacccggctggcttttaaacaat

SEQ ID NO: 124449 - DNA, 601 bp, Human
cccaccacccaccttgttctgcatggaagggtgggatcagaaccaggtgtttgagttatacgatctttttttttttttttttttttcttgagatagagtttccctcttgttggccaggatggagtgcaatggcgcgatctcagctcaactgcaacctctgcctcctgggttcaagtgattctcctgcctcagcctgccaagtagctgggattacaggcatgcgccaccaggcccagctaattttgtatttttagtagagacggggtttctccatattgatcaggctggtctcgaacccccracctcaggtgatctgcctgcctctgcctcccaaagtgctgtgattacaggcgtgagccaccgcacccggctggcttttaaacaatatcaacaccgaaggggtgagattcttagagtgacagttcagagacagtcaggagagtaggggagatggaaacacctgctactaatggtaaggctcggctgcgactgcccagccctgggaaagcctttctctgcagagcacttgatcccacggaaacttggcagtaagagctttaaaaggaaagggagagggaaatgaaagcgagagggttctgtc

SEQ ID NO: 124450 - DNA, 601 bp, Human
gagtgcaatggcgcgatctcagctcaactgcaacctctgcctcctgggttcaagtgattctcctgcctcagcctgccaagtagctgggattacaggcatgcgccaccaggcccagctaattttgtatttttagtagagacggggtttctccatattgatcaggctggtctcgaacccccgacctcaggtgatctgcctgcctctgcctcccaaagtgctgtgattacaggcgtgagccaccgcacccggctggcttttaaacaatatcaacaccgaaggggtgagattcttagagtgacakttcagagacagtcaggagagtaggggagatggaaacacctgctactaatggtaaggctcggctgcgactgcccagccctgggaaagcctttctctgcagagcacttgatcccacggaaacttggcagtaagagctttaaaaggaaagggagagggaaatgaaagcgagagggttctgtcagggagctgctcggttttaacaaaggaggccattcccatggcacaacccttctttctgttatcaggagaccatgttgacattaccctgaattcacctaaactggtgctgactcttcatgag

SEQ ID NO: 124451 - DNA, 601 bp, Human
ctacttcagcctcctgaaatgctgggattccaggcataagacactgtgcccagccaaacatttattttttgaggttgtggtaatagctgtaataatagtgtataagtagtgtattaatagctgtaaaagtagtgtcttcccagctacttaggaggatgaggtgggaggattgcttgagcccaggaggtcaaggctacggtgagctatgatcatgccactgcactatagcctgcatggcagagcaggaacgcttaaccatctcatagataactagattagtcttcttctagggacctaaagrgcaaagcgataaagcgagcataaaagcagtttgaaaagtaagtgacagaagcatgaaaagcatcgtttttgaattagttcttacttggattccattgatgagcacaaaacagtaatctggttcaggatagaaatataaacattaggccgggcacggtggctcacacctgtaatcacagcaccttgggaggccaaggcgggtggatcaccaggtcaggagttgaagaccagcctggccacataacgaaaccccatctctaccaaaaatataaaaaattagctaggtgtggtggcatgcacc

SEQ ID NO: 124452 - DNA, 601 bp, Human
agcatgaaaagcatcgtttttgaattagttcttacttggattccattgatgagcacaaaacagtaatctggttcaggatagaaatataaacattaggccgggcacggtggctcacacctgtaatcacagcaccttgggaggccaaggcgggtggatcaccaggtcaggagttgaagaccagcctggccacataacgaaaccccatctctaccaaaaatataaaaaattagctaggtgtggtggcatgcacctgtaatcccagctactcggaaggcggaggcaggagaattgcttgaacccrggaggtagaagttgcagtgagccgagaaattgcgccactgcgctccagcctggccaacagagcaagactccatcttaaaaaaaaaagaaagaaagaaatataaacattaggccgggcacggtggctcacgcctgtaatcccaacactttgggaggccaaggcaagcggataactttagtcaggagtttgagaccagcacagccaacatggtgaaaccctgtctctactgaaaatacaaaaattagccaggcatggtggcacgtacctgtagtcccagctactcaggaggcagaggtgaga

SEQ ID NO: 124453 - DNA, 601 bp, Human; identical to SEQ ID NO: 29572

SEQ ID NO: 124454 - DNA, 601 bp, Human; identical to SEQ ID NO: 29573

SEQ ID NO: 124455 - DNA, 601 bp, Human; identical to SEQ ID NO: 29574

SEQ ID NO: 124456 - DNA, 601 bp, Human; identical to SEQ ID NO: 29575

SEQ ID NO: 124457 - DNA, 601 bp, Human; identical to SEQ ID NO: 29576

SEQ ID NO: 124458 - DNA, 601 bp, Human; identical to SEQ ID NO: 29577

SEQ ID NO: 124459 - DNA, 601 bp, Human; identical to SEQ ID NO: 29578

SEQ ID NO: 124460 - DNA, 601 bp, Human; identical to SEQ ID NO: 32545

SEQ ID NO: 124461 - DNA, 601 bp, Human; identical to SEQ ID NO: 32546

SEQ ID NO: 124462 - DNA, 601 bp, Human; identical to SEQ ID NO: 32547

SEQ ID NO: 124463 - DNA, 601 bp, Human; identical to SEQ ID NO: 45872

SEQ ID NO: 124464 - DNA, 601 bp, Human; identical to SEQ ID NO: 45871

SEQ ID NO: 124465 - DNA, 601 bp, Human; identical to SEQ ID NO: 45870

SEQ ID NO: 124466 - DNA, 601 bp, Human; identical to SEQ ID NO: 45869

SEQ ID NO: 124467 - DNA, 601 bp, Human; identical to SEQ ID NO: 45868

SEQ ID NO: 124468 - DNA, 601 bp, Human; identical to SEQ ID NO: 45867

SEQ ID NO: 124469 - DNA, 601 bp, Human; identical to SEQ ID NO: 45866

SEQ ID NO: 124470 - DNA, 601 bp, Human; identical to SEQ ID NO: 45865

SEQ ID NO: 124471 - DNA, 601 bp, Human; identical to SEQ ID NO: 45864

SEQ ID NO: 124472 - DNA, 601 bp, Human; identical to SEQ ID NO: 45863

SEQ ID NO: 124473 - DNA, 601 bp, Human; identical to SEQ ID NO: 45862

SEQ ID NO: 124474 - DNA, 601 bp, Human; identical to SEQ ID NO: 45861

SEQ ID NO: 124475 - DNA, 601 bp, Human; identical to SEQ ID NO: 45860

SEQ ID NO: 124476 - DNA, 601 bp, Human
aagggctcatacttcagtggaggagacaaaccttaatcagataatcttcctgaatcctcaggttgagggtctatgtggatgaaacactgggggctgaaggcccaagagagttggggactgacaggcccgaagatcctcattctttgcctcttgatcagtcctccccattccataccacatgggtcctttgagtagctgctcctgggagtaacccaggcctcatttttttttttctttctttctttctttttttttttttgagacggagtctcactgttgcccaggctggagcgaagtggtrcaatcttagctcactgcaacctctgcctcctgggttcaagtgattctcctgcttcagcctcctgagtagctgggattacaggtgtgtaccaccacgcctggctaattttcatatttttagtagagaagggatttcaccatattggtcaggctggtctggaactcctgacctcgtgatccacccacctcagcctcccaaagtgttgggattacaggcatgagccaccgcgcccagcctttttattttttcttgagtcaggatcttactctgtcacctggctggagtgcagtggcatgactg

SEQ ID NO: 124477 - DNA, 601 bp, Human
caagcaagttggtctctagcatcaagggctcatacttcagtggaggagacaaaccttaatcagataatcttcctgaatcctcaggttgagggtctatgtggatgaaacactgggggctgaaggcccaagagagttggggactgacaggcccgaagatcctcattctttgcctcttgatcagtcctccccattccataccacatgggtcctttgagtagctgctcctgggagtaacccaggcctcatttttttttttctttctttctttctttttttttttttgagacggagtctcactgtygcccaggctggagcgaagtggtacaatcttagctcactgcaacctctgcctcctgggttcaagtgattctcctgcttcagcctcctgagtagctgggattacaggtgtgtaccaccacgcctggctaattttcatatttttagtagagaagggatttcaccatattggtcaggctggtctggaactcctgacctcgtgatccacccacctcagcctcccaaagtgttgggattacaggcatgagccaccgcgcccagcctttttattttttcttgagtcaggatcttactctgtcacctg

SEQ ID NO: 124478 - DNA, 601 bp, Human
actttgtcacaaaaaaaaaaaaaaagaataggccgggtgcggtgactcacgcctgcaatcccagcactttgggaggctgaggcaggcggatcacctgaggttgggagttcgcaacaacagcgaaactccatctcaaaaaaagaaaggtgtcttttatttattcaaccaacagtcccccttgctatggggttcctgccccataggactctctgttcctagagggacaggtgtggaagctgtggcccagttgactggaggaatgctctttgccagccatgtatggaggggtctggtggaagtkctggagtggagggccctgcaaggggaggaactggcttctgggaaggctggtggtgacccacaaacacgcctactggcagtttatctcggatgaacttatcagtcctttctttctgccagagctgccaaacaatcagccttctgttaaatccagacaaaagggactcctcccttgccgtgacttggctggccctgcttgctagccctctgcctcaggcaggcctgtgggcctggcatttgggtcaggagcctccacccttgaccagcaccagcccctgcccctctctgtcaggcctggaga

SEQ ID NO: 124479 - DNA, 601 bp, Human
cgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagtccgcaaggaccgaacacccccaccccgatttagacctgcgggtgctgccccacgtcccccaccaaagcccatgtaaggagctgagttcttaaagactgaagacaggctattctctggagaaaaataaaatggaaattgtactttwaaaaaaaaatttctttaaatagctgcgtatttttctggaactgtacatttctgtaaatctccaatcaccttatgactctggttcttactaaagttttattcctttaaaaaataccttgttagtcttgcagattgtttcccaagacttcagtaggcttataggaattctaggtagcttcaatatggacatttgtcctacagcaattagtaatagtccccatttccagtatcaactcttaaaactccttttcatagtaataagcctattcagcactttggacagtgcctaacacactcagta

SEQ ID NO: 124480 - DNA, 601 bp, Human
gagagaggtgggttgaataatctctaagtgacctttcaatactaagacaaggtcaaggaaacttttgataaagggactgaaaactttactacatctctgcagtcttatccttttgtcaaaagcagaaaatatgactaatgttaggtagaagtaaaaccagctggagtttccaatatatctccatggcagttgactgagcccagatgcctattagcttgttacttttgatttcaccaggccacggcttagtaaaaagcatgggttctattcacttatcatgggaaaaaccctgacatttccmaagtgactctgggccctctagctatttgttattcaatctgtctctttcgttttccgcaaaaccacagactgtcagagctggaaggggccttggagctcacccagcccctgatgtgcaacaggcagtcccaggaaagggaggtaacttacccaggctcacagagcaagccaggggcagaaccaggactaagacccatgtctcaactcccaagccagtgctctttccacagcaccaggttatcctatgccttagatagaggagcaagttccaacttgctgaacaagtactttatgaaaattc

SEQ ID NO: 124481 - DNA, 601 bp, Human
caattgtggctccttgacctggggggaaaagaccctgaagaagaaataatagaaaagaacagctaagcaaatatttccattaaatgaaattttctcctctcccccagcaacacccatcaccggagtccttccttcagctgaggtgactggtagaaaagagaactctggttactctcaagggagccctgtgcaactctgtatgtatgtcttgagggaaagagaaaggagggagaaagtgggagagagaaatgctgaaagaagaggaaagagacaggaggacagagaaaaggagataaagacmggtgaaggagaaaattgagaaagggcaggggaacctgattttaagaatgaaaaagaaaaatcagacacgaagataagattgaagggcatgcgaccacagggatgagatcagaattggaagggtcagggcaaaatggataggttctttctaaaagataaaatcaaggatacttaaaactagttatcagtcttgagcatggacagccacgggaatgggcaacaatatgaaaaaacaaataagaactcagcatgagaagcgggaataagacagttttgggatctgtctttttggatctcctga

SEQ ID NO: 124482 - DNA, 601 bp, Human
aagtatctagaaaatgctgaagagcattatggagcttctctgctcttcccaaggcactcaaaggaaggagagcatgtacgtatgggagaaggatgcaaataaatggacccaaacataggatgcttaggttgggaatcaaggtagaactctaaaatgccagttttcattgtgctgctgatagctgggctatccttcctttccttccttctttccatccctcccccagccttctctctctctttctctctctctgtcaccaacacacacacacacacacacacacacacacacacacacacaaggtctcgttctgtcacccaggctggagtgcaatggcacaatcatggctcactgcagactcaacttcccaggctcaaacaatgctctcactcagcttcccgagtagctgggactacaggcgcatgccaccatgaccagacaattttttatcttttgaagacatggagtctcgctatgtcttcaactcctggcctcccaaagtattgggattataggcgtgagccactgtaccaggccttggctatcacttctttccataaaacccagctctgaagagccaactgtggaacttcagtaactc

SEQ ID NO: 124483 - DNA, 601 bp, Human
agccacgggctttctaaccactctcaccttcagcatgtggctacattgtttgtctactctcttctctgcaccactacttaaactccattgcctcaccgtcataataatgtactgcaatcattggtttactactctactactgagttctttgagagcaaaggctgtcttttatttgaccttacacccccagtaccttcctaacacagcacacagcacgtggtagaaacatttgaatgatggctaactaaatgaacaaaggattgtggaatcacaagggaggaactggtcaattctacttaayagattagtagggtattaaagaagatttcacagatggagctagatgatagtaagttcctaaggggcagggatgctttaccaccacagtgcttggcacaaaacatttactacaacacaggatggaggaatgaatggatggacagatggttgaagaaacaaatacatataaatactttcatgactctcctatctatcaacatagatctgactggaaagagatacagcaaatcttctatttctattatgatttatctcttaaggctaaaatggtttaaattgagcttagagtttttcttattac

SEQ ID NO: 124484 - DNA, 601 bp, Human
caacaaaaacaataatctttccttctaattgcacgaatttcacaggtcacaggtgtattcatgtccagggacataagattgcttcctcaggaaggctttccagaaccttcagattaggctaggttccccacccccccaccccacacagtctctcttgcgatacatcctgtcattctccctcatggcacctgacatgcctgaatcatttatttgtaataatttgtttaatagccatctttcccactaaactgaaagcttcatgagggagacgtcagggtccatttagagcaaatagagcacytggcaaataggaggtgctcaaatatttactgatggtctcatttaatctttacaacaatccagtgaggtaggcaagtgtacacctccccgtattaatggaaactgtcccttaactaactggttattcacaaagctaggacatggcatccaggccttctatttccagttgaggactcattccatgctcccatgctgctgttgccaccaaagactaactaaaatgtgcatctgtatccaaagaggatgaatccattgctgtcaccctctgctcatactagcttagctaaagagactgctgagt

SEQ ID NO: 124485 - DNA, 601 bp, Human
atatcaaatgacaccttggggcgataaaacaaaatttagacttgtaaagcctataggtcaaacaaatgcattagcaaaaaattctaagagagaaaaaaaatgagagtggaaacttcataaaaaaggatgaaaagatgtagctgtcaattacaacatatggaccttacttggctttttttttttttttttttaaagagtctggctctgtcacccaggctgaatgcagtggtgtgatcatagctccctgcagccttcaacttctgggctcaggtgatcctcctgcttcagcttcctgagtagstgggaccacaggtagatgccatcatgcctggctaatctcgctacattgcccaggctggtcagaactgctgggctcaagcaatcctcctgcctcagcttcccagaacactgagattacaggtgtgagccaccatgcccggcttctggaccttatttggatcttaatttgaacaaacaaacgaaaaaaaatcatgagtcgatcagggaaatttgaacactgtctaagtttttaaggatactaaggaattgttaacatattttaggtgtaaaaatgccactgaggttaggttttctttttaaa

SEQ ID NO: 124486 - DNA, 601 bp, Human
tccattaatccacagtattttggtcatatctggtctgtttcctcatactactcaaaatgtgttagagctaagtttttatattagaatgtcatcaaccatttgtttatttttttcattttgcaaacgttttcatttacataaagggctggagagacaagaaagtggtagagattcagaggggaacataaaaggaaaagtattctcttttcccaaaaatccacctttaaaaaggtagtaatgagactttgagaaagagtgctgattcatggacttcccccatttttttatttctatataacamatttaaggacattaatgtactaaaacgtttggtctgtgaaatagcggaatcattagcaccaaaaggagttatggagcttgtatatattattaaaacaatgattgttactgttggtcatgggtaaaggtttcatttcatttttacatcccaaagttcttgaaagtgcctgtggacaagagaaataacacttttcaaaatctccatggggtcgtcaatacgcaccacagagactgtacttggccttcccagttttggtttatctggtagacaagaaaaccagggcccccagatgattaccac

SEQ ID NO: 124487 - DNA, 601 bp, Human
cctaatctggaattcatacaactaagaaaaaaagaaacaaagtcccacattctcatgtgttcctgctgatgggctgtggatgggtaagttatggaaaggctgggaggagcaacaaggaagatagaggccaagaccagagctttttaatccccttctgagtctggccaagggtatatagagaaggctaaaccctagggaataatacaagtgtgaccctaaaaggtattattttgcaactaaatcagtccaatctaacacagccatttcctctaagttcacaaagcaactttattttcaacamacttgcaactgtgagacaaagttgggtcatcatgtgctggggacactggatttttgccctaaatgacaggtaataaatctaaacttaggaacattttcttacagtttaaaaaaaattcttctgccctccttgattaacttgttttctgaatacatttagttgctggcttagtggagaggatggggagggaaaggcaacaattattataaattattttggtttttattaaaatgacttttctttcctgcagagacagattctaaaagaaaaacaagtcaaacttctgggatgcctttctct

SEQ ID NO: 124488 - DNA, 601 bp, Human
gcctttcaaaatatgtaagagtcaaacatcttagttttaatttaattagcaatagaattcaaaagaagaatttcaaaagaaatttgattgcctgattcttaggggtaattttctaattgcacatggccaacagagtagtcattattatttgataattgacttgccattgctacatatccttgccttttcaggcagaatacttaactgccttgaacagtcaattgccctattctattgcttgcttaattgggtagcattactcgactataaaattttactctaccctgcatgtttttggttsaatatcttcatgtttaaggacctaatgcaagttctcaattttaatttaacatttggaatgtagatattgccagaggaagtagacagtaggatgtccctttgtcttaatagcatggaattgatcataataactacaaatcagccaacacaacatgaatcaggagaaaggtacttctaaggggaggagatatgatctcacatcaagattgattttttaaaaagctcatatgagaaaataagtgaaagaaaatcacttttttgctatcataatactagaaatgatatgacaacttttgcctga

SEQ ID NO: 124489 - DNA, 601 bp, Human
ggatgtccctttgtcttaatagcatggaattgatcataataactacaaatcagccaacacaacatgaatcaggagaaaggtacttctaaggggaggagatatgatctcacatcaagattgattttttaaaaagctcatatgagaaaataagtgaaagaaaatcacttttttgctatcataatactagaaatgatatgacaacttttgcctgagaacctcaacgtactttgaggttgtgggatagctttagcaagctattaaagaagtccctcataaacctataaagtaattaagtatggamtatggggattaagaccatcgtaaatggatatgagagtatttgggaaggagtccaatgcaccccactttatcaacaaatggagttgacctgctcatccacatattaatagagtgcagaaagatagctacagaggagttctggtgattactctaaattctcagtttcctaactgagggtacagtctgacttatatctctgagtagatcacctccaatgcaaaaataaataaataaaacagagctctgtgtcttcagtgtgaatgaatgattactgatattgacagtatcatcatatcattct

SEQ ID NO: 124490 - DNA, 601 bp, Human; identical to SEQ ID NO: 30877

SEQ ID NO: 124491 - DNA, 601 bp, Human; identical to SEQ ID NO: 30878

SEQ ID NO: 124492 - DNA, 601 bp, Human; identical to SEQ ID NO: 30879

SEQ ID NO: 124493 - DNA, 601 bp, Human; identical to SEQ ID NO: 30880

SEQ ID NO: 124494 - DNA, 601 bp, Human; identical to SEQ ID NO: 30881

SEQ ID NO: 124495 - DNA, 601 bp, Human; identical to SEQ ID NO: 30882

SEQ ID NO: 124496 - DNA, 601 bp, Human
gtgagggaaggaattgagggaggagggagggagggaggggtgagggtgggggtgaggaaggggtgagggaggggtgttgggggacctagtatggaacccaggagtatatttgtcacaggtcagcaaggacacagggcacttgagctcagaggccggaagtatagctggtcttgcacaatccacggtaccggtctgggagaaatgaccctgctgactacaaacacaggctgggttttgggggtgctgacgcagctttgttgtgctgctgcttccagttctgccggctcagtgccttgtgacyggggccggtggctcctccatagagggctcacaggggtcctgcccactcagtgcctctcacacctctgcacaaaccctgggtctcagcagccacagggttctggccttccttgggtgagcctggacacccaccctcatgcagacaggttcagaatctgggagggggtccagcctcttgtgcgccctactgtcccccacacctgaggggcactcgggagacagagtactgggggcatgctgttgtcaccacggcctgctggggtcatgtcacagctcagagccttggtccccccagctgtaa

SEQ ID NO: 124497 - DNA, 601 bp, Human
gctggtggggcagcttcctgcggtcacaacaggtcaacagcacctggagttagtgtttcctctaaagtaaagtatttgagagaaagagaagaaaaatatgaaagcattcagacctctaatttattattattattttttgagacggagtctggctcttgtcgcccaggctggagtacagtggggcgatcttggctcatgcaagctccgcctcccaggttcacgccattctcctgcctcagcctcccgagtagctgggactacaggcacctgccaccacggccagctaattttttttttttttgtatttttagtaaagaaggggtttcactgtgttagccaggatggtctcgatctcctgacctagtgatccgcgcgtctcagcctcccaaaatggtgggattacaggcatgagccactgcacccggccctttttttttttgagtcttgccctgtctcccaggctggagtgcagtggtgcgatcttggctcactgcaaccttcacctcccaggttcaaatgattctcctgcctccgcttcctgagtagctgggattacaggcgcccaccaccacacccggcttatttttgtattttaatagag

SEQ ID NO: 124498 - DNA, 601 bp, Human
actctgttgccaaggctgcagtgcagtggtgcgatctcagtttgctgcaacctgcacctcccgggttcaagcaattctcgtgcctcagcctcctgagtagctgggattacaggcatgtgccaccgtgcccagctaatttttttgtagttttagtagagacagggttttgccatgttgtccaggctggtcatgaactcctgagctcaggtgatccacctgtctaggcatcccaaagtgctaggattacaggcgtgagccaccatgctgggcccagtcctatgattgttaagaataatgcagwgccaaaaaaaaaaaaaaaaaagaataatgcagtgaagaaacaggcactccactctgattgaacacaggtggaagaggaggccctaggaaatggaggggagggctgggcgtagggtgtggcgtgggttctgtcacaaatggccaatacacccagaatcaggtgctcctccctgcctggccgtaccaggcctgggcccagcaccttgaatggaggtccagttgcctccccactcatctgacatgagctgccctcatccttactctgcacatgtggaatgaatgggccaggtccttcaaggat

SEQ ID NO: 124499 - DNA, 601 bp, Human
tgcagtggtgcgatctcagtttgctgcaacctgcacctcccgggttcaagcaattctcgtgcctcagcctcctgagtagctgggattacaggcatgtgccaccgtgcccagctaatttttttgtagttttagtagagacagggttttgccatgttgtccaggctggtcatgaactcctgagctcaggtgatccacctgtctaggcatcccaaagtgctaggattacaggcgtgagccaccatgctgggcccagtcctatgattgttaagaataatgcagtgccaaaaaaaaaaaaaaaaaagaataatgcagtgaagaaacaggcactccactctgattgaacacaggtggaagaggaggccctaggaaatggaggggagggctgggcgtagggtgtggcgtgggttctgtcacaaatggccaatacacccagaatcaggtgctcctccctgcctggccgtaccaggcctgggcccagcaccttgaatggaggtccagttgcctccccactcatctgacatgagctgccctcatccttactctgcacatgtggaatgaatgggccaggtccttcaaggatgaaccagatagaaagcactgc

SEQ ID NO: 124500 - DNA, 601 bp, Human
tacctcttcaccttggaacaacccactgagatctatgcctgccttcacatctatcttctatccgtcatctatcaagctatccatatgtcatctatttctcatctatcagtcaatcttttcatcttttactcttttccatcaaatacaacagcttctatcaatcatctctatctaatcatccatctgaccatccagcatctatcatctattatctatctaatctatctaatcatctaatctatctgaccatccatccatcatccgtccgtccgtctgttcatccatccatccatccacccaygtatctaccatctatcaatctatctaataatctctctgttataggaaagaggttaggaaaccctcccatcacactctgcccagttggtcatctccagctctatgcgactgcccctacctgcccccgcacctcactgcttccccaacaccagcccagctcacaggacttgtgcaaaggcttccttgccctcaaaccttcttcccagacttctgcatggcccctcgccatcatcccaggtcacctactgacctccctgcccattcctcctgagctccctgtgtgtccctccatgtccccccc

SEQ ID NO: 124501 - DNA, 601 bp, Human
cgctgggcggcatgcatctgagtcagcgctggccacgcaacctgcggccaatgctacattgcctcctgtcaggagcacatttcgcacccaccgtataccttcgcagcttccttttcaactcagcacatctcagaactcattcccatatcaactacttttcaaaccctctatgggacaaacacaaaagtggagagagcagtgccacgagctcagcttctcggcatccacgcggtccacctactcagtagttgctgttgttttcccccgggagtgctttagagcagagcccagttagaccccctcactcaggagtgcttctgctttctgtcacttcagcaatggggctatgcagacctgatgtcagcccagacacaggactgcaggtgggggccactcatccatccgaggaacgggagctggagccaccccaagtcacggggctcagcccagatggggacagaagaaaagtgatgaggaagtaagtgggggcctcagtagtgctggaggccttgccccctcccctgtgcccctggaaggctgcttggaggaggaaagggcagaggctggcaggagatgcacaggtacctcagctggaggggcc

SEQ ID NO: 124502 - DNA, 601 bp, Human
ctacttttcaaaccctctatgggacaaacacaaaagtggagagagcagtgccacgagctcagcttctcggcatccacgcggtccacctactcagtagttgctgttgttttcccccgggagtgctttagagcagagcccagttagaccccctcactcaggagtgcttctgctttctgtcacttcagcaatggggctatgcagacctgatgtcagcccagacacaggactgcaggtgggggccactcatccatccgaggaacgggagctggagccaccccaagtcacggggctcagcccagayggggacagaagaaaagtgatgaggaagtaagtgggggcctcagtagtgctggaggccttgccccctcccctgtgcccctggaaggctgcttggaggaggaaagggcagaggctggcaggagatgcacaggtacctcagctggaggggccaggtcgggggacccacagcggggacacagaggcagtgcgggatggaggacggggcaggctgaccccactcccacctcaggccaccagatgctccacatccagggagatgaggggctggggctgggaggggcggtggggagaacagaatggg

SEQ ID NO: 124503 - DNA, 601 bp, Human; identical to SEQ ID NO: 29429

SEQ ID NO: 124504 - DNA, 601 bp, Human
gcggagctgcaggtgcgggcggcaggtgcgggccgcgggacctggcgggaggactgacagaccgactgccgccccgagtgtccgcagcgctcgtggtgcaactgggccaggccaggcgccggcgggtgaatcgcggaaacctttagacgcgggtcggccccccgcccccgggaacactcttgcgccccgcctaccccgcggaccagaccgcggctccgcctgcttggatcttcagacaaggtcggggatcctccctgcggtctcccaacccccgcccccacgcgccctgccgccccctagwcttcctgggctgtcgccccccacacacacccctccgtgccctccacccgcactgtggagcgggactcgggccatcggactctgccagagagaaagctatgactgtttcctccaaaatcataaaacggaagttcagaaaggttaagtaacttgctcaatgccaccagctaggcagcgaaacccgcagccagtccacatggcctggctttagctctgcagctcctgccccgtgtggctgcctgcccccgccccctgcccaagccccgtccactctgcctggcctgtcacctggcccttctgt

SEQ ID NO: 124505 - DNA, 601 bp, Human
gatcttcagacaaggtcggggatcctccctgcggtctcccaacccccgcccccacgcgccctgccgccccctagacttcctgggctgtcgccccccacacacacccctccgtgccctccacccgcactgtggagcgggactcgggccatcggactctgccagagagaaagctatgactgtttcctccaaaatcataaaacggaagttcagaaaggttaagtaacttgctcaatgccaccagctaggcagcgaaacccgcagccagtccacatggcctggctttagctctgcagctcctgcsccgtgtggctgcctgcccccgccccctgcccaagccccgtccactctgcctggcctgtcacctggcccttctgtccccgctaggagacacagagtccccgtttctcacccatctgagggcccacgtctgaatccttaatccaggcctcttctcaagattcctagaattcgagagctattgagtatttgaatttccaagatgtgagtctcgcccggaagtttcccggaaaacggtcgctgacacagagtcctcggctaccacacaaaggccagagggctccaccgcccgcatcctgacccc

SEQ ID NO: 124506 - DNA, 601 bp, Human
gaccggtggagctgaaatagagctagcaagggtcagaggtggaggagataaggccagcgggaggatgcagaggtgaggtctagagggccaagtgaggtttgactttgactaggaggaacccactggagagtttggagaagaagagaggcatggtctaccctgtgtcttcatactgcggctactgtgtgaagatcagactgaagacagtgccctccaggttactaggagatagtgagccaggtgttagcagtggaggtggtggattctggacatattttgaaggtagagctgatgggattcrttgacagatgagatatgtgagagacaggagtctcggatgattctaaggtttgaggcctgagaaactagaagaatgcagttgtcctcgactgcgatggggaacaccgagaggggcgtgtgctggaggcaggactgacaattaggagctaagtgtgggacctgctaagtttgaaatgccttctagacatccaaggcaatgtcaaatagacagatttatgtatctggagttcagaggagagatccatgctgcaggtataaattggaaaagccaactggaaaaaccaaccaaaaaccaagagat

SEQ ID NO: 124507 - DNA, 601 bp, Human
gattggctaggaccgtaaaagtcatctagtccagccaaccctcattggacaccatccctgataagaggtgaagagcttgggatctgcattaagcaaacttgtttgagtcccagctccagccctcagcagccagagatctcggaccagttacctaatctctgtaaacccagtttgttcatccatatagtggaataatggttccatctggcagtggtgtcatcgggctgaaatgagatggcattggcagagtgcttagctcagagctacacacaggggacacactgaatacgtggaggagacscctgtctagctcagtcacttctgcttgtcacccacgatgatgggcagctcattgcctacaaggcaagccattccccttgggactaggccacgtcgcattgtggtgaagtgcacagactctggggctgcatggcttgggtccaaaccctggcctggccacttactggctgtgcaagcctgtgcaattggctaaacctcaccaagcaaccattggctcatctgtaaactggggctaatgattgtagccacctcatagggttgctgggagaattatacaggcagtgctggtagtgtttaagaa

SEQ ID NO: 124508 - DNA, 601 bp, Human
gggcagctcattgcctacaaggcaagccattccccttgggactaggccacgtcgcattgtggtgaagtgcacagactctggggctgcatggcttgggtccaaaccctggcctggccacttactggctgtgcaagcctgtgcaattggctaaacctcaccaagcaaccattggctcatctgtaaactggggctaatgattgtagccacctcatagggttgctgggagaattatacaggcagtgctggtagtgtttaagaacagtgcccagcatgtagtaagtacacagtatgtaagtgtttscttcgttacatgggtagggccaactgttgttttcatgtgaacagaagcaagaaagttccctggccatcaaaaggggctagagggatgtgggaattggcagctgagcctgtatttgcctggtgtgcagtgatatcccctccatcatattggtcgattgtgactcgctcttttctgggtcaagatgcataaagcccatcacccaggtattagcaagagacagaggaaggcggccacctcacatgggttcctggcctgtgggttgggcccctccctcctccacccaccaccctcgcagagttg

SEQ ID NO: 124509 - DNA, 601 bp, Human
ggaattttaaaagcggcctggacaacataaggaaaacactgtctctaaaaaaatttaaaaattacccaggagtggtggcgcatgcctgtagtctcagctactggagaggctgaaggaggaggatcacttgagcccaagaggtcgaggctgcggtgagccgtgatcacagcactgcactccagcctaggcaatagagtgagagtgtgtctctaacaaaaagacaaaaagaaaaacaaaagccaagtggtgtatgtgagagggattgcagtagcatggtccttccttaaacacctcccccagytcctgtggccccgggggcctggtgtggaaactaaacagcaaacatctatttagcacttgctaagggtgtggcacttgcccagggcttcagaagcagcctttaatcaatccagaaccactctggggtggcttctaatcaaacccctgtctttacagatgaagggactgaggcttttctttcttttccttttcttttcttttcttttttttttttttgagatagagtctcactctgtcgtccaggctggagtgcagtggcatgatctcggctcactgcaagctccgcctcccaggttcacac

SEQ ID NO: 124510 - DNA, 601 bp, Human
tcacttgagcccaagaggtcgaggctgcggtgagccgtgatcacagcactgcactccagcctaggcaatagagtgagagtgtgtctctaacaaaaagacaaaaagaaaaacaaaagccaagtggtgtatgtgagagggattgcagtagcatggtccttccttaaacacctcccccagctcctgtggccccgggggcctggtgtggaaactaaacagcaaacatctatttagcacttgctaagggtgtggcacttgcccagggcttcagaagcagcctttaatcaatccagaaccactctgrggtggcttctaatcaaacccctgtctttacagatgaagggactgaggcttttctttcttttccttttcttttcttttcttttttttttttttgagatagagtctcactctgtcgtccaggctggagtgcagtggcatgatctcggctcactgcaagctccgcctcccaggttcacaccattctcctgcctcagcctcctgagtagctgggactacaggcccccgccacttcgcccagctaattttttgtatttttagtagagatggggtttcactgtgttagccaggatggtctcaatct

SEQ ID NO: 124511 - DNA, 601 bp, Human
gtctcaaactcccaacctcaggtaatctgcccgcctcggcctcccaaagggctggaattacagatgtgagccaccacgcccggccaacaaggtcaaataacctgtccaaggcctgcagccaggcaggaagtgacagaacaaagactcaaaccctcatctgtctgattccaaaccccatattcccactgacttgctggttctttcctaagtggcagtttccctccacgtcatgcctccagggacaggcaaggctctgagcccgcctacggcagctctctggactctagagctatttctgggytcatgttcattcattctttcactcaacacatagtttttgaacacctgctgtatgccaaaaccataccacaccctgaggttgcagtggtgaacaggacagacacagctcagtccactttaggtttatattctttgtgggggagataagaaaaaaaatcatttaaccaacaaagacacaaaactgtttcagggagcagagtgctatgaagactgtaaagcaggatgaggtaaaaactcaaagcctttcttatgaaatgacttttgatcagagactgaacaacagaaaggaatggggcaaatg

SEQ ID NO: 124512 - DNA, 601 bp, Human
acaaggtcaaataacctgtccaaggcctgcagccaggcaggaagtgacagaacaaagactcaaaccctcatctgtctgattccaaaccccatattcccactgacttgctggttctttcctaagtggcagtttccctccacgtcatgcctccagggacaggcaaggctctgagcccgcctacggcagctctctggactctagagctatttctgggctcatgttcattcattctttcactcaacacatagtttttgaacacctgctgtatgccaaaaccataccacaccctgaggttgcagtrgtgaacaggacagacacagctcagtccactttaggtttatattctttgtgggggagataagaaaaaaaatcatttaaccaacaaagacacaaaactgtttcagggagcagagtgctatgaagactgtaaagcaggatgaggtaaaaactcaaagcctttcttatgaaatgacttttgatcagagactgaacaacagaaaggaatggggcaaatgaagagctcatagaggaacatacagaagaacaagcaaggctacggcaggtgcaaagaccctggtgcattcaaggatcagctgggaga

SEQ ID NO: 124513 - DNA, 601 bp, Human
tgctatgaagactgtaaagcaggatgaggtaaaaactcaaagcctttcttatgaaatgacttttgatcagagactgaacaacagaaaggaatggggcaaatgaagagctcatagaggaacatacagaagaacaagcaaggctacggcaggtgcaaagaccctggtgcattcaaggatcagctgggagaaggccagtgtggcctgaagggcaagtgagggaagaaccacaggagataaagttggaaagagagacgagggcagattatgaaaggcctcacagcaagtcgctcaggttctattyatgcagccagaagacaggggaggccaggtgcagtggctcacacctgtaatcccagcactttgggaggccgaggcaggcggatcacgaggtcaggagattgagactatcctggctaacgtggtgaaaccccgtctctactaaaaatacaaaaaaattagcctggcatggtggcgggcacctgtagtcccagctacttgggaagctgaggcaggagaatggcatgaatccgggaggcggagcttgcagtgagctgagatcgcgccactgcactccagcctgggtgacagagcgagactctgt

SEQ ID NO: 124514 - DNA, 601 bp, Human
cctttcttatgaaatgacttttgatcagagactgaacaacagaaaggaatggggcaaatgaagagctcatagaggaacatacagaagaacaagcaaggctacggcaggtgcaaagaccctggtgcattcaaggatcagctgggagaaggccagtgtggcctgaagggcaagtgagggaagaaccacaggagataaagttggaaagagagacgagggcagattatgaaaggcctcacagcaagtcgctcaggttctatttatgcagccagaagacaggggaggccaggtgcagtggctcacrcctgtaatcccagcactttgggaggccgaggcaggcggatcacgaggtcaggagattgagactatcctggctaacgtggtgaaaccccgtctctactaaaaatacaaaaaaattagcctggcatggtggcgggcacctgtagtcccagctacttgggaagctgaggcaggagaatggcatgaatccgggaggcggagcttgcagtgagctgagatcgcgccactgcactccagcctgggtgacagagcgagactctgtctcaagaaaaaaagaagatgggagggttttaagctggggagc

SEQ ID NO: 124515 - DNA, 601 bp, Human
gcattcaaggatcagctgggagaaggccagtgtggcctgaagggcaagtgagggaagaaccacaggagataaagttggaaagagagacgagggcagattatgaaaggcctcacagcaagtcgctcaggttctatttatgcagccagaagacaggggaggccaggtgcagtggctcacacctgtaatcccagcactttgggaggccgaggcaggcggatcacgaggtcaggagattgagactatcctggctaacgtggtgaaaccccgtctctactaaaaatacaaaaaaattagcctggcrtggtggcgggcacctgtagtcccagctacttgggaagctgaggcaggagaatggcatgaatccgggaggcggagcttgcagtgagctgagatcgcgccactgcactccagcctgggtgacagagcgagactctgtctcaagaaaaaaagaagatgggagggttttaagctggggagcgacatgacttactaaacggtgtgagaatggaccgtaggtggtcaagagcagaagccaggagacccagcagaaggagtctgacctaacctctacttgatttacagtcaaatatgtgaagcccgc

SEQ ID NO: 124516 - DNA, 601 bp, Human
ctcacacctgtaatcccagcactttgggaggccgaggcaggcggatcacgaggtcaggagattgagactatcctggctaacgtggtgaaaccccgtctctactaaaaatacaaaaaaattagcctggcatggtggcgggcacctgtagtcccagctacttgggaagctgaggcaggagaatggcatgaatccgggaggcggagcttgcagtgagctgagatcgcgccactgcactccagcctgggtgacagagcgagactctgtctcaagaaaaaaagaagatgggagggttttaagctgrggagcgacatgacttactaaacggtgtgagaatggaccgtaggtggtcaagagcagaagccaggagacccagcagaaggagtctgacctaacctctacttgatttacagtcaaatatgtgaagcccgctgtcatattccccatacatctttacttctccagttaaatattttcagctcctccagctgctcctcaggtggcaagattttgaagttcttcccttcctgttctggacctggtggccccttgaggctccttataaccccatgctctatttccacgattccacccatctgctcca

SEQ ID NO: 124517 - DNA, 601 bp, Human
tacaaaaaaattagcctggcatggtggcgggcacctgtagtcccagctacttgggaagctgaggcaggagaatggcatgaatccgggaggcggagcttgcagtgagctgagatcgcgccactgcactccagcctgggtgacagagcgagactctgtctcaagaaaaaaagaagatgggagggttttaagctggggagcgacatgacttactaaacggtgtgagaatggaccgtaggtggtcaagagcagaagccaggagacccagcagaaggagtctgacctaacctctacttgatttacrgtcaaatatgtgaagcccgctgtcatattccccatacatctttacttctccagttaaatattttcagctcctccagctgctcctcaggtggcaagattttgaagttcttcccttcctgttctggacctggtggccccttgaggctccttataaccccatgctctatttccacgattccacccatctgctccacctcatgttccaggggtcctctctcctaggaaactagctgtattttctcccccctgctgataatattaggaacaggctgatgattgcagcagcaggatggggcagagg

SEQ ID NO: 124518 - DNA, 601 bp, Human
ctttcctttcctctgtgtggcatcactctcagacactctctccccttgaagccccatgtatggccacaggtatccccagaactgtgctcagtcagcccagcttcctttccctctagttccagcaaaaatccagtgtggaactcttcctggtccagagaggtgaccattccctggccaagaattgttatagtgatagcacagacctcctccaatttataaaaggtgtaagtaattacacacattagtgctctgttacacagattcactgaaatcatggaagttgggatacgcccaatacacrgtggctgcagcagatatggagggatggtagccagggtggagcattctggagctgagggagcataaaatagcatgagaggccgggcacagtggctcacacctgtaatcccagcactttgggaggccaaggcgggaggatcatcaggtcaggagatcaagaccatcctggctaacacggtgaaaccccgtctctactaaaaatacaaaaaattagcggggcgtggtggcgagcgcctgtagtcccaactactcgggaggctgaggcaggagaatggcgtgaacctgggaggcggagcttgca

SEQ ID NO: 124519 - DNA, 601 bp, Human
ccaatgcaggaggaaggcgtgctctgccctcttggccacggctaccctggggcctccagactacaaatggttacctgtccacaatacttatggaaacggaggctaaaaagttacagcgatttgacacagtaaatgtatgtctctgtaatctaataataaaaatccgggaggtatattctacatgtctttttaattctatttttctagaaattcattctttgttgtattttacaaaagcagtgacctgtgatgggttgggaatgtttcagaaactggtccttcactgcagacggtttgaaaygcactcctcaggatgccaggggcccatccaagttttctctttttttttttttttttgagatggagtctcactctgtcgctgaggctggagtgcagtggcgctgtctcggctcactgcaagctccgccttctgggttcacaccattctcctgcctcagcctcccgagtagctgggactacaggtgcccaccaccatgcccggctaattttttgtatttttagtagagacggggtttcaccgtgttagccaggatggtgtcgatctcctgacctcgtgatccacccacctcagcctcccgaa

SEQ ID NO: 124520 - DNA, 601 bp, Human
ccacaatacttatggaaacggaggctaaaaagttacagcgatttgacacagtaaatgtatgtctctgtaatctaataataaaaatccgggaggtatattctacatgtctttttaattctatttttctagaaattcattctttgttgtattttacaaaagcagtgacctgtgatgggttgggaatgtttcagaaactggtccttcactgcagacggtttgaaacgcactcctcaggatgccaggggcccatccaagttttctctttttttttttttttttgagatggagtctcactctgtcrctgaggctggagtgcagtggcgctgtctcggctcactgcaagctccgccttctgggttcacaccattctcctgcctcagcctcccgagtagctgggactacaggtgcccaccaccatgcccggctaattttttgtatttttagtagagacggggtttcaccgtgttagccaggatggtgtcgatctcctgacctcgtgatccacccacctcagcctcccgaagtgctgggattacaggcgtgagccaccgcgcccagccaaggcccatccaagttttctaacagatgtcatccaaggcat

SEQ ID NO: 124521 - DNA, 601 bp, Human
ttttacaaaagcagtgacctgtgatgggttgggaatgtttcagaaactggtccttcactgcagacggtttgaaacgcactcctcaggatgccaggggcccatccaagttttctctttttttttttttttttgagatggagtctcactctgtcgctgaggctggagtgcagtggcgctgtctcggctcactgcaagctccgccttctgggttcacaccattctcctgcctcagcctcccgagtagctgggactacaggtgcccaccaccatgcccggctaattttttgtatttttagtagaracggggtttcaccgtgttagccaggatggtgtcgatctcctgacctcgtgatccacccacctcagcctcccgaagtgctgggattacaggcgtgagccaccgcgcccagccaaggcccatccaagttttctaacagatgtcatccaaggcatctgcttctcccaaaggagcacgtagaggagcctgcaggggacagaaacagagagccaccatctgggtgggagccagttgaggtctgacctgcactgaggctggtgggagcgaagacccctggaaggagggcccagggcaggggtttct

SEQ ID NO: 124522 - DNA, 601 bp, Human
aggaaaggtcaggaaagggcacgaagaagcttccatctgctgggtttcttgcctatgtcctcaatgcctttcatctgacttaattcctgtgacaacccactgaggaggtgtttagccacctttgcagtggaggaaacaaaagcttaaacagctttactcttgtgcccgaggtcacacagtaggaaatggtagagccaggatttgaacctaggcctctctgattccgaaacctgcttgtaggtactaaacatattgcttctttttcatcagatgagactgaaaaagagaacacccatattcyaggactggctctgctagaaatcagctcaccttaggaaggtcacttcatcttgctagccaagcttcctcatctgtaaaataaggaggtatatgttttgccaaattccttccttctcttgcattcttttgctctgagcaataataatagctcgcgtttgttaaggcttattacacgcctagcatcaagctaagagcacttttatatgaattatctcatttggtcccaccacacccttatgattaagtgcagttagcactcccctttggcaaatgaggaacctgtggtttggagaagctcagc

SEQ ID NO: 124523 - DNA, 601 bp, Human
gacaacacactgtgttgcaaaaggaaaagactttctctgagagcagcccttgctggggaaacattaaacggagggctgctgtgtttcacctctactggttccaaccggctgaagtagcccaggatctcgctaatgacttttgtgaccagcgaaagggcagtgggcaatctcagctcgctgcaacctccgcctcccggattcaagcgattttcctgcctcagcctcccgaatagctgggattacaggcacgtgccaccaccattagctcagctaattttttgtatttttagtagagatgggktttcaccgtgttggccaggctggtcttgatcgcctgacctcgtgatccacccgccttggcctcccaaagttctgggattacaggcgtgagccaccgcgcccagcgtatgcggcttttcttaaccaagcttattgagacttaaaggcctcattctgtcctacccagcttgcatgttgccaatccttaattagcataaccactgagaaaaaccattttttaaaattatttaaaataaaaaaaaaaaacaagcaacaacaccaccaaaatcaaaaccctaagtttttgcctcccagaaaacat

SEQ ID NO: 124524 - DNA, 601 bp, Human
agaaaacatgtcagtaaatttcttcactggtatattcccttgtctggccagtaaatcaactcagcattgttattatcactattattactgctataatatgtatttatgtatggttctgatggtatttgttttattctttggcaacacataataagtttaataaatatttgtctggccaggcaaggtggcacactcctgtaatcccagcactttgggagggccaaggtgagaaatgtcaggcctctgagcccatgctaagccatcatatcccctgtgacctgcatgtatacatccagatggygtgaagctactgaagatccacaaaagaagtgaaaatagccttaattgatgacattccaccattgtgatttgttcctgccccaccctaactgatcaatgtactttgtaatcttccccacccttaagaaggttctttgtaattctccccacccttgagaatgtactttgtgagatccaccccttgccctcaaaacattgctcctaactccaccgcctatcccaaaacctgtaagaactaatgataatcccacctccctttgctgactcctttttcagactcagcccgcctgcacccaggtga

SEQ ID NO: 124525 - DNA, 601 bp, Human
ctgagcccatgctaagccatcatatcccctgtgacctgcatgtatacatccagatggcgtgaagctactgaagatccacaaaagaagtgaaaatagccttaattgatgacattccaccattgtgatttgttcctgccccaccctaactgatcaatgtactttgtaatcttccccacccttaagaaggttctttgtaattctccccacccttgagaatgtactttgtgagatccaccccttgccctcaaaacattgctcctaactccaccgcctatcccaaaacctgtaagaactaatgatratcccacctccctttgctgactcctttttcagactcagcccgcctgcacccaggtgaaataaacagccttgttgctcacacaaagcctgcttggtggtctcttcactcagatgagcgtgacaagaaaatcacttgaaaccaggagttcaagaccagcctgggcaacatatcaagaccccgtctttacgaaaaaaaaaattaaaaattagcttgctgttgtggtgcacacctgtagtcccagccacttgggaggctgaggtggtgggatcacttgagcccaagaggtcaagattgcagtga

SEQ ID NO: 124526 - DNA, 601 bp, Human
ccttaattgatgacattccaccattgtgatttgttcctgccccaccctaactgatcaatgtactttgtaatcttccccacccttaagaaggttctttgtaattctccccacccttgagaatgtactttgtgagatccaccccttgccctcaaaacattgctcctaactccaccgcctatcccaaaacctgtaagaactaatgataatcccacctccctttgctgactcctttttcagactcagcccgcctgcacccaggtgaaataaacagccttgttgctcacacaaagcctgcttggtrgtctcttcactcagatgagcgtgacaagaaaatcacttgaaaccaggagttcaagaccagcctgggcaacatatcaagaccccgtctttacgaaaaaaaaaattaaaaattagcttgctgttgtggtgcacacctgtagtcccagccacttgggaggctgaggtggtgggatcacttgagcccaagaggtcaagattgcagtgagtcatgatcaagccatgcactccagcctgggtgacactgctcttctcaaaccaccaaccccctacctcctacttgacagattaaatacaatcctta

SEQ ID NO: 124527 - DNA, 601 bp, Human
agccaaaccctgcctctgagctttgatggcatccatctgccttcttagtgagccttgcgccatgtccacctggctccttcttgaatattcaactacatcctctcaccggatctgtctcacagaccaatatgcttaagtctctcacttcttaaaagaaaagtataaaccttcccttgaccctcttactcctctccagctaccatttcacagtcaaatctcttgagaaaatggaaaacaaaagtcaatgagggctgggcgcagtggctcaagcctgtaatcccagcactttgggaggtcgagrtgggcggatcacgaggtcaggagatcgagaccagcctggataacatggtgaaaccctgtctctactaaaaatacaaaaaaaaaaaaaaaaaaattagctgtgtgtggtggcgggcgcctgtagtcccagctactcgggaggctgaggcaggagaatggcgtgaacccgggaggcagaacttgcagtgagccgagatcgcaccactgcactccagcctgggcaacaaagcgagactctgtttcaaaaaaaaaatacaaaaattagcaggtgggcacctgtaatcccagctactcaggaggc

SEQ ID NO: 124528 - DNA, 601 bp, Human
tacatcctctcaccggatctgtctcacagaccaatatgcttaagtctctcacttcttaaaagaaaagtataaaccttcccttgaccctcttactcctctccagctaccatttcacagtcaaatctcttgagaaaatggaaaacaaaagtcaatgagggctgggcgcagtggctcaagcctgtaatcccagcactttgggaggtcgaggtgggcggatcacgaggtcaggagatcgagaccagcctggataacatggtgaaaccctgtctctactaaaaatacaaaaaaaaaaaaaaaaaaattagctgtgtgtggtggcgggcgcctgtagtcccagctactcgggaggctgaggcaggagaatggcgtgaacccgggaggcagaacttgcagtgagccgagatcgcaccactgcactccagcctgggcaacaaagcgagactctgtttcaaaaaaaaaatacaaaaattagcaggtgggcacctgtaatcccagctactcaggaggctgaggcagaagaatcgcttgaacccaggaggtggaggctgcagtgagcagagatcgcaccactgcactacagcctgggcaacagagcaagact

SEQ ID NO: 124529 - DNA, 601 bp, Human
ccagctaccatttcacagtcaaatctcttgagaaaatggaaaacaaaagtcaatgagggctgggcgcagtggctcaagcctgtaatcccagcactttgggaggtcgaggtgggcggatcacgaggtcaggagatcgagaccagcctggataacatggtgaaaccctgtctctactaaaaatacaaaaaaaaaaaaaaaaaaattagctgtgtgtggtggcgggcgcctgtagtcccagctactcgggaggctgaggcaggagaatggcgtgaacccgggaggcagaacttgcagtgagccragatcgcaccactgcactccagcctgggcaacaaagcgagactctgtttcaaaaaaaaaatacaaaaattagcaggtgggcacctgtaatcccagctactcaggaggctgaggcagaagaatcgcttgaacccaggaggtggaggctgcagtgagcagagatcgcaccactgcactacagcctgggcaacagagcaagactctgtctcaaacaaaaaaaaaaaaaaaaagtcagtgagtacaaaaactccctctgtttcctcctgccactcccaggcagctttgacctctgtggcccatt

SEQ ID NO: 124530 - DNA, 601 bp, Human
taccatttcacagtcaaatctcttgagaaaatggaaaacaaaagtcaatgagggctgggcgcagtggctcaagcctgtaatcccagcactttgggaggtcgaggtgggcggatcacgaggtcaggagatcgagaccagcctggataacatggtgaaaccctgtctctactaaaaatacaaaaaaaaaaaaaaaaaaattagctgtgtgtggtggcgggcgcctgtagtcccagctactcgggaggctgaggcaggagaatggcgtgaacccgggaggcagaacttgcagtgagccgagatygcaccactgcactccagcctgggcaacaaagcgagactctgtttcaaaaaaaaaatacaaaaattagcaggtgggcacctgtaatcccagctactcaggaggctgaggcagaagaatcgcttgaacccaggaggtggaggctgcagtgagcagagatcgcaccactgcactacagcctgggcaacagagcaagactctgtctcaaacaaaaaaaaaaaaaaaaagtcagtgagtacaaaaactccctctgtttcctcctgccactcccaggcagctttgacctctgtggcccattgaaag

SEQ ID NO: 124531 - DNA, 601 bp, Human
gtggtggcgggcgcctgtagtcccagctactcgggaggctgaggcaggagaatggcgtgaacccgggaggcagaacttgcagtgagccgagatcgcaccactgcactccagcctgggcaacaaagcgagactctgtttcaaaaaaaaaatacaaaaattagcaggtgggcacctgtaatcccagctactcaggaggctgaggcagaagaatcgcttgaacccaggaggtggaggctgcagtgagcagagatcgcaccactgcactacagcctgggcaacagagcaagactctgtctcaaacaaaaaaaaaaaaaaaaagtcagtgagtacaaaaactccctctgtttcctcctgccactcccaggcagctttgacctctgtggcccattgaaaggatgcttgccagggtcactgatgacttccatgttgctaaatgcaacagacacttcccagttcccctcctgacttctcagggcatcagacactgtgggctactccctttttcttgccacactcctttgctttttgtcccacactctcctgctctgcctttagctctctggggttcttcatggactctctggctgggcagtcttccggg

SEQ ID NO: 124532 - DNA, 601 bp, Human
catgttgctaaatgcaacagacacttcccagttcccctcctgacttctcagggcatcagacactgtgggctactccctttttcttgccacactcctttgctttttgtcccacactctcctgctctgcctttagctctctggggttcttcatggactctctggctgggcagtcttccggggccagcccatggctttaattaccatttgttttctaatggctgtgaaactcacatcaccagctcagctctccccttggagctccaaatccccatatccagctgcttcttgatttctgtatctygatgtctcaaaagtcatgtcacacacaagactgaattcatggtctttcctgaccttccacaccaagccagatctttgtccaatattttatttcttgggtgatgacgttaccaatcagccagaagtctaggatttttctttgacagcccccctcaccctccatatccagcccacccccaagtttctccttcattccccgccccccgctccatattcagcccaccccaccccccataatttgtgttttcctgatgtctttgaacaggtccagttctcccttctcctctggcaccattccggc

SEQ ID NO: 124533 - DNA, 601 bp, Human
atggtctttcctgaccttccacaccaagccagatctttgtccaatattttatttcttgggtgatgacgttaccaatcagccagaagtctaggatttttctttgacagcccccctcaccctccatatccagcccacccccaagtttctccttcattccccgccccccgctccatattcagcccaccccaccccccataatttgtgttttcctgatgtctttgaacaggtccagttctcccttctcctctggcaccattccggcccaagctgtcagtcatcctcctcccagactatagcagargcctcctcgtggctctttcatatctatcctgcactctccagcccattctctttgctgcagccaaagcaacattttgaaatagctgagaacacacacacacacatgactttggttgtgtgtgttttgaataagggctaaaatattaaccctggcctacagaccctgcaccatctggccccccagcctctccagtgtcatcttccatgtcccaccagctgcccctgcttccctgtttctgctccagccacatggcgccctccctgtgcagggcctttgcatggtgttctgagtgcactgccc

SEQ ID NO: 124534 - DNA, 601 bp, Human
tcccaccagctgcccctgcttccctgtttctgctccagccacatggcgccctccctgtgcagggcctttgcatggtgttctgagtgcactgccctggccaccgccctttgcttggcttgggttgtgtctacgtttgtgttttcagcaaaacatcccctgacccccatgcaggccaggtctcattccttacagaagccagttttcttcctttagagccctgatgccagtttgtgaaacacactcgctaacgtagggatccgagtgatggactgatgtctgtctccttccagcaggctgttcmctctctgagagcggaggtatctattctgctcactcttttatcccaaggtgttcttaacatggcaccccgaagaatgtaggccctcaggaaatatttgtcaaatggtgactgaagtggagagagagagagagggcaatgaggccgccgcttgtgagggctccaagtgttcggagggagtggattgtgcctattcagtcacgcacctttgtcacttgggaaatggctggctctggccttgcacctagtgggggcttcataaatattggcaggattgaattgaactgagttgacgcactcacc

SEQ ID NO: 124535 - DNA, 601 bp, Human
gggttgtgtctacgtttgtgttttcagcaaaacatcccctgacccccatgcaggccaggtctcattccttacagaagccagttttcttcctttagagccctgatgccagtttgtgaaacacactcgctaacgtagggatccgagtgatggactgatgtctgtctccttccagcaggctgttcactctctgagagcggaggtatctattctgctcactcttttatcccaaggtgttcttaacatggcaccccgaagaatgtaggccctcaggaaatatttgtcaaatggtgactgaagtggrgagagagagagagggcaatgaggccgccgcttgtgagggctccaagtgttcggagggagtggattgtgcctattcagtcacgcacctttgtcacttgggaaatggctggctctggccttgcacctagtgggggcttcataaatattggcaggattgaattgaactgagttgacgcactcaccagctccactggaaaatgtgtctcgagctagcacttactgagcatgtaaaactacgggtcattatgctgaatgcttctcatgtgttcacccatttaatcctgaagacaccatgagatgg

SEQ ID NO: 124536 - DNA, 601 bp, Human
cagaagccagttttcttcctttagagccctgatgccagtttgtgaaacacactcgctaacgtagggatccgagtgatggactgatgtctgtctccttccagcaggctgttcactctctgagagcggaggtatctattctgctcactcttttatcccaaggtgttcttaacatggcaccccgaagaatgtaggccctcaggaaatatttgtcaaatggtgactgaagtggagagagagagagagggcaatgaggccgccgcttgtgagggctccaagtgttcggagggagtggattgtgcckattcagtcacgcacctttgtcacttgggaaatggctggctctggccttgcacctagtgggggcttcataaatattggcaggattgaattgaactgagttgacgcactcaccagctccactggaaaatgtgtctcgagctagcacttactgagcatgtaaaactacgggtcattatgctgaatgcttctcatgtgttcacccatttaatcctgaagacaccatgagatgggcattactgttccatttttataaacaaaggaaccagtcaggggccctgtgggaaacagatggcacactcag

SEQ ID NO: 124537 - DNA, 601 bp, Human
gccctcaggaaatatttgtcaaatggtgactgaagtggagagagagagagagggcaatgaggccgccgcttgtgagggctccaagtgttcggagggagtggattgtgcctattcagtcacgcacctttgtcacttgggaaatggctggctctggccttgcacctagtgggggcttcataaatattggcaggattgaattgaactgagttgacgcactcaccagctccactggaaaatgtgtctcgagctagcacttactgagcatgtaaaactacgggtcattatgctgaatgcttctcaygtgttcacccatttaatcctgaagacaccatgagatgggcattactgttccatttttataaacaaaggaaccagtcaggggccctgtgggaaacagatggcacactcaggatgatttcaggagaatttcacaaaggaatcctccacaaccatgtggacgggggtggggggaagaaaggcataaggggctgcgatgcctcagggctcacagtgactgctgggggcttcactgctacccctacgcttgaagtttgccagaaccccacacagagagggcagagtggaggagctgcctgtcagg

SEQ ID NO: 124538 - DNA, 601 bp, Human
caatgtctaacatgaggaagcgagaacatggacatcccaacgcttgtgtaattgtaacgactgtctgcaaagcacttcagtgttcccaaatggaaagattccccggaagtagaaagagctattattgtccattatgagcattctttctagaatcttcttctttctaccctcaactgtggctttttagactagcagacatctgccaaaagccactaacccagagacactgattctatcaaacagcacagtgggacagtcactctcccaactttctttctttttcttttttctttttttttttgagacagagtttcgctcttgttgcccaggctggcgtgcaatagtgcaatctcggttcaccgcaacctccacctcctgggttcaagcgattctcctgcctcagcctcccgagtagctgggattacaggcatgtgccaccgtatccagctaatttttgtatttttgggagagacagggtttctccatgttggtcaggcttgtctcaaattccccacctcgggtgatccacccacctcagcctcccaaagtgctgggattactgtcatgagccaccaggcccggcccccaactttcttaataa

SEQ ID NO: 124539 - DNA, 601 bp, Human
ttcttttttctttttttttttgagacagagtttcgctcttgttgcccaggctggcgtgcaatagtgcaatctcggttcaccgcaacctccacctcctgggttcaagcgattctcctgcctcagcctcccgagtagctgggattacaggcatgtgccaccgtatccagctaatttttgtatttttgggagagacagggtttctccatgttggtcaggcttgtctcaaattccccacctcgggtgatccacccacctcagcctcccaaagtgctgggattactgtcatgagccaccaggcccsgcccccaactttcttaataattaaatccaatctcttgctagacagacttttttgttgtagtgccaaggctgcttgaaattttcattttgctgtctaatttgcataaacttgtaatcaataagtttttgccctatacttggcccctactcctaccgtagtaaaatattcgatgcatatttttcatggaaatattgaagaaacatacattctcagacaagaaacatcaaatgtggccattgcttttgtaccactcaatatgcaactcagactggttgaaatttagaccaaatggtaacatcc

SEQ ID NO: 124540 - DNA, 601 bp, Human
caaatgtaacataacatttgttacacttaaaataagtaaggaggcagctgtaggctaaatttaacatgcctgggaggagggaactgaagctcaaaccagaagcagcagatagatgggtctgcaaatttcatgcgttttccaccagatctctgcctgtggctcagagaggtgtggcagcacagctacctcacacagctgctgagaaacaggcttggatacaggtcttttttttctccccacttttgcttcagatctctacccaggtataacgagctgcatctcaaggtcagaacgactgaamaataaagaggttggttcaacagatgacctcaaaactcataacctacatcccgaagctaaagaaaaacttacgtctccaaaaagaggtgtagttagctgcaggttatttgaatgagcagcacatgctgtgcatttgctttaagattctccaaacacgcagaaagccaagctaatcctcagcgctcccatgccaatctggtgtggggaccctccactccaggctgccttgtagaatgccttattgatgtgcggcaaggggcaccccatgaaagtcccaacagctctgaaggtaatgagcaaa

SEQ ID NO: 124541 - DNA, 601 bp, Human
cactggaggcgactggattcctgggagaggtgctttcagtggcgtgtgtggccaaccaagccacccaaggctactttgtcaccagattctgctcttggcccattcccccagctgctgtgggagagtcacaggaagtgaggaatcctaagaagatcttcctttttcaaaacagcttcatcaaggtgcaattaacagacaagaaactgcacacactgaaaatacacactttggtatgttttcacatgtctatacccatggaactaccaccacaatcagaataataagtatattgaaggaaatraaaatatttcactccaaaatatactttttggcatattttaagatggctattcaaaagggctagaaatccaagaatagctgaaaagctgtcttgctgggggaggtttgcgtccatagagaccatctttgtgagccaggcctcctcttctgcccctgccataagctgatttgtcatcttttttttcttttcttttttttgagacggagtctcgctctattgcccatgctgaggtgctgaagtgcagtggtgtgacctcggctcactgcaacctttacctcctaggttcaagcgattctcctg

SEQ ID NO: 124542 - DNA, 601 bp, Human
aatccaagaatagctgaaaagctgtcttgctgggggaggtttgcgtccatagagaccatctttgtgagccaggcctcctcttctgcccctgccataagctgatttgtcatcttttttttcttttcttttttttgagacggagtctcgctctattgcccatgctgaggtgctgaagtgcagtggtgtgacctcggctcactgcaacctttacctcctaggttcaagcgattctcctgtctcagcctcccgagtagctgtgactacaagtgcatgccaccacgcccagctattttttttttttggtatttttgtatttttagtagagacagggtttcaccatgttggccaggctgctctcgaactcctgatcgcaggtgatccacccgcctcagcctcccaaactgttgggattacaggcgtgagccaccgcacctggcccccccgacttgccatcttaacccactgtgggccaccctcagatcccctgttctctctgtaacctcgaggagatacacaagcttctgcacccgtgggggttggggtcatctttctgtgattttccctccatgcacgttgataaatttgtatgctgtttctagta

SEQ ID NO: 124543 - DNA, 601 bp, Human
aataggtattaactaaggttaccctaaagctgcctccatacatagtttaagttgggccttaatttcctctgtacatagtgaactataacttaactggatgtgtaaacagactataacctactcttgtgccaattatcaaattgcactcaattttctttttctataattcctctccaatcacgtggcagccaccagcgttattctgacctattctggctcaggaggccacacagttcatgaatcgttctttgctcaattaaactcttaaatttaatgtcttaagtttttattttaacagtcrtagtggttctcattatgattttgtgtgtgtgtgtgtgtgtgtgtgtgtgtgtgtgtgtgtgtgtgtgtgtgagatagcatctcactctgtcacccaggctggagtgcagtggtgcaatcatgggctcgacctcttgggctcgagtgatcctcccacctcgacttcccaaagtgttgggattacaggcacgagccactgtgcccagcctctcatggtgatttttaatttgcatttctataatgacaacgatgttgagcctattttcctgtgcttgtttcccagctatgtagcttccttggt

SEQ ID NO: 124544 - DNA, 601 bp, Human
atttatatagccttatttcaggggggtgaggggagatgggaatataggtgattgtgttgaggggtaataaatgattactagggagaatgaatggaaagaggaacagagattaacttgtgaatgagttctattcaggtgtgattgggtcctattcaggtgtgggtacattcttggttgtttttggtcttgctttgtcaccccagctggagtgctatggcacaatcttggccttgacctcctgtgctcaactgatcctcttacctcagccttctgagtagctgggtctacagatgcatgccaycatgtcctgctaatttttaaattttttttgtagagatggggtcttactacattgcccaggctagtcttgaattcctgggctcaagcaatctgcccaccttgacctcccgaagtgctgggattacaggcatgagttaccgccttggtcttgttttctgcaacagataataagataatagggagggggagggaacaacaattgttctcctgatgggtacatctagtctttatgaaggtaggagaaagtctcttccggatcaaaggtctgttgacctctaagggcctttaattcaaaatactc

SEQ ID NO: 124545 - DNA, 601 bp, Human
tttacagttttagatttacctctaggtctatgatatattttgagttaatttttatatatggtgcaaggtatggatccaagttcaatttttgccaatgtagatccaattgctccagcactgaattgcctttgcacctttgtcaaaaattagttatccatatatgtgtggatctgtttctgatttctggactccctattctattccatttatctatttgtctctctgtgcaccaacaccatatgttttcactattgtagctttaaaataagtcttgaaatcaggtagtgttaatccccaactktttcccaaaagtcatttgagtattctaggttcttaagttttcttgtgaattttagagtcagtttgtcagttcccacaaaatcttgcaagaatgttgactggcaatttgacgcctgaatatgtataagttttcatttatttaggtattatttcacttctctcagtgatgttttgttcatatttgtttttgtttttaaagactaattggagaaaaggcataaaaatgtattaacgtgcacatggggagaatcacagagtgatcgctccctatctcattggggcccacatatttatacagcct

SEQ ID NO: 124546 - DNA, 601 bp, Human
ctcattggggcccacatatttatacagccttatttcagaggggtgaggggagatagggaatataggtgattctgttgaggggcaataaatgattactagggagaatgaatggaacagggaacagagattaacttgtgaatgagttctattcaggtgtggttacattcttggttgtttttggtcttgtttgtcaccctggctaggatcttgctctgttacccagactggagtgcagtggtgcaatcatagctcactgcctcaaactcctgggctcaagtgatcctcctgccttagcctttawatgcattctaacctctctcctgctagaattacccccctagagccagggcagtaggcaactgagaagaaattttctaactagcaaagaggcttgattttctattgtgttagttttgctgacaattcctatgtggtagtttttctcaaattctactgtgcatcagaataatcagagaagggtattctaaaaacagagattcccaatacaccctctcttcaaccaatgaatcagaatccaggaaatctgtagtgtatttttaggccactgttcagaagattctgatatatacttatgtctaga

SEQ ID NO: 124547 - DNA, 601 bp, Human
ttcttcttcctctacttaggctcctgggtttctcagctctcttttaaaggaaaccaaaaatattttatcccaaaatatacttctttgtcatactttggggtggctctttggagggcctgcagacaggaatagccctgcaaagctaccttttgtggaagagatttgcgtctgtaggaaaaagtctgcactggtgaaataaacagccaggctttctctgaggccccacccattctttctgagagcagctcagtgattacctgagcaatttccacgtgcgtaacatgagagctttggtgtgagsagcgttcctcccttcgctcccctcaacctgtgaccccacctcccgagaaatgtggttccaggccattgttctttgggctctcccatcttccctgaaaatcgtttatttctacacctccttcatctcccctctttccaaccaagaggatatttaagcatcaaccgtcttgccattctttgagttttcgtattttgtgtgactcctgtgcatgtacgtgcacgttaataaaatttcccaccaatctagtctcagtgtgttttatagacccaaattatcaaaatttcaggggaaaaatttaaa

SEQ ID NO: 124548 - DNA, 601 bp, Human
agataattacatggtcaacagccaccatgcctaggaggccctgtgaccctgtcccaccccacctcagccaaagttcattgactttgggtgcaaatagccaaaggcagccttgagctgactcaagtacactgagcagtgacaaagtcacagagcttggcttgctgagagccgtggagatgacaaagtcttgaagcaatggaggtcagatgttcgtgctgacctgtcaacaggtgggaggtggtagcggctagatcatatacagcaggagggggcttgttttcctggaataaaaaaaaaaaaagccagacagcaaatatttctgtctttgagcaccatactgtctctggtgcaccatagtctagtgttgccattgtggtgtggaagcagccatcgacagaacataaaagaatacggacggcatggcagtcacagtcagttgacttcattgtagagccttatgggccacaatgaggtatttggatttattctattggcaaggagaaggcactggagcattatacaaggtggggtggagggtaattagatctcacttacacttcaaaaattataatcttagagctgtaaaaataccatggtacta

SEQ ID NO: 124549 - DNA, 601 bp, Human
ggaggtggtagcggctagatcatatacagcaggagggggcttgttttcctggaataaaaaaaaaaaaagccagacagcaaatatttctgtctttgagcaccatactgtctctggtgcaccatagtctagtgttgccattgtggtgtggaagcagccatcgacagaacataaaagaatacggacggcatggcagtcacagtcagttgacttcattgtagagccttatgggccacaatgaggtatttggatttattctattggcaaggagaaggcactggagcattatacaaggtggggtggrgggtaattagatctcacttacacttcaaaaattataatcttagagctgtaaaaataccatggtactaaaggagtatttttatcccttgtgaaagaaagccaaattgtaagctttcaggaccagccagggtaatcttcaatttacgtctccaccatcttctgagttttatcttaaagtaggtgtaagatagtcatcctaacattaccatggaattataaaaccacagggttgggatgggtgcggtggatcatgcctgtaatcccagaactttgggaggccaaggcaggtggatcacctgag

SEQ ID NO: 124550 - DNA, 601 bp, Human
cccccactctgatgagaggttagaaaataattctgctttttccaaagagattaagcaataacaaacagaaacaagaaactaaaaaatcttgggtgcctttggactgcagaacttacaatctctctaaatcccaactctgactcttcaaatctaccatttgactttttccattgaagtgagttgatttaattctagtgcagccacaaatgtagatgaagcacccgggaaccacatagcacatcgcgggatgcagacaggagttactgacacagacgacaggtcccaaagtagaaaattaggyctcttaaaaatcattttaagggagattataagcatggaaacatgatgtctacgtattgttaagtgaaaatagtaatatactgtctgataacatttctgtaaaagaacagagagagattggaatcatcttgaaattaaagatttctgcgaaaaaaacaagtgtccaccagtatgtacagcattcttcaacttatgtttttaaaatgctgtgtataagtgattgaaaaatcatatcacagggcatacaatagcaagtttaaagcacgtgctattataagacaaggcaacatggtaagaagga

SEQ ID NO: 124551 - DNA, 601 bp, Human
cccactctgatgagaggttagaaaataattctgctttttccaaagagattaagcaataacaaacagaaacaagaaactaaaaaatcttgggtgcctttggactgcagaacttacaatctctctaaatcccaactctgactcttcaaatctaccatttgactttttccattgaagtgagttgatttaattctagtgcagccacaaatgtagatgaagcacccgggaaccacatagcacatcgcgggatgcagacaggagttactgacacagacgacaggtcccaaagtagaaaattaggtcwcttaaaaatcattttaagggagattataagcatggaaacatgatgtctacgtattgttaagtgaaaatagtaatatactgtctgataacatttctgtaaaagaacagagagagattggaatcatcttgaaattaaagatttctgcgaaaaaaacaagtgtccaccagtatgtacagcattcttcaacttatgtttttaaaatgctgtgtataagtgattgaaaaatcatatcacagggcatacaatagcaagtttaaagcacgtgctattataagacaaggcaacatggtaagaaggagg

SEQ ID NO: 124552 - DNA, 601 bp, Human
acatggtaagaaggagggagatggaaaaaagaaaaggaaagaagtctgtctgtggtatggccagaggggaaagaaacactgggagaaaacccactcatcctggtctttcctgccactttcagatatcctcctggtagctttgctgtctcagtcctgtactgacaaatgctggtaatgggactgcatgagagcagtcatactctgaggaatccaccggcttttaagtgtggttccattacaggattatgtggcgccacgaagtccaatacccaggaacagaggatggggaatgtgacccacrgagctcaaacaaaatgacaaaggagaccacttgggttctagggcagcagatcacatttgcttcttccaaagaaccagaaagctttttaaaaagcaaatggaataaagatgtggatgaaaagttttctccctgggataagtggatggggaggaagaaaatgaaaaacaggtaaattgctgaagaaaaggcagtatagtgaaaaaatcaacatttaagaattaattatatgccacttttcaagaaataagcataagacaccagaaaaatacgaatttagtgaaggtcgaacaaacacttttt

SEQ ID NO: 124553 - DNA, 601 bp, Human
ggagccccgtcgggccggacctgagcctgcatatggggaaatcgctgttgttgtcagccgctcttgcaaaaagctgatgatgtggctgttgaacaacctgggacccttgaccctgccatgacgtttgtaccaatgtgggtgtctgggtgacattcaaaattaaataaatcaaacttaaattaccaagttctagactccaatgtccagggaaatgccacattttgctgtgggcgacagaattttgccccctccacgctttttgtcataagggtcaaataaacaggatcattgaacagacagrgtgggctctgatgtgcttctcagctggacactgaacacgggcagtactgtagtgatgtccccaggagcgattgtgcaggagtgaggtggggcagacggcttttcctgctggctgctgagttggtgccatatacatctctgctgcccgaggcaggagtaacattgagccaataccatatcctgttgaattttgccaaaatgagaacgcacagaatcctcagatggtcaagtgggagaaacaaaaagaaaaatgttctgtcctcctaccttggtctaattatttactttctttctttttttt

SEQ ID NO: 124554 - DNA, 601 bp, Human
agtgggctctgatgtgcttctcagctggacactgaacacgggcagtactgtagtgatgtccccaggagcgattgtgcaggagtgaggtggggcagacggcttttcctgctggctgctgagttggtgccatatacatctctgctgcccgaggcaggagtaacattgagccaataccatatcctgttgaattttgccaaaatgagaacgcacagaatcctcagatggtcaagtgggagaaacaaaaagaaaaatgttctgtcctcctaccttggtctaattatttactttctttctttttttcttttttttttttttttttgagacggagtctcagtctgtcgcccaggctggagtacagtggtgtgatctcagctcactgcaagctccgcctcccgggtccacgccattctcctgcctcagcctcccgagtagctgggactacaggcaaccgccaccacgcctggctaatttttggtatttttagtagagacggcgtttcaccgtgtcagccaggatggtctcgatctcctgacctcgtgatccgcccgcctcggccttccaaagtgctgggattacaggcatgagccaccgcgcccggcga

SEQ ID NO: 124555 - DNA, 601 bp, Human
gcaggagtaacattgagccaataccatatcctgttgaattttgccaaaatgagaacgcacagaatcctcagatggtcaagtgggagaaacaaaaagaaaaatgttctgtcctcctaccttggtctaattatttactttctttcttttttttttttttttttttttttttgagacggagtctcagtctgtcgcccaggctggagtacagtggtgtgatctcagctcactgcaagctccgcctcccgggtccacgccattctcctgcctcagcctcccgagtagctgggactacaggcaaccrccaccacgcctggctaatttttggtatttttagtagagacggcgtttcaccgtgtcagccaggatggtctcgatctcctgacctcgtgatccgcccgcctcggccttccaaagtgctgggattacaggcatgagccaccgcgcccggcgatgtttagagtttttttaaaatcaggttacaaaatggtgtaagccaaattaaaatgtacagagaaaccaaaagaggacggcaacatgcctcagtgaaatagtgactgcatctgagtagctgttttttctgtttcttcagactttgctgcac

SEQ ID NO: 124556 - DNA, 601 bp, Human
ctcactgcaagctccgcctcccgggtccacgccattctcctgcctcagcctcccgagtagctgggactacaggcaaccgccaccacgcctggctaatttttggtatttttagtagagacggcgtttcaccgtgtcagccaggatggtctcgatctcctgacctcgtgatccgcccgcctcggccttccaaagtgctgggattacaggcatgagccaccgcgcccggcgatgtttagagtttttttaaaatcaggttacaaaatggtgtaagccaaattaaaatgtacagagaaaccaaaasaggacggcaacatgcctcagtgaaatagtgactgcatctgagtagctgttttttctgtttcttcagactttgctgcacttccccaatcctccataatagcaacagcagaagcacagcctgtggggctagccttgctttaagcattagctgctgttattcccagcgttgttactcgtatcatcaaaagttgataaactgaaagctgagaaaaagaccaaaggttagagggaaacatttagaaatgtgttagagacttgtttttaaagaaacttttaattttgaacgaattttaggtctaca

SEQ ID NO: 124557 - DNA, 601 bp, Human
cactccagcctaggggaaagagctaaactctgtctcaaaaaaaaagaaaaaagaaaaaaaagaaaagtaattcacctgtttttccacttagggactctttctgttttaggaggatgagatttttgaatgttaactaatgtccccctttttttatattttaattgtgaaacatacgtagaagttcataaaacaaaatgcactatttaaaggaaaatgaaaagttcaaggaatggaatgatgccagtctcctggtatcctttttctgactcgccacccagaggtaatcattaccctgactttyatggcaataatatccttgcttttcttggtagtgttactgtccagctataatctcctcagtaaagtagttgtgcctgtttttgaactttatgtacatgaacgcatgctgtatattcttttgttcaaggttatctggttgttgtgtggtgtgtgtgtctatggctcattcattttcattgctgtgtggtactcgactgagatgctctttgatattttctcctgctccctgcccttccctaatcaaatagaccttctgcctccatgtcccagggatggcaatataaccacagaaaatcaaatt

SEQ ID NO: 124558 - DNA, 601 bp, Human
gttagacctaataattcatttgttgtggggatgtcctgttcagtgcaggatgtttagcagcttccctgggctctaccactaggtgccagtagcatccacggccctccagttgtgagaaccaaaatgtctccagatattattgccaaacatccccagggaggcaaagtcaccccagatgagagccactgtgagaagaaggaaaggaaaaaatcagttggggaaaatgcagactgcagaagcaacctgcctgaaaagttacagcaacaggcaaaaatgaaacaaccttggggaaaaaaaaaaacaaaaaacctcaggctgcacctgcgcacagataagcaacttagtgagctcccaggaaaaaagtttcttcccttttttcaggcatatatacggtggaaacttgcacagatggggagggggcttacctaaaacaaacccacagttaatacaaactagaaaagcagaattcgtgatggcctagagacatacccacggctgcgtaacagaaggggaattgcacagacagctttactgataagagaagtgactcaaactgctagagataagagtttctgataaaagcttttgaactcagctgtaa

SEQ ID NO: 124559 - DNA, 601 bp, Human
taggtgccagtagcatccacggccctccagttgtgagaaccaaaatgtctccagatattattgccaaacatccccagggaggcaaagtcaccccagatgagagccactgtgagaagaaggaaaggaaaaaatcagttggggaaaatgcagactgcagaagcaacctgcctgaaaagttacagcaacaggcaaaaatgaaacaaccttggggaaaaaaaaaaacaaaaaacctcaggctgcacctgcgcacagataagcaacttagtgagctcccaggaaaaaagtttcttcccttttttcrggcatatatacggtggaaacttgcacagatggggagggggcttacctaaaacaaacccacagttaatacaaactagaaaagcagaattcgtgatggcctagagacatacccacggctgcgtaacagaaggggaattgcacagacagctttactgataagagaagtgactcaaactgctagagataagagtttctgataaaagcttttgaactcagctgtaaccccgcaatccactcggaatcctctctcctctgcagagagcgttttttctgtcactttttttttctttttccttttttt

SEQ ID NO: 124560 - DNA, 601 bp, Human
tcaggcatatatacggtggaaacttgcacagatggggagggggcttacctaaaacaaacccacagttaatacaaactagaaaagcagaattcgtgatggcctagagacatacccacggctgcgtaacagaaggggaattgcacagacagctttactgataagagaagtgactcaaactgctagagataagagtttctgataaaagcttttgaactcagctgtaaccccgcaatccactcggaatcctctctcctctgcagagagcgttttttctgtcactttttttttctttttccttttytttttttttttttttttgagatggagtctctctctgtcgcccaggctagggtgcagtgccgcagtctcggctcactgcaagctccgccccccgggctcacgccattctcccgcgtcagcctcccgagtagctgggactacaggcgcccgccacctcgcccggctaatttttttgtttttgtttttgtattttcagtagagacggggtttcactgtgttagccaggatggtctcgatctcctaactttgtgatctgccctcctcggcctcccaaagtgctttttttttttttttttttttg

SEQ ID NO: 124561 - DNA, 601 bp, Human
tgaaaatacaaaaaattagccaatggccgggcatggtggctaacgcctgtaatcccagcactttgggaggacgaggcgggcagatcacaaggtcaggaggtcgagaccacggtgaaaccccgtctctaccaaaaatacaaaaaaaattagccaggcgcggtggcggacgcctgtagtcccagctacttgggaggctgaggcaggagaatggcgtgaacctgggaggcagagcttgcagtgagccgagatcgcgccactgcactccagcctgggcgacagagcgagactccatttcaaaagraaaaatattagccaagcgtggtggcgggcacctgtagtcccagctactcaggaggctgaggctggagaatggcgtgaacccggaaggtggagtttgcagtgagccgagatcgcactactgcactccagcctgggcgacagagtgagactccgtctcaaaaaagaagaaaaaatcaaaagtgtgagtcttgtttactgaaaactatataatatttttggaagaaactaaagaagaattaaatagaaagacatgccatgttcatagattggaggataacatcattaagatgataatcctcct

SEQ ID NO: 124562 - DNA, 601 bp, Human
atacaaaaaattagccaatggccgggcatggtggctaacgcctgtaatcccagcactttgggaggacgaggcgggcagatcacaaggtcaggaggtcgagaccacggtgaaaccccgtctctaccaaaaatacaaaaaaaattagccaggcgcggtggcggacgcctgtagtcccagctacttgggaggctgaggcaggagaatggcgtgaacctgggaggcagagcttgcagtgagccgagatcgcgccactgcactccagcctgggcgacagagcgagactccatttcaaaaggaaaaatattagccaagcgtggtggcgggcacctgtagtcccagctactcaggaggctgaggctggagaatggcgtgaacccggaaggtggagtttgcagtgagccgagatcgcactactgcactccagcctgggcgacagagtgagactccgtctcaaaaaagaagaaaaaatcaaaagtgtgagtcttgtttactgaaaactatataatatttttggaagaaactaaagaagaattaaatagaaagacatgccatgttcatagattggaggataacatcattaagatgataatcctcctcaaat

SEQ ID NO: 124563 - DNA, 601 bp, Human
accccgtctctaccaaaaatacaaaaaaaattagccaggcgcggtggcggacgcctgtagtcccagctacttgggaggctgaggcaggagaatggcgtgaacctgggaggcagagcttgcagtgagccgagatcgcgccactgcactccagcctgggcgacagagcgagactccatttcaaaaggaaaaatattagccaagcgtggtggcgggcacctgtagtcccagctactcaggaggctgaggctggagaatggcgtgaacccggaaggtggagtttgcagtgagccgagatcgcacyactgcactccagcctgggcgacagagtgagactccgtctcaaaaaagaagaaaaaatcaaaagtgtgagtcttgtttactgaaaactatataatatttttggaagaaactaaagaagaattaaatagaaagacatgccatgttcatagattggaggataacatcattaagatgataatcctcctcaaattagtcaacataatccctaacaaaagcctacctgctttctatgcagaagttgaaaagttgatcttaaaattcatatggaaatgcaagagacccagaatacacaaaacaggcc

SEQ ID NO: 124564 - DNA, 601 bp, Human
atggaataaaattgagagtccagaaataaaccattactttcaggattaattgattttcaacaatggtgataagacaattcaatgaggaaagaagagtcttttaaagtaaggatgctggggaaaccacacacatccatatgcaaaataaaaaagttgaaccccccacctcacaccacatacaaaaaaaaattcaaaatgtatcaaagacctaaattacatttagagctaaaactataaaactcttagagaaaaatacagatgtgaatctttgtgactttaacttaggcaatagtgtcttagytgtggcaccaaaagcactagcaattaaaaataaacaaattgaacttcatcaaaattttaaaattttggccaggtatggtggctcacgcctgtaatcctagcactttgggaagccaaggcgggtggatcacctgaggtcaggagttcaagaccagcctggtcaacatggtgaaaccctgtctctactaaaaatacaaaaattagccaggtgtggtggcacacgcctgtaatcccagctacttgggaggctgaggcaggaaaattgcttgaacttgggaggcagaggttgcagtgagccaag

SEQ ID NO: 124565 - DNA, 601 bp, Human
caatacagtactatgtcatgctgtgtccggagttggttccttccagtgggctcttggcctagctgacttcaagaatgaagccacgaaccttcccagtgagtgttacaggtcttaaaggtggcacagacccaaagagtgagcagcagcaagatttattgtggagagcaaaagaacaaagcctctacaccatgaaaggggacccaggcagtttgctggctggggtggccagcttttattcccttatttgtccccgcccacgtcctgctgattggttcattttacagagtgctgattggtccaytttatagagtgctgacgggtgcatttacaatcctctagctagacacagagcgctgattggtgcgtttttacagagtgttgattggtgcgtttacaatcctctagctagacagaaaagttctccaagtccccactggacccagtaagtccagctggcttcacctctcaatgccacactaaccagcatcttttcttgccttacagcttgttttccctcaccttcttggccctaggtttgtacccctcatataaaataccagctctctaatcaggactccagctcctctttcttgaggacctg

SEQ ID NO: 124566 - DNA, 601 bp, Human
atgctgtgtccggagttggttccttccagtgggctcttggcctagctgacttcaagaatgaagccacgaaccttcccagtgagtgttacaggtcttaaaggtggcacagacccaaagagtgagcagcagcaagatttattgtggagagcaaaagaacaaagcctctacaccatgaaaggggacccaggcagtttgctggctggggtggccagcttttattcccttatttgtccccgcccacgtcctgctgattggttcattttacagagtgctgattggtccattttatagagtgctgacrggtgcatttacaatcctctagctagacacagagcgctgattggtgcgtttttacagagtgttgattggtgcgtttacaatcctctagctagacagaaaagttctccaagtccccactggacccagtaagtccagctggcttcacctctcaatgccacactaaccagcatcttttcttgccttacagcttgttttccctcaccttcttggccctaggtttgtacccctcatataaaataccagctctctaatcaggactccagctcctctttcttgaggacctgggtaagacagttatttt

SEQ ID NO: 124567 - DNA, 601 bp, Human
ggtggccagcttttattcccttatttgtccccgcccacgtcctgctgattggttcattttacagagtgctgattggtccattttatagagtgctgacgggtgcatttacaatcctctagctagacacagagcgctgattggtgcgtttttacagagtgttgattggtgcgtttacaatcctctagctagacagaaaagttctccaagtccccactggacccagtaagtccagctggcttcacctctcaatgccacactaaccagcatcttttcttgccttacagcttgttttccctcaccytcttggccctaggtttgtacccctcatataaaataccagctctctaatcaggactccagctcctctttcttgaggacctgggtaagacagttattttattttcccaatttacacaattgagttgtgtgtaaaaatggctcattgaggcatgaagagaagaatgagcataataacataaactacaattcagaaaagcatcccaaacacgagcagtgaggaagaatctcttgtgaatgccaaaaggagtctgagtgggtgaaacaaacaattatttcacatatgacacagaaaaaggaaaat

SEQ ID NO: 124568 - DNA, 601 bp, Human
tttgttgccaaaaccatagagacatcattcaaactcccacttcttatactaaaaacaggtagtttactttgctgccaagaatcttataaaatcatcccaaatttacaaatgttatgccaggagaaaaagtagaaaagtttattcacaaaatttctttttaaaacatctctatggatagcacataaaactcaatggcttaagatgtggaaaagccattactatcatatgcgtatgagcagatattttatagctggataaaaatgcccctgtccaaagtatgaatcaacttttggcacatgtrtaagtcaagttaggccaggcgacatggagcaacaaataaaccctgaaaccgtgcctttataaagtctgatgcagttgggtgaccccttccatactgcagctgtgccatgtagaacgagtatctgccaagatcactgcagcacaggaagagacggaggaggcatgcagctctcaaacaccttcacctggaatgacgcattgagaaacaccaggaggaaacgtgaggacaacaggccattgcttctgcccgtggtgcatgtatgagggagaagtatgaatggttttgttgttgctgactacc

SEQ ID NO: 124569 - DNA, 601 bp, Human
gcagcgaagaatgtgaccctgcatgggaaaacaaaaatgagggaggggtaaggaagaggagttggtccacaagaagctggtggtgggttaggcagtcatgacctgtgaggggtctgcagcattttccagatgctgcaatctggtgagtttccgttccttgatgcttatctgggaggtctgatgattggtttcctgagaaagaaactcaggtaagacaattgtaactttctcaagttttaagactgagaggggcagttcctggcattcactgaggctcacttccttggactctttggaggtrgagctcagaaatacacattttaaacaagttctgcagagatttttatgcacaccaatttattggtaggcttggaaaactttgctaaaaatggatacatgaaaacatgagatgtcaattgcaacaggcaatggaaatgaatttgagtttaaaagttcctctgtcctgaagaaatttcagatggtaactttatttccaacttatgtgctccttaagcaataaagttttcagtgctgacataagccaagtttcttgccttttatggtaaaaacattagtgactccgtttctccaagtgcgagga

SEQ ID NO: 124570 - DNA, 601 bp, Human
atgtgaccttatttggaaataggatcatcacaaatgtaagtaaaatgaggttatactggaggagggagggcccctaatctgatatgcctggtgtccttagaagaggagaagagacagacacacaaaaagaatgtcacctaatgatggagggggcagtgattggagtgaggaggaggctggtaacaccaggagctaagagaaaggcggaacaggccctgtcaacaactagactacaggcttgtagcttcccccactgtgaaatactacatttctcttacaatctggctggcttaaaagtaamcaaaatgtattgtttcagagttttccaggctggaaatctggagttattgtctcagttgtttcgtactttgttaaagctcatgcagcctgccatctgaaacaatgcaccctgcaaggtgcttagtgtagaaactttggaaaacagagaattcactaagtgctcatggtcccacgttccagaaccagtcgctgtagagtgtatattttccagttttcttcacttgcctctgaaggccattctgtccacttctaccttttaaaaatagtagcagttctcttatgtattttcttcttttgttgt

SEQ ID NO: 124571 - DNA, 601 bp, Human
tgtagaaactttggaaaacagagaattcactaagtgctcatggtcccacgttccagaaccagtcgctgtagagtgtatattttccagttttcttcacttgcctctgaaggccattctgtccacttctaccttttaaaaatagtagcagttctcttatgtattttcttcttttgttgtttgatcagctgtactctttatgggatgtgctttcaaaagagtgagaaccactgtaaactccagaatcctgtttttcatcaccaccgccaccatcctcctcctccttctcatcaccatcaccatmaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagccaggccacccgctgccctgatgaggctgctgggagtgagtattccagctctgcgtggtccttt

SEQ ID NO: 124572 - DNA, 601 bp, Human
tccagaatcctgtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggttgccaggccacccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaac

SEQ ID NO: 124573 - DNA, 601 bp, Human
ccagaatcctgtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtaaccaggccacccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaaca

SEQ ID NO: 124574 - DNA, 601 bp, Human
agaatcctgtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagcgaggccacccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaacaga

SEQ ID NO: 124575 - DNA, 601 bp, Human
gaatcctgtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagcctggccacccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaacagaa

SEQ ID NO: 124576 - DNA, 601 bp, Human
atcctgtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagccagaccacccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaacagaata

SEQ ID NO: 124577 - DNA, 601 bp, Human
ctgtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagccaggccgcccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaacagaatacca

SEQ ID NO: 124578 - DNA, 601 bp, Human
gtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagccaggccacacgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaacagaataccagg

SEQ ID NO: 124579 - DNA, 601 bp, Human
tttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagccaggccacccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaacagaataccagga

SEQ ID NO: 124580 - DNA, 601 bp, Human
taacaccttccagaacaactgtgaggaaagtttcacatcgttccagcaaaacccacagtcaccattataaactataaaacccaggtatttggagaggaggccccaaatccttactcacatcttaagccaatcaaaatccacgtaattcaatcaagagttaatcaacatcaatgaacacagaattatagaaccaaagaagttagcgctggaaggggctaaaagattctgtaagtcgcggtactctctgaatgaagaagcagaaggcccctcctgactatgtggctgtggaggagcccatgargagtgaagggtgggtgtcccctcctaggctggtgctcctgcttagcttctctcccggacaccctgagactgagaagctcgcagtgatgccctcccactagccccatgtggacatgatgcaaaggggaagtgtgaggaccagcggccagctcctggctcgcccagaggctcatccctatcactctgttgacctaaaaataacgtaacctacgttttacacaagtcctggttctcactcagagcatatggtaggatttattgtcttcaggtcctggttctcactcagagcatatggtaggat

SEQ ID NO: 124581 - DNA, 601 bp, Human
ccaagtgtttcatctttagtgacattcaattcgctaccaagctgtgcagtgcatactagactgagccacataaaattgccatatttataagtcaaaaatggttgagcaacgacaatattatttggttctaagatggatcattcccatgttacagataaggagcctgagcctcagaatggagaaatatcctggcagtagtcattgtgctggaaaatggcgtagagcaagattttgaacccaaatctgatagactccaaaatccattctctttccactaaactatggggctagataagaaggygaagctcaggaaaagccataggcaattgcactgtttgtactgtactcgataacatttcttttcataactcataatcctttattctccctttatagtcataaataatgcacttcaggaaaactgcaagtaccatcttgaaggagccctaagtactgaaagaaccacaaatgattgtttccaggttatcaaattttaataacattattttattacaatacaacatctgtccttttaaagacaatgttccaagaactcattatgcaattataaaataataaagctcttcatagagtgaagaac

SEQ ID NO: 124582 - DNA, 601 bp, Human
gctgtgcagtgcatactagactgagccacataaaattgccatatttataagtcaaaaatggttgagcaacgacaatattatttggttctaagatggatcattcccatgttacagataaggagcctgagcctcagaatggagaaatatcctggcagtagtcattgtgctggaaaatggcgtagagcaagattttgaacccaaatctgatagactccaaaatccattctctttccactaaactatggggctagataagaaggtgaagctcaggaaaagccataggcaattgcactgtttgtaytgtactcgataacatttcttttcataactcataatcctttattctccctttatagtcataaataatgcacttcaggaaaactgcaagtaccatcttgaaggagccctaagtactgaaagaaccacaaatgattgtttccaggttatcaaattttaataacattattttattacaatacaacatctgtccttttaaagacaatgttccaagaactcattatgcaattataaaataataaagctcttcatagagtgaagaaccaaaggcagttcctccttgtagcaacactcagcatctcct

SEQ ID NO: 124583 - DNA, 601 bp, Human
agattttgaacccaaatctgatagactccaaaatccattctctttccactaaactatggggctagataagaaggtgaagctcaggaaaagccataggcaattgcactgtttgtactgtactcgataacatttcttttcataactcataatcctttattctccctttatagtcataaataatgcacttcaggaaaactgcaagtaccatcttgaaggagccctaagtactgaaagaaccacaaatgattgtttccaggttatcaaattttaataacattattttattacaatacaacatctrtccttttaaagacaatgttccaagaactcattatgcaattataaaataataaagctcttcatagagtgaagaaccaaaggcagttcctccttgtagcaacactcagcatctcctgaaaattttttttaaaaatcctaagcatgcaatattgcttcttcaggcaagagtagatacagcacaaagtaagtataagtgaggaactgaataaaacatgactcaaaatgaatctgatgtgtatacgtgacactcctaacgatatcctagggtaagaacagtcttaaagtttggtcatttctcagt

SEQ ID NO: 124584 - DNA, 601 bp, Human
gaactgaataaaacatgactcaaaatgaatctgatgtgtatacgtgacactcctaacgatatcctagggtaagaacagtcttaaagtttggtcatttctcagttgactgagatggcaaaggcttttacatacaaccaagttgaatctttggcattttctcttcttttgtgttctagtatcattattgacaagttttcccttgttatgggttatttaattctaaatgcaaacacttgtttttggaatttaatacacagtcataattttaaaaatcaggtaataaataaaagtacaaaaaaaatagcaaataaaccaccccaaatcccacttagtctcaccagaaatagaagatttgatgctaattttccacagaattacctttggtgcatacttcagggcatactgaagccactcacagaaaggaggagaaagtggttgtaatagatctgggcacgtaattcaatttcatacaacagccaccctgggttctatttgtggatgatcttttggattaacaagtggatagatttcccatcccataaacttgattcataagcacacgtgttaaagaaaactttaagtgcatttccccctcatttta

SEQ ID NO: 124585 - DNA, 601 bp, Human
ggatgatcttttggattaacaagtggatagatttcccatcccataaacttgattcataagcacacgtgttaaagaaaactttaagtgcatttccccctcattttaattagggtccatgtaaaatatttttgctccaattataaccagaactacaaatacctcccctcttcaacccaaagaagcagttacgagtcctttgtggcgtgttccagttctgacttgagtatcactgcattttttcccagaagagcaatctcttgggaaaagagtcaggccactttgggtaagatgtcatggcgayggcttaaactgaagacagatagtggaaatagaccttttcaaactttcaaaacccagacttatgatccattctgcttttaaccatggaggacccaaatatgacatgagaaattggaataattttattctctaaaagcaccagtaagctcccgctcctggaaacatattagaaaagtttttgccctttgccctttgcatagataggtccaaagaccttcccaggctataattttttttatcatgtaccacagcagagatcaacaaaactgagttgcactgtggctgctgagcaagtggctca

SEQ ID NO: 124586 - DNA, 601 bp, Human
ttgggaaaagagtcaggccactttgggtaagatgtcatggcgacggcttaaactgaagacagatagtggaaatagaccttttcaaactttcaaaacccagacttatgatccattctgcttttaaccatggaggacccaaatatgacatgagaaattggaataattttattctctaaaagcaccagtaagctcccgctcctggaaacatattagaaaagtttttgccctttgccctttgcatagataggtccaaagaccttcccaggctataattttttttatcatgtaccacagcagagawcaacaaaactgagttgcactgtggctgctgagcaagtggctcagcccactcactagcccagggactcccttctgcaaaccaggcttccagaacaggggattctcttctgtgcagaggcgaaagtatcaaatcactgcgtggcttggacttctcaaatagctgaaagcccaaatattgaatctgcaaaagctaggagcaaggtagtaatgtatttgacttctagtctacagagccaaagttcagctctggctctgacatttacatgatcttgggtgaactccctaatctctctgttgtaca

SEQ ID NO: 124587 - DNA, 601 bp, Human
agactttactaaggtctttgaggatactcagtgggtttatatggcagaaactccaaaataatttaaaactgagtctgggactcacctgctttgaaaaattctttagccattctaccaccgggccccttgctgcactctttaaattcttttcttctcaagaacccaaaatacatacaggcttacactctcccttttcacctgctgcactccctgcctgacacccagcctctcccttgcttgcttagaagagccacgtgcattctgctcacacaagttggcatctgcccagacacctcctttkcttctttctcctccagtgtttgtgaaggaaagagcatggtagaggcattttatttctcctagaatataaattatgccaccattacctctcccctttagaagacagaagcagctatagtccatttctgtgtgtgtgtgttttgtttatttgtttttttagatgaagtctcgctctgtcgcccaggctggaatggagtggcacaatctcagcccactgcaacctttgcctccaaggttcaagcaattctcctgcctcagcctcccaaataactgggactacaggtgcacgccactacacccg

SEQ ID NO: 124588 - DNA, 601 bp, Human
gccggtcacagttgttcattcctgtaatctcagtactttgggaggccaaagtgggagatcgcttgaggccaggagtttgagaccagcctggcaacatagccagaccccatctctacaaaaataaaaaaaaaagtagccaggcatggtagcgtgtgcctgttgttctagctactcgggaggccgaggcaggaagattgcctgaacccaggagtttgaagttgcagtgagctgtggttgtgccactgcactccagtccaggtgacagaatgagatctatctccaaaaacaagaacaaaccaartatgtgtgtgtttctttcaatgtgccaggccctattctagatgctgggttgtgaccacagccaaaaatccctgccactatggagctcatatttggatggtgacaaggaacacaacagacaataaaccaatatataattaaagtaaatgtatatcagactgtgacaggtggggaaagataaagcaggatagggtgacagaaagaaatggcaagacggtgggggacaggtggcttgcaattttaaattaggtagtcagggaagaagaccccattgaggaggggccattttagcaaagacctg

SEQ ID NO: 124589 - DNA, 601 bp, Human
tggcaacatagccagaccccatctctacaaaaataaaaaaaaaagtagccaggcatggtagcgtgtgcctgttgttctagctactcgggaggccgaggcaggaagattgcctgaacccaggagtttgaagttgcagtgagctgtggttgtgccactgcactccagtccaggtgacagaatgagatctatctccaaaaacaagaacaaaccaagtatgtgtgtgtttctttcaatgtgccaggccctattctagatgctgggttgtgaccacagccaaaaatccctgccactatggagctcrtatttggatggtgacaaggaacacaacagacaataaaccaatatataattaaagtaaatgtatatcagactgtgacaggtggggaaagataaagcaggatagggtgacagaaagaaatggcaagacggtgggggacaggtggcttgcaattttaaattaggtagtcagggaagaagaccccattgaggaggggccattttagcaaagacctgcaatgtgtctgggagtgagtcatgtgactggggaagaggggcaaggatggaaaatgtcacaggctgaggaagcagcctgtgccagggt

SEQ ID NO: 124590 - DNA, 601 bp, Human
ttgtccaccttgcccacccctgagggagggggcagtgcagagagaatcactttgaggtgttttctacactgtctgccagatttttcctggtggcattgactcccagtgcccacagggccacgatgcccattattctgaccttcttaccttccccctcccgccttcccaccagcccccactggagcttcctagaatcatccctcaaataaacaacttgtactcaaatctttgtgttttgactattgttgtgggttgaattatgtcctctaaaaagttgaagttctaacccctggtacctgtraacatgacctgatttggaaatagggttttcatggatctaatcagatatatttcatggatataactaagatgaggggtgggccctgatccactatgattagtattcttataagagtagagcgagcacacataaggaagagaacgccatgtgaacagggagaggggaggtcaggtggcagaagaatagagactggagtgccatgtctccaaccaagggatgccaaagattcgcagtaacatgggaagctaagagaagggcatggcacaggttccccctgagccttcagagggggtgtggccc

SEQ ID NO: 124591 - DNA, 601 bp, Human
agagtcatcagagttcttccatggtggctcaaagctaccagagtgagggtgttccaagagacccaggtagaagcagcaaggtttcttgtaagttagtctcagaagtcccagaatgttacttctacaaattctgttggctgagcaggtcactgagtccagcccagattcagagggtcatgaataagacagccccctgaaatgggaaaaagagcaaagaactgcagccgtccttcatgtacatcacctgtgccagggtctgctgctaggggaacccaacctaagacacttgcctgcaagattmttcaggctctggctcctgccctgtttctagggtcatctcatgccctcacatttgactttggtgcctgacatgccagattctcttttgtttttctaacactccaggttctatcttgctcccatgcctttatttaatttacttattatatgcaaagtaacaaaaaatacacaatagatgttcatgctctcctctgcctagaatgtccttccaccctatccttgtttacctgcagctgggctcatccttggagacctcgactgggcttcgccttcttcattccagtgaggtcacgcacctcca

SEQ ID NO: 124592 - DNA, 601 bp, Human
gtggtggctcacgctcataatcctagcaatttgggaggccaaggagggtggatcacttgaggtcaggagtttgagaccagcctggccaagatggtgaaactccatctctactaaaaatacaaaaattagtggagcatggtggtgcgcacctgtagtcccagctactcaggaggctgaggtacgagaattgcttgaacacgggaggtggaggttgcagtgagtctagatcgagccactgcactccagcgtgggtgacagagtgaaactccatctcagataaataaataaataaataaataartaagtaaataaataaaagagatacaacttacatgaagtgcacaaatcataaggtatagctcaatgacatatatcatacctcaacacatacccagatcaggatatgcgatgttgcatcatcccagaaagttccttcaggcccctctccagtcaatacttccctcccagaggcaaccacgcttccgaactctccagagacaagttttgcctgtccttgaactttatgtaaggggaatcatccagcatctcctctttcatatctggcctcctttgtgaacatggtcttgaggttcatccgtgt

SEQ ID NO: 124593 - DNA, 601 bp, Human
ataatgcttagggttgatcagccattatcccatagctccctgtccatggctcagtttggtgcttagattaacctaggaggtggtaaggaaagtactcttgccaccttgaggggtgaaaaggctaaatgacttctgcaggggtaacattcagtaagtggaggagggcctgccttgttctctcctttgtctccaggttaaactgaatgatactctaatgtaccagaatatgccctttgtaatattttatttttttaaaatttattttactttattttattttattttttagatggagtctcastctgccaccaggctggagtgcagtggcacgatttcagctcactgcaacccccgcctcccgggttcaagcgattcttctgcctcagcctcctgagtagctggggctacaggtgcctgccaccattcccagttaatttttgtatttttagtagagacagggtttcaccatgttggccaggatggtctcgatctcttgatctcatgatctgcccgctttggcctcccaaagtgctggaattataggtgtgagccactgcgcccagtcatttatttttatttttatttaattttaatttttttt

SEQ ID NO: 124594 - DNA, 601 bp, Human
acctaggaggtggtaaggaaagtactcttgccaccttgaggggtgaaaaggctaaatgacttctgcaggggtaacattcagtaagtggaggagggcctgccttgttctctcctttgtctccaggttaaactgaatgatactctaatgtaccagaatatgccctttgtaatattttatttttttaaaatttattttactttattttattttattttttagatggagtctcagtctgccaccaggctggagtgcagtggcacgatttcagctcactgcaacccccgcctcccgggttcaagcrattcttctgcctcagcctcctgagtagctggggctacaggtgcctgccaccattcccagttaatttttgtatttttagtagagacagggtttcaccatgttggccaggatggtctcgatctcttgatctcatgatctgcccgctttggcctcccaaagtgctggaattataggtgtgagccactgcgcccagtcatttatttttatttttatttaattttaattttttttttgagacagagtattgctctgtcacctaggctagagtgcagtggtgcaatctctgctcactgcaacctct

SEQ ID NO: 124595 - DNA, 601 bp, Human
tgccttgttctctcctttgtctccaggttaaactgaatgatactctaatgtaccagaatatgccctttgtaatattttatttttttaaaatttattttactttattttattttattttttagatggagtctcagtctgccaccaggctggagtgcagtggcacgatttcagctcactgcaacccccgcctcccgggttcaagcgattcttctgcctcagcctcctgagtagctggggctacaggtgcctgccaccattcccagttaatttttgtatttttagtagagacagggtttcaccwtgttggccaggatggtctcgatctcttgatctcatgatctgcccgctttggcctcccaaagtgctggaattataggtgtgagccactgcgcccagtcatttatttttatttttatttaattttaattttttttttgagacagagtattgctctgtcacctaggctagagtgcagtggtgcaatctctgctcactgcaacctctgcctcctaggttcacaccattctcctgcctcagcctcccaagtagctgggactacaggtgcccgccaccacacccggctaatttttgtatttttagt

SEQ ID NO: 124596 - DNA, 601 bp, Human
tgcagtggtgcaatctctgctcactgcaacctctgcctcctaggttcacaccattctcctgcctcagcctcccaagtagctgggactacaggtgcccgccaccacacccggctaatttttgtatttttagtagagatggggtttcatcatgttagccagaatggtctccatctcctgacctcgtgatccaccccctcggccttgcaaagtgctaggattacaggtgtgagccaccgcgcctggcctatttttgttttttaaacggagtctctctctgttgcccaggcaagagtgcagtggygagatctcagctcactgcaacctccgcctccaggttcaagtgattctcctgcctcagcctcccaagtagctgggattataggcattcaccatcacatcccatcacataatttttgtatttttggtagagatggggtttcgccatgttggccagactggtcttgaactcgtgacctcaagtgatctgcttgcctcggcttcccaacgtgctgggattacagacgtgagccactgtgcccagcccctttgcaatattttataaaggttaaccaataggcatagagtccttattttactataa

SEQ ID NO: 124597 - DNA, 601 bp, Human
tttactcagaagaatagagcccacgcacagggaaaatgtcccttcttctactgatgtcccaaatgcctctttgcttaaagattgcttaagagggatgccaatgtagttaatgcagctctatagtgaggagtgaacccagtccagctccatattacatttttgtgtttcataatattataaggctcttagcaaggaggggaaagaaccaattcagagaaaaagagcttatgccctctggaatgaataagatgccaagatggcagatagtaccagatagttcatcttaatgctttttttttttgttttttttttgagatggagtctcaccctgttgcccaggctggagtgcaatggcatgatcttggctcactgcaacctccccctccggggttgaaatgattctcctgcctcagcctcctgagtagctgggattacaggcacccgccatcatgaccagctaatttttgtatttttagtagagacagggtttcaccatgttggccaggctggtgtcgaactactgacctcgtgatccgcccaccttgggctcccaaagtgctgggattacaggcatgagccaccctgcccggactaatgcctt

SEQ ID NO: 124598 - DNA, 601 bp, Human
cataagcatttgtgttgacattgatcaaaaaacactactattgccaactactcagcatgtgtttctaatacctactatgtataaggcatagttctagatgctatgagctagacattgatcagaagcctgtaagacctgttctcaagaagacaggttaaatatacattaaagtaattcagaatacatgacagtcttcgaaaagggcaaagaaaagacaggagtttaaattataattggaagaagaatgtgaagggaaacagaggtcaagagagataagtattgtttggaaagatcaggaatkatgtgaaattcagatagtggaaaatgtaaaatttaaggagggataagcagagaaaagggacaagccagagggaacagctaaagactagtttgatgagaagaagaaggttacccatgtttcacttgtacactgtcttaggtggtaagctaaggaatttaaacttgtctttaaaaaaaaaacaaaatcactttattgaggtatgattgacatataaaaagctgtgtctacttaatgtatacatctcgataagtttgggcataagtatacccctatgaagcaatcaccaccatcaaggagata

SEQ ID NO: 124599 - DNA, 601 bp, Human
caccaccatcaaggagatatttatgtccattaacttttttttatagacagtggggagccatagaatgttcttaacaagggacttatatcatttagggattttttttttttttttttttttggtgaggcagagtcttgctctgtcacccaggctggagtgcagtggcgcgatctcggctcactgcaagctccgcctcccaggttcacgccattctcctgcctcagactcccaagtagttgggactacaggcgtccgccaccacatttggctaattttttttttttgtattttttgtggagayggggtttcaccatgttagccaggaaggtctcgatctcctgacctcgtgatccgcccacctcagcctcccaatgtgctgagattacaggcgtgagccaccgcacccggcccatttaaggctattttatcataagcagcagagaagccaatttgacctggcttaaacaacaaaggaagtttcttggcttacacaatagaaatctctacagacagatattggcctcaggtaaggtttgatctagcaatccaaacaagaactcccggacactagttcctctctgcctcagcttcatccttagat

SEQ ID NO: 124600 - DNA, 601 bp, Human
tttcaaagtagggtgggtgtggaagggaaactatgccttttgtttgcaaagaaaaatttaaaaacaattgataaacagtatttagtgtcatatggtttatatcctgcagagccttctataaaagaccttagtaatgcttttggcattttattacattaattttttaaaacattatttctgctgcctagggtctttggtggggaaatgtactatttagcaatatgtttagtgaacttttgtcctgtcatggtaagaagaaagcagctataactaagtaaggagttactcttattcattaacrtgtaaaacgctgtttaaaaaaaaaaaactggtcatttttttaagttttatttttaattggcacatttatttatggagtacaatgtgatattttggttcatatgtacattgtacaatgaccaaatcagggtaattagcctatcaatcatctcaaatatcactttttcgtggtaacaacacttaaaatcctcttgaggtattttgagatatacaatacagtattattaattataatcactttgctgtacaatagatcaccagaacttactcttcctaattttgtacctgttgacaaactctt

SEQ ID NO: 124601 - DNA, 601 bp, Human
ttttcttacactcaccaaactatggaggattcatcaccagaccgggaagcaacagcctgggctccagagtcagacacttgtccgtgcacagcgagggaaggtctcatgaagtttcggtgcagtctgggactctagctgttttcgtaacaagttgtttggcatgagacccagtcacgagtgcccttcgtgactgggcttaaggaacacaaaaaggtcacaacttgtttttgcgattgtctattgttttttaataactaacgtgtaagaatagattgaaatagagatttctctgaaacagcgmtggatgaatgcctcaaggggctcactcaacctgtttcaggacttagtgaccattgtttgtgtccatgttcaattgagttcaaatttaatatttaacttttcctccacacacatgcctggctaatttttgtatttttggtagagacagggtttcgccatgttggccaggctggtctcgaactcctgaactcaggtgatccacccaccttggcctcccagagtgctgggattataggtgtgagccactgcacccagcctagaattgtttattctatttctgtgaagaatgtcattggtattt

SEQ ID NO: 124602 - DNA, 601 bp, Human
aatgatcctttgaatttctgcagtatcagttgtaatgtctccttttcatcgcctttttttttttttttttttttccacttgagacagagtcttgctctgtcacctaggctggagttatcttggctcactacaacctccacctcctgggttcaagtgattctcctgcctcagcctcctggctagctgggattacatttgacagagttttagctcttggtcaggctggtcttgagctcctgacctcaaatgatctgcctgctttggcctcccaaagtactgtgagccaccatgcctggcctcsttttaatctctgattttatttatttaggtcctctatttttctcagtctgactaaaggtttatcaattttgtttaactttttaaaaaaactttttattgaactttattatttcttttcttctattattaattttggatttggtttgctcttgcctttctagttccttaagatgcattgttaggttatttatttgaagggttttttgttgttgatgtagacatttagagctataaacctccctattagtactgctttccctatatctcataggttttagtatgttatgtttccattatcatg

SEQ ID NO: 124603 - DNA, 601 bp, Human
tatataaaatatatatacatatattatatatacacacatatatatatacacacacatatacacacacacacacacacacacacacacatatatatatatatatacatatatatatgccctaagagtgagttttttctcttggcaggggttcttgagatcaggattggaggattaaaacttcaggcctttcttttattagtctcacagagtgactggtttgatttgtgttttagaattagaatcaccttcttcaccagacttcctttgcatgaagcagtaggagcaagtggctgcttgaccrgcttgagctctaaagtgtgtttgtggtatgaagtgttctcagaggaaccgaaatcggtgtggtcacacatcatcagtgcctcttcatacacccacgctctcctgaagtttgctgtttgtattgcttccagtgcgtgttgctgttcaacagtacccttggtttcagcgtagttgctatgatgaagaaaacctgttagaatctgccttttttttttttccagaactgttggaaacattgaataattccatgtactctaaaaggaaataaagtcttttgggtaatttggacccaaagactcct

SEQ ID NO: 124604 - DNA, 601 bp, Human
agctgtgctggtccttaccctggggcctttgctgcctcagagagaggggtcctcagcaaacaggtgggatcttgtcagtaccctgcttaagacacgggcggcccttggctctcagggtgaagaacaccaggtccttcgaaacatgccaccacccatgtctcttgtctcatttcacctcctagccctcccctcagccacagggtcaggccctcttgcttttgagcctggtttcttggatcagatccagtgtttctgtctcaggaagcttgcccctgctgtcctgctcccctccctgctgtcrgcatccactctgcaccctactttctactacttgacatgttttaaattgtgattatatggttgataccagtgtcccctactcgactgcaggctccacgaggccactgagtctctgctgctaagagcagaccccagcctaggttagacgctcactaaaggtgtgtgaggtgcacagctgggttgggggcacaccaggcacccttctgtgttgtttcttatacttggctgatgacagactctccgcatgtgacttttgcttttttctcatccgctttaaacctgtgttcccggtttggaaggc

SEQ ID NO: 124605 - DNA, 601 bp, Human
tgctgcctcagagagaggggtcctcagcaaacaggtgggatcttgtcagtaccctgcttaagacacgggcggcccttggctctcagggtgaagaacaccaggtccttcgaaacatgccaccacccatgtctcttgtctcatttcacctcctagccctcccctcagccacagggtcaggccctcttgcttttgagcctggtttcttggatcagatccagtgtttctgtctcaggaagcttgcccctgctgtcctgctcccctccctgctgtcagcatccactctgcaccctactttctactrcttgacatgttttaaattgtgattatatggttgataccagtgtcccctactcgactgcaggctccacgaggccactgagtctctgctgctaagagcagaccccagcctaggttagacgctcactaaaggtgtgtgaggtgcacagctgggttgggggcacaccaggcacccttctgtgttgtttcttatacttggctgatgacagactctccgcatgtgacttttgcttttttctcatccgctttaaacctgtgttcccggtttggaaggcccatgcctctggcagtctcatccccttga

SEQ ID NO: 124606 - DNA, 601 bp, Human
ggataatacagatatcagaaacgtggccacacagcttgttatgtgtgttgttgcctttaagattagactgcacacaaaacctggggagtattttgataacctggtaaaaacaattttgaagtgaaagttgatgtgttgacaatattggctatagtcatgaacctatactggggtggggcaggaattgtggtttattttttaagacacaccccttgaattccagggcagggagaagaaccgtttttgttctttctggtcttcagaatatcggaactgttagcttgcaagtaactgttacatktctcctctcacacagaagtatttaacctattggatttttttgtaatgacgatttagtttagaaatatgctgagcagatatagatacgctagaatctatagcgtatagttgtatgtatagttggtggtcaggcagaacggatagaaacaatatctaaaaagtgatttcaatacatatatatgtatctagttttaagtcaaattatgggaaaatctggatttgtggaaagctctcatttgtgaagagtaccactagaattccttttaaaaataagttcatttagggaaagaaaaattattct

SEQ ID NO: 124607 - DNA, 601 bp, Human
aggaattgtggtttattttttaagacacaccccttgaattccagggcagggagaagaaccgtttttgttctttctggtcttcagaatatcggaactgttagcttgcaagtaactgttacatttctcctctcacacagaagtatttaacctattggatttttttgtaatgacgatttagtttagaaatatgctgagcagatatagatacgctagaatctatagcgtatagttgtatgtatagttggtggtcaggcagaacggatagaaacaatatctaaaaagtgatttcaatacatatatrtgtatctagttttaagtcaaattatgggaaaatctggatttgtggaaagctctcatttgtgaagagtaccactagaattccttttaaaaataagttcatttagggaaagaaaaattattctatgtgctaaagttttagctttatatgtagttttccagaagcaagtttactacattgagtgagataccctctattttgccctcagggaggaaaagtgcagtcctgctgcaagcttctgtctgtgttccttccctgaaaggtcagcgctctgttgaggaggaccctctgttctctttgggt

SEQ ID NO: 124608 - DNA, 601 bp, Human
gaagagtaccactagaattccttttaaaaataagttcatttagggaaagaaaaattattctatgtgctaaagttttagctttatatgtagttttccagaagcaagtttactacattgagtgagataccctctattttgccctcagggaggaaaagtgcagtcctgctgcaagcttctgtctgtgttccttccctgaaaggtcagcgctctgttgaggaggaccctctgttctctttgggtcgggtggggggtatggtggggctagggtgatcagcatgcctttttgtggtccttatctacyctagagctcttatcctcaagcagctttgtgaccaaagaaaaggtgttcatggagaaggatctggggagcccagaggctgttcagggttctcctccacaccccaaaggcctggcacactgatgcctttgggaaattgctgaatgtgcagagcctgcccatgtgtacctgctttattcaggaatgagatttctgactatatgaagaaggagaaaagtgtgcttagtcagggagtcatgttgcacaggtcctgtctgaaaaccaagtaatgttagcctgcagagaagaccatggaggtcacct

SEQ ID NO: 124609 - DNA, 601 bp, Human
accaagaaagtaaatttttccaatactgtagaagaagtgtgtcttttaaaatctcatttaggtaacattgagtgttacatgcagaaatgaaaaagcttcaaaactctggagatttcttctcaaacatgacattgtaaaatgattaggctctcaaaattaattggttgaacaactaaaacataaagcttgtttaacaaacgtgactgtcttccatgtccctggccctatagatgcagcggtaagtgggatatggggtttagaaaggtttctcggaagagatgatccttgtagtgagtcttaktgggatgatcaggagctagtcctgccagtgatccttcttccagtcttaccaagccatatgtgcaaaggctagaaagtgagaggaagcacagtctgtctgggaaactcctggagtccagtcctctcagctgggatgggggtgtgagatctgctggagtcaaagtacagattcaaggagaacccagcagtttggaaaaaaggacagaaagttgtaattagggccagaccaattgttaaggcaaatgtcttattcccagtttttgtgaactgttgttcctcaagaaccactgggcatgtgggg

SEQ ID NO: 124610 - DNA, 601 bp, Human
tgggaaactcctggagtccagtcctctcagctgggatgggggtgtgagatctgctggagtcaaagtacagattcaaggagaacccagcagtttggaaaaaaggacagaaagttgtaattagggccagaccaattgttaaggcaaatgtcttattcccagtttttgtgaactgttgttcctcaagaaccactgggcatgtgggggaaagccccaggagttttatgaggtagtaatttccccatcactgcaagtgtccatgaagagacaaactcccaggtcatagatattgtatagggatgargccatggggaaaatgacggtggggaattctgcattgaatgagagtctggactgaccttcaaagatttttttagagtgctaaaatgaaaaatatctctatttggaaacccgcagaaaatgcatttatacaggcctccctctgtactgtcaaaatcatgctaagacagttatttgaaatttgaaacccttttaaatagggcctgatctgagaattcaggcataattaataattccatctccatgggaaagtacatttgaaaggaaaaatagatggggactcctccctgtctttgtcatggcc

SEQ ID NO: 124611 - DNA, 601 bp, Human
ttgcccagagaaaaattcctagaaccatttagtcaaactactggctaagatcttgctgggaggtagcctgtatttgtggtgtggtcctgtgttcccagtgggactgaagtggattggagggccgtgctgtgcctgctgttgggtagcatcactttgagctggatgacgaaggactttccccaaacctgtcctctgttgtacacatccccacacccaaaaccttcctaacattgtcactttccgaggtcaaatgtacagataaatacagggtatataggacccattccaccttaaagccaayagcattgtgtcagccggggtggcctttcctacgagagggcattattcacagccagtaattacaatgaatgaaggaagaaaccatcttcctttcagttatgaattcttcagtaatatttaatgaggggtgggtggaccaaagacacttccttcccttctgaagaggatttagagtggagtggtaagggggaggaattggactgcttcccgttagaattctgcccctcctctcctttttaaggaaaatgtccctaaggagctcactataaccaggcggttctttaaactgacaactgcctgt

SEQ ID NO: 124612 - DNA, 601 bp, Human
gtatatgccaaggaagtagttatttacatagttataatgctctttcaaacaactagattttttttttttttttttgcttagaatttaattaaaagaggaagaataattcttaagtattgcctgttctagttgtttaaagagaaatattttgtcacccattctggtgatgtagttatctggtcatagaagggacttgtatttctgccacttttgtctcctaatgtagagaaaatgatcattttccttattcagaagtataggttagccaagaaaggtaaaccattgtctgtttatgcctggmtttttttttaatcagcttaggtgtatttttttttaccctagttatactaagcctattttcaggattaaatgaggtttctgagctaataggaatcaaagagagtaaggactttgaagttaggtacaccagagtttcagtaccactcagttggacaagttatataatttttttaagtcttggtttattcttttttaaaaaaaataaggataaaaataactactattattgaacattatttactctctcacagaactcaaaccaccaattcagtgaggcaggtggcattgttatcttgcgaat

SEQ ID NO: 124613 - DNA, 601 bp, Human
tatatgccaaggaagtagttatttacatagttataatgctctttcaaacaactagattttttttttttttttttgcttagaatttaattaaaagaggaagaataattcttaagtattgcctgttctagttgtttaaagagaaatattttgtcacccattctggtgatgtagttatctggtcatagaagggacttgtatttctgccacttttgtctcctaatgtagagaaaatgatcattttccttattcagaagtataggttagccaagaaaggtaaaccattgtctgtttatgcctggctttttttttaatcagcttaggtgtatttttttttaccctagttatactaagcctattttcaggattaaatgaggtttctgagctaataggaatcaaagagagtaaggactttgaagttaggtacaccagagtttcagtaccactcagttggacaagttatataatttttttaagtcttggtttattcttttttaaaaaaaataaggataaaaataactactattattgaacattatttactctctcacagaactcaaaccaccaattcagtgaggcaggtggcattgttatcttgcgaata

SEQ ID NO: 124614 - DNA, 601 bp, Human
cagagtgagactctctcaaacaaacaaacaaaaaatatatataggggcaggtgaacttatgaccctcaggccaaatctggcctgctgcctttttgtgtatggcccatgagcttgggatgggttttacatttttgaatggttgaaaaaataataaaaatatttttcacatgtgaaatatatgaaattcaaatttcagtgtccacaaatgaagttttactggaacacagccatgcttatttgtatgtgttgcctgtggtggttttctgctacgctggcaaagttgagttgtgacacagaccartgtggcccacaaagacaaaaattatttaccttcaggcccttcacagaaaacctgggctgacccctggtctagtgctgagataagaactcctagagctttcccttttccctgttccttcggccatgcttctgccctcctcactctctcacctcccagttaggtttatcttgcctggataaaatcagggctacgtcagccatttgaaaagaatatgaatccccccccccaaaaaaatgcagtttgaaatttgtatccctaatagtttaggagtaaagtgaaaatgggaagttgccacacagc

SEQ ID NO: 124615 - DNA, 601 bp, Human
ctgctcttctgtccctttgtttttgccagcatcttaattcttactaattgatttggtgaggttatttttatgtattcttttaacacagaattattttttgtgtttcagagcagttttatttcaaaggataaaactgtctcttgaaatagtcatgtggtgctttgtctgtaataggttagaatattgccatccatagaagagtaaaaatgactgctgcttttaaataggcttaaattattgactttttatacaaccagcataggcgctgtcattagagcgtcagacctcttatattcagtcygaacatagtccaaatagtcaccatatttattagtttatttgaaccactctcaatttcaccatttgatttgctttcctaataggttctaaactctttgaagctcagttattttgttctgttttctcagcctatgaatttggcctcttgccaagttagttttgattacatttttgctttttcatttatgagctgccataaaagagattgttctgtcttatgctttactaatagttggttaaaggtttgacttaaaagacttggttggcccagagtcatacaagtgcatgtttgccattctga

SEQ ID NO: 124616 - DNA, 601 bp, Human
cgcctcagttcctttattctcctcttgttcttgaggactgaccaatgggtgtgtgtccctgtttgcctctttgctggggtcacagaggaacccaggagctcacattgagtggcccccagacatgtcactggggccagaaagtgccatgaggatgggggtctacactggggtgtggggtggccatatcttctggccctgacttgaacaatgagtccatgtgtggcctctagtttacataaataaagaatggctgtggctgggcgcggtgactcacgcctgtaaccccagcactttgggaggyccaggcgggtggatcacctgaggtcaggagttcgagaccagcctagccaacatggtgaaaccccatctctaaaaatacaaaaattagctgggtgtggtggcaggtgcctgtaatcccagctactcagggggccaaagcaggagaatcgcttgaactcggaaggcagaagtggcagtgagctgagattgcaccatcacactccagcctggggggaaagagcaagacttcatctctaaaaaaaaaaaaaaaaaaaaaagaatggttgtaatcccagcacttcaggaggccaaggcgggtgga

SEQ ID NO: 124617 - DNA, 601 bp, Human
agctctgtgtggggagagaggaaggttgagcacaggagcctgcagaacaagaggagtgactgaggcccctgggagatgctgctagcctggttgtagctgggcagtgttacatgagcaccagcttacagtggttgacctcctgaccttatactatttccacatcttttttcattgtacttatggcaaaatctaagttatggtagctgaaataatcccttgcctttctgtgtacatttcacaaaatttaaagttaatgaaagaaaagaaacctttttaaattcagcaaaatatacatatatgggtgtgtgtgtgtgtgtgtgtgtgtgtgtgtgtgtgtgtgtgtgtgtattttagttcctctgcttcatcctggtcagtattttcaaatgctgtttaatgcagtaaaatctacacaaaacatgttctgtgtcaaaaagaaaataacgggcagtgaaagatatgtacatttgaatttgaaaaggttcattgttttcacttgactcaagtgaaatgttttttattctgttctattctgaaattctcatggttttcttttaccttatcattgagggaagtaaaccccgtgttaagcttagtcaca

SEQ ID NO: 124618 - DNA, 601 bp, Human
gaggtcaggagttcgagaccagcctgtccaacatggtgaaaccccgtctctaccactaaaaatacaaaaattagcctggtgtggtagcacatgcctgtaattccagctactcaggaggctgaggcacgagaatcacttgaacccaggagatcgaggttgcggtgagtcaaaattgcaccactgcactccagcctggcaacagagtgagactctgtctcaagaaaactaagcacaggctgggcacggtggctcacgcctgtaatcccagcacttggagaggccgaggcgggtggatcatgargtcaggagatcaacaccatcctggctaagatggtgaaaccccgtctctactaaaaacacaaaaaattagccgggcgtgttgataggcacctgtagtcccagctactcgggaggctgaggcaggagaatggtgtgaacccgggaggcggagcctgcagtgagcatggatcgcgctactgcactccagcgtgggtgacagagtgagactccgtctcaaaaaaaaaaaaatgtctacttaagggcctcctggtgttcttaaggagatgaggagcacctttgcgatacagaacacaacattata

SEQ ID NO: 124619 - DNA, 601 bp, Human
gttggaatctgaagctttacagccttctttacaggacactactgtgtgccaactttgcatcactgtgcagtgagtgggggcccttaaccaagctattggactcatgcagccagggtcctagatttgccgcagtaggtcaatcattccataagtgaaacacgcagtagatgatcagaaaatgacaaattcatcaactgttttcataaagtagaaatcactctgctctgggtggatttaaggaacatgtggggttcagacctgtcctgtaggatctcccaaagacccaacttagccatgaggkctgattagagtatagaacctcttaagaaacgccctggatttgttggcaagatggcaaataggaacagctccggtctgcagctcccagcaagattggtgcggaaggcaggtgatttctgcatttccacctgaggtactcagttcatctcattgggactggttggacagtgggtgcagcccaaggaggatgagccgaagcagggtggggcgttgcctcacccgggaagcgcaaggggttggggaactccctctcctagccaagggaagccattagggactgtaccatgcaccccggcccaga

SEQ ID NO: 124620 - DNA, 601 bp, Human
agtgggggcccttaaccaagctattggactcatgcagccagggtcctagatttgccgcagtaggtcaatcattccataagtgaaacacgcagtagatgatcagaaaatgacaaattcatcaactgttttcataaagtagaaatcactctgctctgggtggatttaaggaacatgtggggttcagacctgtcctgtaggatctcccaaagacccaacttagccatgagggctgattagagtatagaacctcttaagaaacgccctggatttgttggcaagatggcaaataggaacagctccrgtctgcagctcccagcaagattggtgcggaaggcaggtgatttctgcatttccacctgaggtactcagttcatctcattgggactggttggacagtgggtgcagcccaaggaggatgagccgaagcagggtggggcgttgcctcacccgggaagcgcaaggggttggggaactccctctcctagccaagggaagccattagggactgtaccatgcaccccggcccagatgttgcacttttcccacggtcttcgcaacccacagaccaggagattccctctgaagcctacaccaccagggc

SEQ ID NO: 124621 - DNA, 601 bp, Human
gttgcaatcctagtctctgataaaacagcctttaaactacaaagatcaagagacaaagaagggcattacataatggtagagggatcagtgcaacaagaagagctaactatcctaaatatatatgcacccaatacaggagcacccagattcataacgcatgttcttagagacctacaaagagacttagactcccacacaataatagtgggagactttaacaccccactgtcaatattagatcaatgagacagaaagttaacaaggatatccaggacttgaacttagctctggaccaagcggrcctaatagaactcttcaccacaaatcagcagaatatacactcttctcagcaccacatagcacttattctaaaattgatcacataattggaagtaaaacactcctcagcaaatgcaaaaaaatggaaatcataatggtctctcagaccacagtgcaatcaaagtagaactcaggactaagaaactcactcaaaaccacacaactatgttgaaactgaacaacctgctcctgaatgactactgggtaaataacgaaatgagggcaaaaataaagatgttatttgaaaccaatgagaacaaag

SEQ ID NO: 124622 - DNA, 601 bp, Human
agtaagatcatgttgcctccaataaagaaatcattcacattataaaaatatgattctttcctttagataaatttatctttaaggtattctaaaatgtgattaccatcctaggcaatacgacaggaccctgtctctacaaaaaaaaatttttaagttagccaggcatagtagtatgcacttgtgtcccagctattcaggaggctgaggtgggaggatggcttgagtccaggagttagaggctgcagggagctgtgatcaccactgcactccagcctgagtgacagtcgaggctctgtttccaaaaaaaaaaaaaaaaaaaaagtgattgactgtacttaagtaaattatatttacattagatttcctgtttacttagtactgaataaaatgtaatctacagtctgtgttacacagatggatgtatagaaccaatttataaggacttttttttaaaattatactgaatttttatatatatatcacaataagaattgaggttaggattatggtttttttactaacatgaatataatatcatcacctagttgccttcgtttagttcagtacaattactgcacatcatttatatatctttgttgaa

SEQ ID NO: 124623 - DNA, 601 bp, Human
aagttagccaggcatagtagtatgcacttgtgtcccagctattcaggaggctgaggtgggaggatggcttgagtccaggagttagaggctgcagggagctgtgatcaccactgcactccagcctgagtgacagtcgaggctctgtttccaaaaaaaaaaaaaaaaaaaaagtgattgactgtacttaagtaaattatatttacattagatttcctgtttacttagtactgaataaaatgtaatctacagtctgtgttacacagatggatgtatagaaccaatttataaggacttttttttwaaattatactgaatttttatatatatatcacaataagaattgaggttaggattatggtttttttactaacatgaatataatatcatcacctagttgccttcgtttagttcagtacaattactgcacatcatttatatatctttgttgaatatgtttccactaacttctttttttttataattttttgtctttaggaataagtttgtggagtttgacatgaagccagtctgtaagaagtgctatgagaaatttccattggagctgaagaaaagacttaagaaactagctgagaccttagga

SEQ ID NO: 124624 - DNA, 601 bp, Human; identical to SEQ ID NO: 20668

SEQ ID NO: 124625 - DNA, 601 bp, Human; identical to SEQ ID NO: 20669

SEQ ID NO: 124626 - DNA, 601 bp, Human; identical to SEQ ID NO: 20670

SEQ ID NO: 124627 - DNA, 601 bp, Human
acctgcccggccccttgcttggggccgggcgcgtagtgggccgcgccaggcgtagcacctttggagagcgagcggtcacctcctcgaagttggtccgagctaccctgcctgcagcgggcccgggaggcggccgcctggggctgtgcacagggagaacaccacgagcgcagcgccgcagcccagcgccaacagatggtcataggcccggtctgtggaggactctggaaagccggccgctgggaccaggccacgccggcgaggacttgcggggtcccccctaccccgacgccccacgggcacygtgcaccggggccgattgtccgcgcggcgcgcaaggtcggcacgggcgggtcccgaagcctcccgccacgcagctcacggagctgaccccgccaaccagggacgccgagcgacggcttcaaggttacctgcggggcggggcgaggccgggcctgccacccggctttgaccccagccgtgaggctttcgagagtcgtctgcttggctgcgcacgcggcgccgggtcacccgggagacgggttgttttggaagtgggaagggtgggtgggagcactcgagatccctcctgctaaccccctgg

SEQ ID NO: 124628 - DNA, 601 bp, Human
tggtcataggcccggtctgtggaggactctggaaagccggccgctgggaccaggccacgccggcgaggacttgcggggtcccccctaccccgacgccccacgggcaccgtgcaccggggccgattgtccgcgcggcgcgcaaggtcggcacgggcgggtcccgaagcctcccgccacgcagctcacggagctgaccccgccaaccagggacgccgagcgacggcttcaaggttacctgcggggcggggcgaggccgggcctgccacccggctttgaccccagccgtgaggctttcgagagwcgtctgcttggctgcgcacgcggcgccgggtcacccgggagacgggttgttttggaagtgggaagggtgggtgggagcactcgagatccctcctgctaaccccctggagccggaccctgcacgcccagggccttgagggacaccgaggcacttcagccccgggggtgggaggcgtggagctcgtgcgcgagctcagccagatgttccgggcggttgcagatgtgcctcggggccggggacaggactttcctcctccctagcccccagcctggagctcaggtcagtaaacaaactcggttc

SEQ ID NO: 124629 - DNA, 601 bp, Human
gccgggcctgccacccggctttgaccccagccgtgaggctttcgagagtcgtctgcttggctgcgcacgcggcgccgggtcacccgggagacgggttgttttggaagtgggaagggtgggtgggagcactcgagatccctcctgctaaccccctggagccggaccctgcacgcccagggccttgagggacaccgaggcacttcagccccgggggtgggaggcgtggagctcgtgcgcgagctcagccagatgttccgggcggttgcagatgtgcctcggggccggggacaggactttcctyctccctagcccccagcctggagctcaggtcagtaaacaaactcggttctccccctccccccgccgcccctgggacccgttctcaaagccaggcttctgcccccatccccaatttactaggcgctgccgcatttctttgccttttgccaccctttccccccgcccaccacacacaccctctgtcgcgggatccaagtcccccacccccgggggtggctcgggcatgacctcatccgccgaacgactgggaaggagggggtcgcctggggtgcgggggcagaagaggggggccgggccggga

SEQ ID NO: 124630 - DNA, 601 bp, Human
tcagtaaacaaactcggttctccccctccccccgccgcccctgggacccgttctcaaagccaggcttctgcccccatccccaatttactaggcgctgccgcatttctttgccttttgccaccctttccccccgcccaccacacacaccctctgtcgcgggatccaagtcccccacccccgggggtggctcgggcatgacctcatccgccgaacgactgggaaggagggggtcgcctggggtgcgggggcagaagaggggggccgggccgggaaagttcgaggagggccgcaggaactgcayaacccaccaccgtcccgcgtccccctaaaccccgcgtccccaggctcccgaggcttcgctccgcaaaggggaactcttcggagtgctgcgggggaaaggtatggaggagcgcttggtttgcttacccgggagtgggtgcccaagggggtcgtggcgggtgcgagaagcgtcgtccccctcggactcgggcgcccccagccctggcgggtccccgctgagcggctgcccgctgcccgcgaccactgctcacctcccggggcgctcgccaggcgcgccctgcgtgcccgggtgccccggcct

SEQ ID NO: 124631 - DNA, 601 bp, Human
ctcccgaggcttcgctccgcaaaggggaactcttcggagtgctgcgggggaaaggtatggaggagcgcttggtttgcttacccgggagtgggtgcccaagggggtcgtggcgggtgcgagaagcgtcgtccccctcggactcgggcgcccccagccctggcgggtccccgctgagcggctgcccgctgcccgcgaccactgctcacctcccggggcgctcgccaggcgcgccctgcgtgcccgggtgccccggcctgcccagggagcggcgagtgcggtttccagcgggcccgtgcgcackccggctgggcgagcggcgaaggcgccctcttcgtgaagcggcgcgagaaggacgccggggatcctggcaagctgcggccggctcaggacccgcgcggagtcaggcgcggactccggctgctctctgctgcgctcagctcccgtggcctgtgctcgccgctcgcccgagctctcctcctcgcctggcgcgatctccggcgcgagcctcccaaactgctttataaggcgggcggccgctttgatccgcccacgtcagcgcgtcgcaaccccaccgggtggccccggccgcgcgcggggggcg

SEQ ID NO: 124632 - DNA, 601 bp, Human
aacaagaagaatccacccccaaacatatcaagataagacatccattgcttcaaacactgggccaggcagctgtatgttcccgctttcgttttcaggtaagaaaaatgaagacctagaccatggaggggacttgcccagagtccaatttcaagtccagtccggggctctcctcagcatccagcacacgcttccctgactttgcgcaaaggtcttgctcctgacagggaccgaattacagattctgccactttacccgagaattactctccaaacgcactggtctctttgcaggacacagctytctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacaggtgagaaccagagtgtatatacctgtgccttaaactaatacatcccctgtacccagaagagtttctgtggaaagcctgttaggaatggaatcccgccacagagcc

SEQ ID NO: 124633 - DNA, 601 bp, Human
aagaatccatccaggccaggtgcagtggcacactgtaatcccagcactttgggaggctgaggcaggaggattacttgagcccaggagtccaagaccagtgtaggcaatatggtgagacttcgtctctacaaaaaataaaaatattagccaggaatggtggcgcatgcctgtagtcccagcagtggggggcaggggggtggttcaggagaggattgcttgagcccagggaggtcaaggctgcagtgatccatgattgcgcccctgtactctgggcaacagagcaagaccctggttgaagaaraaaaaaaaaaaaaaagaacaagaagaatccacccccaaacatatcaagataagacatccattgcttcaaacactgggccaggcagctgtatgttcccgctttcgttttcaggtaagaaaaatgaagacctagaccatggaggggacttgcccagagtccaatttcaagtccagtccggggctctcctcagcatccagcacacgcttccctgactttgcgcaaaggtcttgctcctgacagggaccgaattacagattctgccactttacccgagaattactctccaaacgcactggtctc

SEQ ID NO: 124634 - DNA, 601 bp, Human
taagaaaagcctcgctggccatctgaaagggtactgatttccctccaccttcccctcactcaaaagaacagaacgaggacccccaagcactgcatttaagggcagttaaaccgacacatgagggtccagcctaggggcagagcactgggccctctgcatgaggcctctaccctcagctgctccaagaaggtgaaacacaaagtgatccatgtacatctgcacacatggggaggggccatccccatgcacaggggaggagccggtccaccgacacacatttaccaggaagtccatctagacmtgtgagcaggagggtgagcgggaggcagtcttggctcagttgtagatgagctgccaaaatttaaggagatagccagagaaggcatgggcagcagaattttggaaacaaacatccagaaaaaagagagagagaccaggagagaagggtagcagtgcacagatcttctccaaaatgggaaccgtccaccaaggacgtctgctgtaaggatcaaagattatgttagtctagatcccctcagccaccactcctcccacctccccaccaccaacactcacacactctgccaggcccctaaagaag

SEQ ID NO: 124635 - DNA, 601 bp, Human
tgctggccggtcatggtggttcacgcctgtaatcccagcactttgggaggccgaggcaggtggatcaccaagtcaagaggtggagaccatcctggccaacatggtgaaaccccgtctctactaaaaatacaaaaattagctgggcatggtggcgcgcgcctgaagtcccagctactcaggaggccgaggcaggagaattgcttgaacccaggaagcgaaggttgcagtgagctgagatagcaccactgcactccagcctagcgacagagcgagactttgtctcaaaaaaaaaaaaaaaaaaggacacctgctgttaaatttaaaggccagtggtttttctagtgattaaatcacttatgcattaaaacaaattagtggatataaaagggtaagagagtatggaccttttagtccaaaataattaatgagataaatctttgaaagaatccccaatgaaagtcctttaaccataagcactgacctttctcaaggctaaacaacaagttctcacagtagttcgaaattatacaaaattggggtggagattgaggtagtaccactgagtcttttacagcaatactatatgcttgtattatattac

SEQ ID NO: 124636 - DNA, 601 bp, Human
tggggacattagaaaaggattcaggaatctataaacaagaaaagcttaccttccaccaccctctgtgctttgggtgtgttctgcccctgactcagtgcaggatcagaatagggcgatcttgataacaatcatgtgtaggcaaaagcctttgtaccttagcaggatggaatagtaaatatctgggtaggtgattccccatgtgtttccaacagacactcatccgtgcagagttcagtgtggcaggcttttctgtagcacagtccctgtaacctgaacggaagactacctgaatttgcacackttagcttaaaactctttctggggcttgaggattctgttcagagtttatttcatcttagcctgtgcagctgtcagtgtgctcacaggaccagggaacccaccaaagaatctgcttcctccgccatcattaaatctggttaatttagagcccataaagtgtcattttaccacatggttcccacgcctggtaatgaccaggaaggaagaattcccactgggattgggcccttgaccatatttcatccaacagtgaggggtcatgagtggaggtggtttctatcatgtttaattatgtgtcaac

SEQ ID NO: 124637 - DNA, 601 bp, Human
tttaattgtttgcttagtgcgctcatccctattactctccttcccttccttgtggtataaattatgaattaaacttgcattttgagaatctgcttgagaatctactcaccattcttcctacagaaacatgtattcaataaaaattcctgactggctcctatttcccaggtcatagaggtgctaggaatatggtgggaagtgaggtggagacatccctgccctcaaggaaattagattggatgagccaacatgcaaggcaggaagaaatagaacctaaagcccaaaatacacactgtctgawacattccatgaagccttcttgtgcaaagtgaatccccattacccgtgctccttatgcagtcagtgtagaacgtaccgcattagcccaaatagaagcgcatctcagggttctgtcagagtgcatgtgatacgtacttctagaaagaccatgcccttgcactctgcctccctccctctctcgtgtctctctctgtctctctctcttcaccattaaaaatgaaccttgagaattggcttccaagtcagaatttgggggaaaccaaccttagaagtgattccttacccatcaaattcacttgcc

SEQ ID NO: 124638 - DNA, 601 bp, Human
aacaccactctgttaggaaacgtgagattggaatttgatctgtcaggttcaccttacccttttaaattcttacagtagtagtattatatatactactatattatatatattatatattagtatataatatgtagtattatatatattatatgtagtattatactttgggagagtattaatagtttgagaactatactgtagtcatacatcttggtgtcttagatggatcctggctacagaatcaaaaacgtatgatagataagtggctactgcagaacaccttacattgttcttaattatrttcttcgtaaagggaagcagagtgttaccagtgactactagtgagccagttgcccctaaagtttgtttattcctgaaacactataacatggcaatttattaagtataatgaagtagaattttgaagagtttggagaaaggtctaaaatatgtgatgtgaaaaagactgaattattcttgtttatgggataatagcatattgttttacaatttgtgtctagaaatcacgtaactgttagaaataattgcttacaaaaagaactagaatgaaaccacatagcttatattataatccgatgga

SEQ ID NO: 124639 - DNA, 601 bp, Human
ttcatgtatccattattcagaaattaatatctgcttctaaaaatattgaagttgttataataaagacacataaggttttttaaaacatatgaaataaaaaacttgtaattggcattggtgtaggcagaggaaagaaagagctagacgaagataattgctataattaaagataattacagctttgagcatccagccagccatgtgaggggaaaagaagaaaggaaatatgatttttgtatgtgtagtttatcttttatacaaaaaggcaaactacttcaccaggacagaaaaccttcttctragaagtaaaatctctaggagtttatcacacagacacataaagctttatgtaccacacagtagaacaatgtcatttaatagttttatgagaaattcagataaatcaagataatttcttatattaatattttataaaagctacttttatgacattacttcatcagtaggttcagctgctacctcatagagtcctgagctcatgtcagtaggactgtgccagctgcagtcctggaggatgttggtattccagtgagctgtggcagagcatgtccttcagttcatctgaaagccatacgaagtc

SEQ ID NO: 124640 - DNA, 601 bp, Human
cacacctgtgatcccagcactttcggaggccaaggtaggaggatcacttgaggccaggagttcaagcccagcctgggcaacatagctaaattccatctcaacaatacataaataaaaattaaccagatgtggtggtacatgcctgtagtcctagttacttaagaggcctaggtgggaggatctcttgagcccaggagttcaaggtttcagtgagctatgatcacaccactgtactccagcaagggtgacagagaccttgtcttaaaaaaaaagttggcaatggatagccagggttgaaaascactggtctaatttaataggtcgccatagtctttaggataccgttggtttgattttcagcatcttagtctctatatctcatatcttatcatctgggtaatacttcattattttttttagagatcagagcttatggtccctaaggttagtttgatgggaaagtcttttcctttctgacttcctttttccttttattctttgctcttttgaaaatgtattttccttctaaagcataatctggagattgagaacttttaaaatctataaaggaatagtccatggtaattaaacttcaagtttc

SEQ ID NO: 124641 - DNA, 601 bp, Human
gaattgcagcatagactcgttatgtgggaagaggaacaatgagctgtatctgttttatattgccacatcctgattatgacatgttccaatactacaagagaaataagatggaatagcatctgctagttaagagtttagaaatatgaatgaatagtctagctcagtgattctcagccccaaacatatattcagataccctggggacaccttcacaaatatcaatgtcaaggccccattcctgatctattaagccaactttgagagttagacctcggcattagtgtattgtaaaaagtttggsctgggcacagtggctcacacctgtgatcccagcactttcggaggccaaggtaggaggatcacttgaggccaggagttcaagcccagcctgggcaacatagctaaattccatctcaacaatacataaataaaaattaaccagatgtggtggtacatgcctgtagtcctagttacttaagaggcctaggtgggaggatctcttgagcccaggagttcaaggtttcagtgagctatgatcacaccactgtactccagcaagggtgacagagaccttgtcttaaaaaaaaagttggcaatggat

SEQ ID NO: 124642 - DNA, 601 bp, Human
tttcttgttgaaatttttatatttgaaaatgcttaaaaataatgctattttaatttctataataaattacaatagccatataacttttgagggatgcagagaaaactacatagaaataatgtagcaaacaagcaaaaaaaagtgtggctcaaaatccctatcttctaaatctgagtctttatgttgtgtgagctcagataccaccctctggaatagattcaaaacatgatctgttttggcctgggctttaaggatatacatgtgagaaactttggtttatgtgaattgcagcatagactcrttatgtgggaagaggaacaatgagctgtatctgttttatattgccacatcctgattatgacatgttccaatactacaagagaaataagatggaatagcatctgctagttaagagtttagaaatatgaatgaatagtctagctcagtgattctcagccccaaacatatattcagataccctggggacaccttcacaaatatcaatgtcaaggccccattcctgatctattaagccaactttgagagttagacctcggcattagtgtattgtaaaaagtttggcctgggcacagtggctcac

SEQ ID NO: 124643 - DNA, 601 bp, Human
ggatagttatacagtgtctgaaatttggtctgatattttctcacagaaacttatacacaaacctctgtcttgtggatgtgagttgacggacatgggtaggcaaaattcttgcttgctatttgatgatttaagtgacagaagtgaaaaaaaattttttaaattctggtatgtagacttagaggcttgatcaatgcgagtttgcattatcgttagactttctagctagtgcccagggtttccttttgcatcacacaatacaatgtctggttgtgcctcttttcctgacattaaaattcatcartggattcagaagaacctgcttattttaaaaactcaatgtatatataatatattcaaatggacagctggtatctgattatttctttattttagttacagctgtgttaaattcaattataaattataaatcataatagaagaatcagctgctttgaatgcaggaagatgcagattcttctttaagtatgtttttgaataaaataagattatgttaaaccagccagggaagcagcaaaaggagttaatatttactgggtgcctactctgggcaagggcactgaactgtgcatgttgcacaaga

SEQ ID NO: 124644 - DNA, 601 bp, Human
ctctgccttttaagttggcatatggatgataatgattctggatagttatacagtgtctgaaatttggtctgatattttctcacagaaacttatacacaaacctctgtcttgtggatgtgagttgacggacatgggtaggcaaaattcttgcttgctatttgatgatttaagtgacagaagtgaaaaaaaattttttaaattctggtatgtagacttagaggcttgatcaatgcgagtttgcattatcgttagactttctagctagtgcccagggtttccttttgcatcacacaatacaatktctggttgtgcctcttttcctgacattaaaattcatcagtggattcagaagaacctgcttattttaaaaactcaatgtatatataatatattcaaatggacagctggtatctgattatttctttattttagttacagctgtgttaaattcaattataaattataaatcataatagaagaatcagctgctttgaatgcaggaagatgcagattcttctttaagtatgtttttgaataaaataagattatgttaaaccagccagggaagcagcaaaaggagttaatatttactgggtgccta

SEQ ID NO: 124645 - DNA, 601 bp, Human
ttgtttgccaaactagaagttatgtacaaagttgtaagcccaaaatctgagaattttaccctggcaaaccctacaaatattttaaattaccgcaatgattttttagtaaataaaatgtcaatgcaaatatgtggaactagatttcagagatctcagagatccctgaacattctatggttctttatactggcactgtagagaatttatattatattgaacattttatattaagcatatgtcttgaggccaggtgcagtggctcacgcctgtaatcccagaactttgggaggctgaggcgggygaatcacttgaggtcaggagtttgagaccagcctggccaacatggtgaaaccctgtctctacaaaaaatacaaaaattagccaggcatggtggcagacacctataatcccagctactccagaggctgaggcaggagaatcgcttgagcccggaaggcagagcctgcagtgagccgagatcacgccactgcactccagcctgggtgacaaagcaagactctgtctcaaaaacaaagggcaaggggaacttgatgttgagttggatatgggaggaaacagagagggtggtaaacagggagga

SEQ ID NO: 124646 - DNA, 601 bp, Human
gaaaatatgtctagccgacaactgagcatgtggaaggcactcagcatgtactttctcatttacatcaaagggcagtgaagtgactaagagtgtaggcccttaaagcaggtataataacctgatagccttaccatttaccagctagtttgccttgaacaaattactgtgcctctttagtaccatgaggacaataatacctcctatagcatttgctgcataacaaaccactccatgacttaacggcttaaaaacaacagccatttactcagcagctcattctacagttttatagtttgggccrtcttaggttggaggttcttctggtctcagttgggctcatgcctgtgtctttggtcagcttgcagtcagctagatgtctctgcttctgaggattggctggctactgggggaacaataaggacaactggatgaccaccttctcatcatccagcaggctagtgtgggcttattcacatagaggatcagcagaattccagagtgagagtagaatcattcaaagcatgtgggctgggttcaacattgacacaccattgcttccaatgagctccatgagctaaagggagtcacaaatcagcccacc

SEQ ID NO: 124647 - DNA, 601 bp, Human
acaggccttgagaacaagcaaggaaagcctcctggggaggtctttctgtagtggaatgctcctgctctttgtaattgggtagcttgagtagctgtgaagttctttaaagaagattattttcaaaaagaaagaaacttaccaatatctggagaggggcagaaagcacgtgttgcttgccctaagtctccatcctacaaataccaggagagtttgtcctgattttgaaaggatttaggaggtaacatcctgcttttgtcaacgcatggtgtttgctttgacttttgtttggcatcttatttcrcctacaagatcagtgggagctaaaatttattgagcgcacctgctaagtatcaggtcctgtgctataaacatcactctgtctcacagccaggaaagatagaattattcacttagaaataaaaagtcagagttctgttttgttagagaaatcttagtgtaattgcataaatatttagtgatttctttattcatctggtgacctttgttgaatacatatgctattccaaaaataagtttaaacatgcccaaagaatacaaaggatctgtattcattatctgttgcttcataacaaccttagtg

SEQ ID NO: 124648 - DNA, 601 bp, Human
tacccaaggggctgtttaaattcccatgtgcaggtataccctcaaactaattaagtctatctctggaggtatttttttaaagctcccaaggtcctttgaatatgcagccaaagttgagaaatacaggccttgagaacaagcaaggaaagcctcctggggaggtctttctgtagtggaatgctcctgctctttgtaattgggtagcttgagtagctgtgaagttctttaaagaagattattttcaaaaagaaagaaacttaccaatatctggagaggggcagaaagcacgtgttgcttgccytaagtctccatcctacaaataccaggagagtttgtcctgattttgaaaggatttaggaggtaacatcctgcttttgtcaacgcatggtgtttgctttgacttttgtttggcatcttatttcacctacaagatcagtgggagctaaaatttattgagcgcacctgctaagtatcaggtcctgtgctataaacatcactctgtctcacagccaggaaagatagaattattcacttagaaataaaaagtcagagttctgttttgttagagaaatcttagtgtaattgcataaatatttagtga

SEQ ID NO: 124649 - DNA, 601 bp, Human
cttgccaaatgttcatattatgcttgtcgagttaattatcaggaagttacttatctgatcattgtttcttaatttctattgagccagtcattgtcctttataagaaattattttccagctgtagtatttcagtgctgggttttgattatagacatataaaaagggtttatttaggactgcctttaaaattaaatctgatcataattatttgactagtagaggcactctaggaaaaggttgagtagtggctgtccactttggctactcagtaaaattacccaaggggctgtttaaattcccrtgtgcaggtataccctcaaactaattaagtctatctctggaggtatttttttaaagctcccaaggtcctttgaatatgcagccaaagttgagaaatacaggccttgagaacaagcaaggaaagcctcctggggaggtctttctgtagtggaatgctcctgctctttgtaattgggtagcttgagtagctgtgaagttctttaaagaagattattttcaaaaagaaagaaacttaccaatatctggagaggggcagaaagcacgtgttgcttgccctaagtctccatcctacaaataccag

SEQ ID NO: 124650 - DNA, 601 bp, Human
cttaaatgcaatttagcttgaatttgttattcaatatagtcaataatgttatgtggtatttaatttaggccaataaagttttgaatacctaattatgttaaggcctttaagacagttgagaccttgccaaatgttcatattatgcttgtcgagttaattatcaggaagttacttatctgatcattgtttcttaatttctattgagccagtcattgtcctttataagaaattattttccagctgtagtatttcagtgctgggttttgattatagacatataaaaagggtttatttaggactkcctttaaaattaaatctgatcataattatttgactagtagaggcactctaggaaaaggttgagtagtggctgtccactttggctactcagtaaaattacccaaggggctgtttaaattcccatgtgcaggtataccctcaaactaattaagtctatctctggaggtatttttttaaagctcccaaggtcctttgaatatgcagccaaagttgagaaatacaggccttgagaacaagcaaggaaagcctcctggggaggtctttctgtagtggaatgctcctgctctttgtaattgggtag

SEQ ID NO: 124651 - DNA, 601 bp, Human
ttaaacaaatccctatactgttttttatgttctctttttattgaagatatacatagatattcatactattttgaaatgccaattataaattagtacaattttcccaataatatatgggcattattgtgaaatgaaataccttttacctttaatatatggatttatggacactattgtgcccatatattatttagaaaaaatatagtaagtaaattttacatctactattacatccaaatgtggctaacaattcagaatgacttagataagcatcgttattttccagcaatattgacattgyttggctgttccaattgttaattttaaaacccaactgttatcagactaactatgatttaataaaactttggtaaatgtctaaaggagcctttcagtaaatatgatctaaggaaaaagaaatatacagaaatgaaataacttttacatttgattaattgaagtaagttgcaacatttttctgaattgcagttagctttcattttcagactttggaagaacaagtcatttgtaccaggaagtacatggtaaagaactatgtttggcaacttagagaacatttttagcatttgaatttccctat

SEQ ID NO: 124652 - DNA, 601 bp, Human
gtagatacacttcataggtcttgtggatacatacatttaatatacatcatcctcatttacggaaccattacatgttgtagcccagcccaacttgcgtatatgtggaggtgtttgggtcttgactctggactccggagtattctctccatcctggaggggccgtgtgccaggagcccgggggtgtcagccgctctccagatggcctcctttgtgcatcctcacatcagttctgggtgcacccttctccttcctgcatctctaacttagcattggccgagcctggatcggggtttccaacagscttttcacaaaatcacagcgatgcaaagctgtcccaggggttttgtgttgttcagggtggtaaaggttcaaacctaggttctattttttaagtaattattaataaataaaatgatagcttaaatacgttttagaaaataatactgcttcaggacctcttaatgtaagtgaagctattagtgccagtcagatgagtgaacatgcttatgactcacataaacactgcaagcccccatgggggctttaattagtttttataattagtcatttactgttactttatacatagaatggataactg

SEQ ID NO: 124653 - DNA, 601 bp, Human
acgggtgtctcctggaccatagcagagcttgcttaactgtcaggcccctttagggtctgtaaacacacacactgcccccacagaggtacacacaccatgttatgttgtcatttttggaactctatccccattgactgatggcatttgctgcagtggaggaagaatttgtcatccctgtccttctagaattcaaagtgggtgcggactaatccctgttacatggtaaacaggattccaggcacctcctcctgtggctgtcagggtgaactgcatcctgtgacatgcctgcagaggaacgccygagcagcatgtagagaaaggaccagggtactgccctgcccctcctttacagcttcttcactggtgggtcctgggccctttgacataccatggccctgggcacggtggtgtagcacgacctgccagtgtggagagcagccgctctccaggatggacatttgacaattcctccctccccactgccatggggatttagacagttgctcctggaggccttgtcttaacacagaacttcccaaagtggaatctgaggagtttgatgggtgcagctctctctcatttgggcgcccccaaaagagaa

SEQ ID NO: 124654 - DNA, 601 bp, Human
aacatatgatcccccttaaaagaaaataaacttgtcaactttctctgtttagaagttaatatgatatggttgatactacctagcccttagtgttctggaaggcagtttcagattggccaggggagagtcctgttttcctcctcggtcctcatcctggttattctcttctgaagggcttggggtgagggaaatgtaggctgtacattagaggagaattttgtgatactattcattctctgttctgacagagaggacattgtttgttcactgtaataggcttggcaggaatctgtgctgtgcktacagaatgggaaaatagcagagcagtgggaaatctcaaaattctaagcagcagatcagcttagagattttgcaaaaatctattttaatagcttctcattactgtagacgtaagtcataatttggagaaacagttttcctttcagtgataattttcttcacattgcattatgcctgtgttacatgaaaaaagtctttaagatgcagtatgcctatccaagtactgtagtaacaagaattaaaatcatgaaagtttagaaatacttgatgaacacactagacctgctttgatattgccctt

SEQ ID NO: 124655 - DNA, 601 bp, Human
cttgttttatctgatgaaacacctccttccttataaagatatttgtgtacccgcacacagaaatgcaaaaacatatgatcccccttaaaagaaaataaacttgtcaactttctctgtttagaagttaatatgatatggttgatactacctagcccttagtgttctggaaggcagtttcagattggccaggggagagtcctgttttcctcctcggtcctcatcctggttattctcttctgaagggcttggggtgagggaaatgtaggctgtacattagaggagaattttgtgatactattcwttctctgttctgacagagaggacattgtttgttcactgtaataggcttggcaggaatctgtgctgtgcgtacagaatgggaaaatagcagagcagtgggaaatctcaaaattctaagcagcagatcagcttagagattttgcaaaaatctattttaatagcttctcattactgtagacgtaagtcataatttggagaaacagttttcctttcagtgataattttcttcacattgcattatgcctgtgttacatgaaaaaagtctttaagatgcagtatgcctatccaagtactgtagtaa

SEQ ID NO: 124656 - DNA, 601 bp, Human
accacaacatttcaaagggaatacattgccagaacttggaatactctactggacaaacatttcctccaaggtaaatattaccattgtaccaataaagggacacatcactagaatttttgaatggcagtggtacagcacaaaggtttaattgtttagtctcatacagacctagagtgacataagagaaagagagagagggagagagagagaagaaagcagtgctgttggggtatcctgcagcctcttctaaatgtgttaccaggagaatgccatcagaatctgggagctcactgagctgtasgaaaaatgtgtgggaaatgaggaggaaagaagaggctggccttttttcttcgtgttacagatactcgtgaacacaaaagccagcggggttcgattatgaaaataacatttcatcctttatgaggaaaaaaatgagtagtttcctttagaggttaaaataaaatatatgctgtattcatgtcacaagagggaaaagcctgaatcataatattttacaccaactgagacaagtatgaaagattttaaggaactccatgttcttctatgaaaatacctgctaagtaagcctttagtaagcctt

SEQ ID NO: 124657 - DNA, 601 bp, Human
ttgttatgtcagaaatcaggaattatgcctcagttggttaaaatgattgagaggttctgaatcttagtcaacagccaagatattctccttagagcataaacacagccgttctttcatccgtttgttcgttcgttcattcattcattccgtccctctcccctcctccctttcttactgcacttgtcatggtgtcttatgtaaagtgagtgttcaatatgggagagacttatttgaggatgggaagagaactagagaggaagggggcaggaggaagggctaggcaccaaaaacagcagaacarcaggtaggattggggagctgttgaatcaggagggagagcgagggaagtcgcccatgtagcctctcttttctgaacatcttccccatttccacagcagaatgcgtgaagggacaactcggggctagatctgcatgtcgtccaggtgacactgttcacgctgcaccaaagtctccttctaataagaaattttcagaactgaatcacagcttaccttaccaaaaagtataaatgctcttttcaaataaatcacttgttttatttcaaattcagaaaacagttatttgaattttagtatcactg

SEQ ID NO: 124658 - DNA, 601 bp, Human
atacactctcaacatcattactccttccccagaagagactgttaggatataacctcgagaaaacactcctttccttagaccctcctcagcactgccagcgggggctcagcccaggccatctgtcaggtgcccatctcatccctcagggtttcagtgtcccagaatggagctctgtttcagttctgctgggtggctttagccagaacaagagttcaggttagtttggtaaaaacacatcctgaactggagttcacttgcttgggccttcttatgaatgtcatcattagtattaagaagtcascaaccgtcctcatgaaaactgtcagagagccagatgtaacagaaactgctgggcgtggcattccatggacaggatatgtgggtttcagggagaggtcatgtttgactaaatcgtcagtatcagaagtcctaaaattccattcggtggaaaaagaaatcaatattgaaggtatgggatttctgtttgattgggtcaataatcatttgcagtgattaaccttattatctctataccctgataacctaattatctctatcacctttggaaataatcagcaagatgaaaggagacctgaagaag

SEQ ID NO: 124659 - DNA, 601 bp, Human
attcagcataggtagattagcaggtctaagttttgtttattggtttatttccattgcaacatagataaagtattgtatttactggaatgatgtttgcatgtgggaaatattgctgcagcagtatgccagtcatgagcagccggtaatcctactctcttctctgtcttcagggactgtgagtgagagaggttttattatagcaacatccttgagcctactctgatttttttaaaatgaattcactcaatcagtgaataaatattgagcaattactatattccaagcactgtgattcattccwtgctcagtacgttgaactgttctatttaaccaagtccttttgacattgcagttatcgatgagatgtcacagacattgtagaaaggattcaagtatcaagtggggttgatttatggatgacctttaagtttcttttaaatttgagaatctgtaattgagtttcatgattctggtctcatactgagtagttatcttgcctccaggtacagtttttaaaagtcagacatgaatttggagtagattgctgaagtctgttctcctcaatccctgtatttgtctacccagatagcagggagataca

SEQ ID NO: 124660 - DNA, 601 bp, Human
ggctacctctttaattgctgtgtcattgagcatatttaatacagttttcttgcatgattactatggactgaatattgaaatatcaatgaaatatctgtactttgaggttgatctctgttatattgataatgtactaaacctgtcagggaattcagacaggttaatgagaaatatcatgcattagtttaaggatacatttttttttctaccaaaagtatatcaaattgctaacatttagtatttggacaaataaggaatgtgtgtaattagctgggttaataactggtttggtaggcatatscagagagcactgattaataaattgctctcttcctgaagagaggtttttggtattttaactttatccagtcttagtccacattaggcctcacatgagtaaaactgtataaatgcatgccccaaagttgggagagatagcagatgtaaaaactgatggaaacagaattaggaccatcttgacatttaacacagtgacccaaatctaagaagcagaaatgtcacagggatcagtataaacaccctgctcccccagttaaattgcaaaggaacagtaaggagagatgaagcttagcagcatcat

SEQ ID NO: 124661 - DNA, 601 bp, Human; identical to SEQ ID NO: 94593

SEQ ID NO: 124662 - DNA, 601 bp, Human; identical to SEQ ID NO: 94592

SEQ ID NO: 124663 - DNA, 601 bp, Human
tcacttgtcataactgagtggtagttggctctaatcaactaagagcaatgacccacaaaggtgttctatgcttataaaaaacagattccacaaccccagtgcaaatatgcaactaagtgtaagcagcagtgtgatgcatcctgaaatgaggtgtgtcagaacaacagcagcgtctaaataatgtttcacgtagattaacatggaagagagccctggaagagaaatacaggcatttttaaaaagtgctcccaggcagccaatcagtgaatatgaaatgcaacaaactggttttttttttttkttttttttgagatagagccttgctttgttgcccaggctggagtgcagtgtcacaatcttggctcattgcaacctccgcctgctgggttcaagtgattctcctgcctcagcctcctgagtagctggaatttacaggctcccaccaccatgcccagctaatttttgtatttttagtagagacagggtttcaccatgttggccaggctggtctggaactcctgacttcaagtgatccacctgcctcccaaagtgctgggattacaggtgtgaaaagtgtaatttttctgaacttcattttcaa

SEQ ID NO: 124664 - DNA, 601 bp, Human
atagagccttgctttgttgcccaggctggagtgcagtgtcacaatcttggctcattgcaacctccgcctgctgggttcaagtgattctcctgcctcagcctcctgagtagctggaatttacaggctcccaccaccatgcccagctaatttttgtatttttagtagagacagggtttcaccatgttggccaggctggtctggaactcctgacttcaagtgatccacctgcctcccaaagtgctgggattacaggtgtgaaaagtgtaatttttctgaacttcattttcaacatctagacaaytgagggtaaagcctacttttataatgccctatgaggagtaaaactataaattaaaatgtactaccactagaaagcatatttgcaagcaaatgtgtcacaaggtcctaggcagtgctagctaagaggggccagaagttgtgtctattaaccaattaacagatcattcaagaagtaaaatttcccaaagtaagtgactttcaccttaggtgatttttctttcccaaatctggccctaaactgatcttgatgcttgcccaaccccaaagcccatgcccagcctgagcctcagcaagtatgtag

SEQ ID NO: 124665 - DNA, 601 bp, Human
tgagtagctggaatttacaggctcccaccaccatgcccagctaatttttgtatttttagtagagacagggtttcaccatgttggccaggctggtctggaactcctgacttcaagtgatccacctgcctcccaaagtgctgggattacaggtgtgaaaagtgtaatttttctgaacttcattttcaacatctagacaactgagggtaaagcctacttttataatgccctatgaggagtaaaactataaattaaaatgtactaccactagaaagcatatttgcaagcaaatgtgtcacaaggkcctaggcagtgctagctaagaggggccagaagttgtgtctattaaccaattaacagatcattcaagaagtaaaatttcccaaagtaagtgactttcaccttaggtgatttttctttcccaaatctggccctaaactgatcttgatgcttgcccaaccccaaagcccatgcccagcctgagcctcagcaagtatgtagcagcacaagatgtgctgcagggtgaggaggcaggtgctgggggcagaaaacacaaagaacaaagcatgctttccatgtgctccctaacttgtggatataaata

SEQ ID NO: 124666 - DNA, 601 bp, Human
tttttgtatttttagtagagacagggtttcaccatgttggccaggctggtctggaactcctgacttcaagtgatccacctgcctcccaaagtgctgggattacaggtgtgaaaagtgtaatttttctgaacttcattttcaacatctagacaactgagggtaaagcctacttttataatgccctatgaggagtaaaactataaattaaaatgtactaccactagaaagcatatttgcaagcaaatgtgtcacaaggtcctaggcagtgctagctaagaggggccagaagttgtgtctattraccaattaacagatcattcaagaagtaaaatttcccaaagtaagtgactttcaccttaggtgatttttctttcccaaatctggccctaaactgatcttgatgcttgcccaaccccaaagcccatgcccagcctgagcctcagcaagtatgtagcagcacaagatgtgctgcagggtgaggaggcaggtgctgggggcagaaaacacaaagaacaaagcatgctttccatgtgctccctaacttgtggatataaatatgcattgtctaaatggaatagtttagagtttatgtgatttcctt

SEQ ID NO: 124667 - DNA, 601 bp, Human
ttcccaaatctggccctaaactgatcttgatgcttgcccaaccccaaagcccatgcccagcctgagcctcagcaagtatgtagcagcacaagatgtgctgcagggtgaggaggcaggtgctgggggcagaaaacacaaagaacaaagcatgctttccatgtgctccctaacttgtggatataaatatgcattgtctaaatggaatagtttagagtttatgtgatttcctttaaagacttgtagcctgggccaggcacggtggcgcatgcctgtaatcccagcactttggaaagcggaggcrggcagatcacctgtatccaaaggcaggagcagagccctagttatttttctgttccccctacaatgccttaaagtgtaccagcacttaataaatggtttttgaaaagaccactctccttgtctgaggactacacaggcctgagtgcctaatgatcctcagtgtgcatatgcaagaaaagctaaggagcaaaaaagctgttaaggagtggtttcacccctttcagtagtagggaaatttgctggcggcaatatacaccactagaaatggtgcctgcctttatattgctcatgctaatctgta

SEQ ID NO: 124668 - DNA, 601 bp, Human
aggattatgagccactgacctttttgagaaggaaatgccaagcatacagtgagctgcaagaatactctgaactagtttataggctttggccttgaaaactcaaattattccagttttatttatattactaaaatctagagcttcttggatattctatatgtcaattttttttagtgtagaaacctatgttaaaatgaaaaatgtagactaatgggaaactaaagaatatcagctactgtttatgttgagcactgtgggagccactgacacgtatgaacttaacatctaaacagtataatgwagcggcgctcttaatactctccatttacagttaagggaagaggcatagagagcttacataacttggccaaggttacaaaccttcatcacacagcaaagcccacactagagaacattctgcagggctccagagcctacatacacatcctgcctctcaccgtgaccatttactcaacagcagcaaggccacccaaaatgggcagaaaaggctgaaaacattcatgtcaaagggcacttacttatttattcatcttgtgaaaatgacttagaatttaaaattaagaggtaaaaaaatggagag

SEQ ID NO: 124669 - DNA, 601 bp, Human
atcatttcagtcttgggaatgaaggaagtgaacccagtgtgtgctactgagataaaggaagaaagggagcttagagtcccagtaccagtggtttcctgggtatgggggaaccagccagctggatgcctttggcaaaatgctgagtttgaagctgccctaggaaccagagctgccctgagggaggcgtcacgacccagtgtcagcagccaaccctaaccatccgcaacacatcccccaaccctccactgcagacctgccacatttctccaaggaggtaacagagtaaaggcataccttaggmaggaacagggcagaagagggttggaagcacaggaagcagtttgtcttaagtactaacagcagaaacaataagaatatgatctcaaaagctaaaatactctagaaatgctctcttcttctaacctcagaaagattcaaattgtacttgactttccctagaagactcactcatctccttcctccatgaaatgagactaccagaggaatcctgtattttaaaaaagtttaattttaatccttcctagaggaatacagatttgaatgaaatacattcattccataaatacattagcagcaaaac

SEQ ID NO: 124670 - DNA, 601 bp, Human
tcagtcttgggaatgaaggaagtgaacccagtgtgtgctactgagataaaggaagaaagggagcttagagtcccagtaccagtggtttcctgggtatgggggaaccagccagctggatgcctttggcaaaatgctgagtttgaagctgccctaggaaccagagctgccctgagggaggcgtcacgacccagtgtcagcagccaaccctaaccatccgcaacacatcccccaaccctccactgcagacctgccacatttctccaaggaggtaacagagtaaaggcataccttaggcaggaasagggcagaagagggttggaagcacaggaagcagtttgtcttaagtactaacagcagaaacaataagaatatgatctcaaaagctaaaatactctagaaatgctctcttcttctaacctcagaaagattcaaattgtacttgactttccctagaagactcactcatctccttcctccatgaaatgagactaccagaggaatcctgtattttaaaaaagtttaattttaatccttcctagaggaatacagatttgaatgaaatacattcattccataaatacattagcagcaaaaccttccc

SEQ ID NO: 124671 - DNA, 601 bp, Human; identical to SEQ ID NO: 73298

SEQ ID NO: 124672 - DNA, 601 bp, Human
gggtaccaagcttcgccctctgcgtccccgcgccttcgcggtctcccgccagtgcaggtccggggcccccaggcgagcggacaaggttggcctaatctgccaaacttctggggcatttaccgtgctctggccgccctcccgattcttccctccgcgcccttgcctgcttctcgcctaccccgggctccggaagggaaggaggcgtgtccggagcaggcgggcgggaactgtataaaagcgccggcggctcagcagccgggcttcgctcgccgcctcgcgccgagactagaagcgctgcggkaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaagtgagtagggcgcgcccgggagctcccaggctctccaggaaaaatcgcgcccggtgccccggggaagccggcgctccctgggacttgcagctggggcgtgcagggctgtgcctgccgggtgagacaagaggatg

SEQ ID NO: 124673 - DNA, 601 bp, Human
ctttcaccccccagaggttctgttggagattgcagttcctgaaatgtgtggaaggggtggaagtggtggggaaaaaggaaaccggggtgtttgtacacatcgttggtgtagaatgaaggcatcaatgtgctcaaaatgctttatcaaatgacctgcttagcatcatattttaaacagatatctaggcctgcaaaaagttgcaagactctagccccttgtaccggtgtggtaaaaggcaggggaaagggacattgcctggctaaaagaggcttgcatagtctctagagcactctctaagagaaaagacgcgatgtgcctctcccctctcttacaagcaggttagctttcaggcaaggcattgagcaccgcacctggaatcaccacagcgtgctgtcgaaatgcaaatgttaaagattcttgcaacaaaagaaaagttttattgtaatctcttgatttagacaagctttctgcgaaattataagaagggtagagacctattccttcttatagtagcatctgctcccatggatggtggtgagatctgggggaagaagctgctaccttctagttcaggaaaagagcctaaaccttcctatttaaa

SEQ ID NO: 124674 - DNA, 601 bp, Human
atggaaaccccttgcctgactcatctgactgttgtgagggaatctcattgtaaactctaaagatgtcgtcttactttatggaatcaggaattacttcattgccaaaaagctttctgtctttcaaataaagtggtactttgttggcagagggcagattttaaaatattttaaagttatgtttcaaaataacttcttggaaatagaaagatacttcagaaagtacttttatcaatttgctctgatcctctttacatgatgttttggaagatggttttaaatgtctgtgatcatattaggaaaytatttgataataatgtcgtttatgtctggcttttaaagctaccagccatttatattgtggcctttgttttgttcatttcttatcaatccaactgcattaatattaaaaaaaatattttctgcattaatatcgcaagattttaaatgggtgattgtcagcacaaccttatcagcagcatcaccttgtaacatactcaatagcagtttagtacaaatgaaaatgttggctaaaaagtcctggcatcatctcaacacaggtaaaggagacaacagaacagagatgtgcttaaccaaactctgc

SEQ ID NO: 124675 - DNA, 601 bp, Human
gggtttggagttagacagaatgagagttaaatcttagctccactattatgattacaacatgatatttatttccttcctctaggccccaatatcctcattggtgtaatggggttgtaggggtaatagtacatagttggaagaacacaagaattaaatgagattatagtctgggcatggtggtttatgtctgcaatccaaacactttggaagacagaggcaggaggattgcttgagcccaggagtttgagaacagcctgggcaacatagtgagaccttgtctctacaaaaatattataaataaaataaataaataaataaataaataaatgagataatatgtggaaattgtctgacccagaagtgatgctcaataaattgtatctgtaagctttagggaatggattatgccagcagacacatcagtatgtattagactgtctgctctgtgtctgtaaggatgttgacacatgttggcgacctcacaagttgtgaaagtcaagagagtaattaactgagcagtgctctacatactatactgtccattcagaggcctagtgttgttgtattgttctcagacttgagcaataaaaaatataaattt

SEQ ID NO: 124676 - DNA, 601 bp, Human
atttgcaaagaaaagctccaaaaaggaccataaagaagaggagataacacacaaatagtgagcaatgaagtagatgtacaaaatggtttgtgcagatttggcacttaaaacatacagcagccgaagtacatcttaaatttcatttagtgaatatattgctcacgagtccctctcttcatttcctgaggaagtagatccctattctctcccatatggtgagaaaatctctttgctatccaaacagtttccctgtttacatttgttcttccatccccttctgattcctcagcaaagcagctgytttgaaaagaagctcaaaggattaccttgaaatggttacccactctcccccttttctgctccaagaagaaagtttctttctgtattttcccagcattattaagagtcaagacttgaggccttaaggtacatttcctatattcttcttttgttttaaacttgaaagcaaaataatcttcccaagtctaccatgaggatgaatttcagaatgcacaataacttacatttaccgagaaaactgttaagtcagaatcttctaaaatagagataacaataacaagtgtgatgccagtactcctat

SEQ ID NO: 124677 - DNA, 601 bp, Human
caagaagaaagtttctttctgtattttcccagcattattaagagtcaagacttgaggccttaaggtacatttcctatattcttcttttgttttaaacttgaaagcaaaataatcttcccaagtctaccatgaggatgaatttcagaatgcacaataacttacatttaccgagaaaactgttaagtcagaatcttctaaaatagagataacaataacaagtgtgatgccagtactcctatcctgatacattgtaaaaaatcatctccttccttactgtgtcctacatccttttttcttttcttttttttttgagatggagttttgctcttgttgcccctgctggagtgcaatggtgcaatcttggcttactgtaacctctgcctcccgggttcaagcaattctcctgcctcagcctccctagtagctgggattacaggtgcccaccaccatgcccagctaattttttgtatttttagtagaggtggggtttccccatgttggccaggctggtctcgaactcctgaccttaggtgatccgcccaccttggtctcccaaattgctgggattacaggcgtgagccactgcgcccggccacatctt

SEQ ID NO: 124678 - DNA, 601 bp, Human
tcttcaagtttgggcatgatgttactaggaatgcttgttctagacagcaatgacaatagccatagcaaacatttataaaggtgtattatttgacaggtactatactaaatgcccacttacataactatatttaatcctcagcaaacctataaagtcagttctgttattacacccatttacagatgaggaaactgaggcccagaatgataaaataactttccaacggccataaggattgtgtcaaagtagaaattaagatatgggcagtctgattctaaggttgatgttttccaaccccctyctctataccacttctctgtgcatgagtaaacacactgttttctttctttctttcctttttttttttttttttttttttttgagacagagtctcgctttgttacccaggcttgagtgcagtggtgcgatctcggctcaccgcaacctccgcctcccaggttcaagcgattctcctgcctcagccccccaggtagctgggactacaggcgcatgccaccatgcccggctaatttttttatttttagtagagacggggtttcactgtgttggccaggctggtctcgaactcctgaccttgtga

SEQ ID NO: 124679 - DNA, 601 bp, Human
gcaatgacaatagccatagcaaacatttataaaggtgtattatttgacaggtactatactaaatgcccacttacataactatatttaatcctcagcaaacctataaagtcagttctgttattacacccatttacagatgaggaaactgaggcccagaatgataaaataactttccaacggccataaggattgtgtcaaagtagaaattaagatatgggcagtctgattctaaggttgatgttttccaaccccctcctctataccacttctctgtgcatgagtaaacacactgttttctttytttctttcctttttttttttttttttttttttttgagacagagtctcgctttgttacccaggcttgagtgcagtggtgcgatctcggctcaccgcaacctccgcctcccaggttcaagcgattctcctgcctcagccccccaggtagctgggactacaggcgcatgccaccatgcccggctaatttttttatttttagtagagacggggtttcactgtgttggccaggctggtctcgaactcctgaccttgtgatccgcccgcctcagcctcccaaagtgctgggattacaggcgtgagc

SEQ ID NO: 124680 - DNA, 601 bp, Human
gaacagggggtgtttggttacatgagtaagttctttagtggtgatttgtgagattttggtgcacccatcacccaagtagtatacactgtacccaatttgtcatcttttatccctcacccccctcaagttactctaaatcaagagcacctagtatgtagcccttcaatcaaatacaacgttgtatatcttttaagacatttttgttttgtttgttttctttaacaatataacactcatgaactatctaaaatattatatctcagactttatagagtacctaataatcacatagagggcttaytaaaagatgtgctttcctgagatgcaccctcagaaatttggattccctctgacatgcaggaatctgtattttaattaaacaccccagatgattacactttcatctaaacataacacagctgactcccttggtttcagttggaacaccttcagtgaaagaaggaacattttaacagtttattccatcccactaaaaaggcagttggtatgtctcacacacattgcataattcgcaaagccagtttgtgacctttgccaatcaagcttgtcatctgatgtgacagagaaaacgatcaagatt

SEQ ID NO: 124681 - DNA, 601 bp, Human
ttgtcaccctaaagtctatttttattatagcaatcagactgatcttatttaattaatttatttttattctgaagtatatatccctcctctgctcaaaatcttgcaatgaatcctattttattcaagtaagagtcaatgtctgggcaataggcttcaacgccctacatgagctgtcctctccattgtctctctgacatcatcatcttctactgctccctaatttactcttgctatgtcttaaataacagatgccttaaatagaccttaggaccttggcaccagcttttctctctgtatgcartactcttcccacagatgtctgcgtggatcactgccttagctttgtccaatctttggtgaaattttgtcttcttaatgagacacttatcaatattaccctgttaaaaatttcaagctgtttccacccatactgcaatctctggaaagaaaagagtacagttagttctatggctcttctcgagactcagagatgcctggtgatttgaccctccctataagtcttctttcaacaaggactcaagaaacttttaggtgtacatctatacttcctccaagggaattcagctgaagttactaggta

SEQ ID NO: 124682 - DNA, 601 bp, Human
ctcttttgttatctaactttttttttttggtgatgtagtctagcttttgtcgccaggctagagtgcagtggcgcaatcttggctcactgcaacctccgcctcatgggttcaaacgattctcctgcctcagcctcccgagtacctgggattacaggcatgcactgccacacccagctaatttttgtatttttagtagagatggggattcaccatgttggccaggctggtctcgatctcctgacctcgtgatccgcccacctcggcctcctaaagtgctgggattacaggcatgagccaccaygcccggccaacctaacctttcttaaaactcagcagtacacttggtgctgggcaaagccttggtgctgggcaaagcagtacacatggtgactcatgactgtgattgtcactctgaacccaagatcaccagtaaggcagagtagacattatgatcccaatcccctttaccttgctctaatcttatttttcccatagcttttgacaccttttgacatactgtataacctagttacttatgtttgttgattaagccttatgagggcaggaattttgttcattatataggcctagcacctaggac

SEQ ID NO: 124683 - DNA, 601 bp, Human
actttttatatgcaagacactgtgttatgtgttgtgaagatactacaaagataaatcagttgcacaagttcttgaaactctacagtgtaataaggaaaaataagtcatgcataaaagcaactataatacataatagaaaatgttattttcaagccgatgtgtaggttatgtgtgttcgagagagagagagagaagacagattactttctgctagggttcaagaatgccttcctgttggctaaggaaatattttccttaagtggctaaaaagctgtgtttcaaaatattcttttgatgtctyacaaattcagtggaattctcttaggtctaaaaatatacatctctctcactttaacttggtgtgctattgtagattattggattaaagcactgctcagggattatgctgcttcttgccaagcagtctacatttaaagtagaaataagatgtttcttttggtgccataaggtatacattttatgcattctctagtttttagaagataccctaagggctaagtctttaacatgctgctacaagtttattcctaattgccattgggaaattggctgaagaaagtttttaacaaaagttaacaat

SEQ ID NO: 124684 - DNA, 601 bp, Human
gcagccataaaaaaagatgagttcatgtcctttgaagggacatggatgaagctggaaacaattattctcagcaaaatatcacaagaacagaaaaccaaacaccgcatgttctcactcataagtgggagttgaacaatgagaacacaaggacacagggaggggaacattacacactggggcctgttggggggtgggggcctggaagagggatagcgtttggagaaatacctaatgtaaatgacgagctgatgggtgcagcaaagcaacatgatacatgtatacctatgtaacaaacctgcasgttgtgcacatgtaccctagaacttaaagtataataataataataaaaattacaggtgcctgggactacaccaagaaactactttggtaagtctgaaaaagggatccaaacatctatatttttaacaaaattctgaaaggaggcttaagagcaattgctctagatggtctcttctgtcattgtttagaaaccaaaatgtcttgactcttatttaatctcaattcctattatgactagttatcatctgtgttgtatagacttataaggatgccagattaatacaaatcttcaaaatatgtt

SEQ ID NO: 124685 - DNA, 601 bp, Human
tattccataatgatgtttttttcaggttgcacctcttggaataattcaataataactcgactgaaggaggttatataggatgagaggaatttgctttgcagacataaccttgctacattttatgtgagggaaagaaagtggcctgacagtccatttttgcctgtgctcacagttattccttcaatggaaatcattcctttgcagcccctaccagtttcatctttgcattaggtggcaacctgcactgtgcccacacacttgaagtttttttgcttgaagtgattctcatgtcacagaagcmcatgatttatgactttaatgtcaaattttttttttaatttcttcttgaacactttgtactgcccccacggtccccgtggtttttattcgaaatgcttctggcctgtttactaagcataatagttcatctatttacagaacattttgctttgtttctaaaaaaatgttgcaacatttgttttaaatggcaaactcagacttacctaaagaaagggtcaagtatctgggaagaggatgaatcaagcttttataacttgtatctatgggatagttaggttgcagattttagtagttgtaattg

SEQ ID NO: 124686 - DNA, 601 bp, Human
tgccttcccagtagtttaagatgtaagtttcaactacaattaatgaattatcattgtaacctactgaattttatttcctgaatagtagtcaccttatcttactgtgattaggaagctatcatattgtagaagctcagttagttacttaattggaatcatcatcataaggtgtgtcatcatcataaggtatgtcatcatcatgaggtattatacactccctaaatattgtagtttataatctcttctatttgaaagaaaaaattgttatctatctttatttagatattctttactgaggaamgatgaccttgaaaagcctcctgaagttgtcatcttaatttttttttgagacagggtgtctatcacccagtctggggtacagtggtgcaatcatggctcactggagcctcaaactcctgggctcaagtgatcctcctgcctcagcctctctagtagctgggactccagagtagttgccaccatacctgactaattttttaaatttttttcttgagatggactctcactttgttgccaagtctggtctcaaactcctggctttaagcaatcctctcaccttggcttcttaaagcagtaggat

SEQ ID NO: 124687 - DNA, 601 bp, Human
tcactgatggacatttgggttggttccaagtctttgctattgtgaatagtgccgcaataaacatacgtgtgaatgtgtctttatagtagaatgatttataatcctttgtgtatatacccagtaatgggatcgctgggtcaaatggtatttctggttctagatccttgaggaatcgctacactatcttccacaatggttgaactaatttacactcccaccaacatgacagccattctaacccctatgagatggtgtcttattgtggttttgatttgcatttctctgttgattagtgaggttragcaatttttcatatgtttcttggccccttgcatatcttcttttgagaaatgtctgtgtcttttgcttacttgttgtttatggggttattttttgcttgttgaattgtttaagttccttatagattctggatattagatctttgttggatgcatagtttacaaatattttcccccattctgtaggttgtctatttactctgttagtagtttcttttgctgtgtagtagctctttagtttaattagctcccaattgtcattttttgtttctgttggaattgcttttgaggacttagtcata

SEQ ID NO: 124688 - DNA, 601 bp, Human
tgcatatcttcttttgagaaatgtctgtgtcttttgcttacttgttgtttatggggttattttttgcttgttgaattgtttaagttccttatagattctggatattagatctttgttggatgcatagtttacaaatattttcccccattctgtaggttgtctatttactctgttagtagtttcttttgctgtgtagtagctctttagtttaattagctcccaattgtcattttttgtttctgttggaattgcttttgaggacttagtcataaattattccccaaggccaatgtccagaatkgtgtttactaagttttcttccagcatttttacagtgtggggccttacattttaatctttaattccttttgagttaatttttgtatgtgttgaatagtaggggtctagttccattcttctgcatatagctagccagttatcccagcaccatttattgaatagggagtcctttccctattgtgtatgtttgttgactctgtcaaagatgacatggcttgtatgcatgtagctttattttagatttcagattagagatgttcaatctgtataaatgcttagaaagtaatattaacacaataat

SEQ ID NO: 124689 - DNA, 601 bp, Human
gtatgtttgttgactctgtcaaagatgacatggcttgtatgcatgtagctttattttagatttcagattagagatgttcaatctgtataaatgcttagaaagtaatattaacacaataatttattaagcgaccacaaatatctacaacttgactttctaagttctcttccaaatgtaattagaaggaaaccaatgaaaaccaaggacgtaataatgggatactgcgctataggtagatgtgctgagccccagcacacaaagccagggtttgcatcctacctgcaccagttactcctaatgygtgtaccttggggataccggttaacctctctgagtttccatgacctcatttgtaaaataagcttaatataatctctcatggggttgtggtagagactgtatatgaaaacttgttttaaattataaagcacgtttcaaaaacagtattatttttcagtctcaccagaaattgaatatcagtaaatcagcttaacgaataaattactttattattatacactgccctaccaccagtggtagaatgtagatttcagtgtttttatcagggaacttcctataagccttctttgaaccaatattt

SEQ ID NO: 124690 - DNA, 601 bp, Human
ttattattatacactgccctaccaccagtggtagaatgtagatttcagtgtttttatcagggaacttcctataagccttctttgaaccaatatttgtatataaattattcatgaaatggaattggtcaccatactctttacattttctttgctttttagacatatactcagatcccacactttctaaatactaatctagttgattgtatttttgtatttttaaaataatataaattatgcttaagaaagggctggattgttaagcagcttgtgttcagaatacctgccacttcttgctgcrtttttctatctggaatgcctttaatttacctggtttattcaaaatgagatagaatattgctgcttacttatcgctttcacatctgcaacaggtctgctctgtctttgtcactagggtttacataaaatgactagacgctttttcctttcaaagatgaggatgaagattaagaagagaaaagaaattatggaagcttggtggaaagtttgagaggaagaaagttaagtgtaaagaataagggagttaacgccaaaaataaatgaacaaaaatgccgtcatgtctggcagctcaggtgtgtt

SEQ ID NO: 124691 - DNA, 601 bp, Human
gctcccatgtgactacttatgcccatgcctaaattcatttatcaataaattgttctcagattctagaagctattgacaagaccaagcagaatcatacagaaaatgttatggtaaacttgtgcgagatgacctagtctagcaaacatgcacatgatcttagctttctataaggaagataaagtttttagagacaaggtgaaggaaaaaataagtctacaaagcaagatagacccttgaagatgtaatggtgcaaaactactttttaatatatgttatcttaatacccaatggtctaagtcarttgttggctaaattattcatctgggaattttaatggtgacataagagaaggttgcggacagcaaagttggtacagtgtgtaggaaggaagagaacctagaactctgtaacttactagggttatatgcctccaaagtcagttgccggtatagctctcagtaaagaacatggattgagtgtttataatgtgtttggcacattcatctgtcttaattctaaatgaccatttgacataggtatcttgatcttcattgtataaatgagaggaaccaacatacagagtttagatttgtcccagatt

SEQ ID NO: 124692 - DNA, 601 bp, Human
tgtttaattagtgttggattttcaacagcacccttttgcattattttgtggttattttggaaattaaagtatacactttaacttgtaatattctacttagagttactattgtagcacttgagaaaaaaatgcaagaaccttgaaacagggtagttttatttacccatacccatcttttgtgtcatcattgacatatattaacatatctacatcagttataaatttcacaatacagtctacaatacacaatgcagttcaattatttctttgaactgtcatacgtattttaaagtaagagaakaagaaatatattgtcttttatattaacctgcatatttattatttcctgtacccttcattccctcttgtcagtccaggtttccatttggtattaatttccttcaggctgaaaaacattctatagcatctcttataatacagatctgctggcaacaaattcttttttctttttaattggaaaatatctttgttttgtcttccatgtagcaggtactttttactagatattgaagtctgggtacacaggattttttttcttttagtcttttaaaaatatcactatagtattcctgcagttatt

SEQ ID NO: 124693 - DNA, 601 bp, Human
acacacacgtgagcacacatccatacatcccatcattagagtctccttggaaacataccatttataggatgagggaatttcctgctctcagttcacatatggtagaggaatgggctgttcctgtcctcaccatagtagataaaatctatttctgacttatcaagttaaatctatgaattaatttttccctgtaagatgttgatacacacatagtagatctattattttatattatgtactctaggtactttgtatgttaaataggtataggtatatagaaaaatctgtcaaaataagtttyatgttggaagagacccttgtgggagatgtgttttgtttatttaattcgtgaatcattctgctccttttttttttttaaagacagagtcttgctctgttgcccaggctggagtgcagtgacatgatctcggctcattacgacttccgcctcccgggttcatgcgattctcctgcctcagcctccgtagtagccgggattacaggcatgcgccaccacacccagctaatttttgtatttttagtagagacggggttttaccgtgttggctgggctggtcttgaactctggatctcaggtgat

SEQ ID NO: 124694 - DNA, 601 bp, Human; identical to SEQ ID NO: 124672

SEQ ID NO: 124695 - DNA, 601 bp, Human; identical to SEQ ID NO: 124673

SEQ ID NO: 124696 - DNA, 601 bp, Human; identical to SEQ ID NO: 124674

SEQ ID NO: 124697 - DNA, 601 bp, Human; identical to SEQ ID NO: 124675

SEQ ID NO: 124698 - DNA, 601 bp, Human; identical to SEQ ID NO: 124676

SEQ ID NO: 124699 - DNA, 601 bp, Human; identical to SEQ ID NO: 124677

SEQ ID NO: 124700 - DNA, 601 bp, Human; identical to SEQ ID NO: 124678

SEQ ID NO: 124701 - DNA, 601 bp, Human; identical to SEQ ID NO: 124679

SEQ ID NO: 124702 - DNA, 601 bp, Human; identical to SEQ ID NO: 124680

SEQ ID NO: 124703 - DNA, 601 bp, Human; identical to SEQ ID NO: 124681

SEQ ID NO: 124704 - DNA, 601 bp, Human; identical to SEQ ID NO: 124682

SEQ ID NO: 124705 - DNA, 601 bp, Human; identical to SEQ ID NO: 124683

SEQ ID NO: 124706 - DNA, 601 bp, Human; identical to SEQ ID NO: 124684

SEQ ID NO: 124707 - DNA, 601 bp, Human; identical to SEQ ID NO: 124685

SEQ ID NO: 124708 - DNA, 601 bp, Human; identical to SEQ ID NO: 124686

SEQ ID NO: 124709 - DNA, 601 bp, Human; identical to SEQ ID NO: 124687

SEQ ID NO: 124710 - DNA, 601 bp, Human; identical to SEQ ID NO: 124688

SEQ ID NO: 124711 - DNA, 601 bp, Human; identical to SEQ ID NO: 124689

SEQ ID NO: 124712 - DNA, 601 bp, Human; identical to SEQ ID NO: 124690

SEQ ID NO: 124713 - DNA, 601 bp, Human; identical to SEQ ID NO: 124691

SEQ ID NO: 124714 - DNA, 601 bp, Human; identical to SEQ ID NO: 124692

SEQ ID NO: 124715 - DNA, 601 bp, Human; identical to SEQ ID NO: 124693

SEQ ID NO: 124716 - DNA, 601 bp, Human; identical to SEQ ID NO: 124672

SEQ ID NO: 124717 - DNA, 601 bp, Human; identical to SEQ ID NO: 124673

SEQ ID NO: 124718 - DNA, 601 bp, Human; identical to SEQ ID NO: 124674

SEQ ID NO: 124719 - DNA, 601 bp, Human; identical to SEQ ID NO: 124675

SEQ ID NO: 124720 - DNA, 601 bp, Human; identical to SEQ ID NO: 124676

SEQ ID NO: 124721 - DNA, 601 bp, Human; identical to SEQ ID NO: 124677

SEQ ID NO: 124722 - DNA, 601 bp, Human; identical to SEQ ID NO: 124678

SEQ ID NO: 124723 - DNA, 601 bp, Human; identical to SEQ ID NO: 124679

SEQ ID NO: 124724 - DNA, 601 bp, Human; identical to SEQ ID NO: 124680

SEQ ID NO: 124725 - DNA, 601 bp, Human; identical to SEQ ID NO: 124681

SEQ ID NO: 124726 - DNA, 601 bp, Human; identical to SEQ ID NO: 124682

SEQ ID NO: 124727 - DNA, 601 bp, Human; identical to SEQ ID NO: 124683

SEQ ID NO: 124728 - DNA, 601 bp, Human; identical to SEQ ID NO: 124684

SEQ ID NO: 124729 - DNA, 601 bp, Human; identical to SEQ ID NO: 124685

SEQ ID NO: 124730 - DNA, 601 bp, Human; identical to SEQ ID NO: 124686

SEQ ID NO: 124731 - DNA, 601 bp, Human; identical to SEQ ID NO: 124687

SEQ ID NO: 124732 - DNA, 601 bp, Human; identical to SEQ ID NO: 124688

SEQ ID NO: 124733 - DNA, 601 bp, Human; identical to SEQ ID NO: 124689

SEQ ID NO: 124734 - DNA, 601 bp, Human; identical to SEQ ID NO: 124690

SEQ ID NO: 124735 - DNA, 601 bp, Human; identical to SEQ ID NO: 124691

SEQ ID NO: 124736 - DNA, 601 bp, Human; identical to SEQ ID NO: 124692

SEQ ID NO: 124737 - DNA, 601 bp, Human; identical to SEQ ID NO: 124693

SEQ ID NO: 124738 - DNA, 601 bp, Human; identical to SEQ ID NO: 124672

SEQ ID NO: 124739 - DNA, 601 bp, Human; identical to SEQ ID NO: 124673

SEQ ID NO: 124740 - DNA, 601 bp, Human; identical to SEQ ID NO: 124674

SEQ ID NO: 124741 - DNA, 601 bp, Human; identical to SEQ ID NO: 124675

SEQ ID NO: 124742 - DNA, 601 bp, Human; identical to SEQ ID NO: 124676

SEQ ID NO: 124743 - DNA, 601 bp, Human; identical to SEQ ID NO: 124677

SEQ ID NO: 124744 - DNA, 601 bp, Human; identical to SEQ ID NO: 124678

SEQ ID NO: 124745 - DNA, 601 bp, Human; identical to SEQ ID NO: 124679

SEQ ID NO: 124746 - DNA, 601 bp, Human; identical to SEQ ID NO: 124680

SEQ ID NO: 124747 - DNA, 601 bp, Human; identical to SEQ ID NO: 124681

SEQ ID NO: 124748 - DNA, 601 bp, Human; identical to SEQ ID NO: 124682

SEQ ID NO: 124749 - DNA, 601 bp, Human; identical to SEQ ID NO: 124683

SEQ ID NO: 124750 - DNA, 601 bp, Human; identical to SEQ ID NO: 124684

SEQ ID NO: 124751 - DNA, 601 bp, Human; identical to SEQ ID NO: 124685

SEQ ID NO: 124752 - DNA, 601 bp, Human; identical to SEQ ID NO: 124686

SEQ ID NO: 124753 - DNA, 601 bp, Human; identical to SEQ ID NO: 124687

SEQ ID NO: 124754 - DNA, 601 bp, Human; identical to SEQ ID NO: 124688

SEQ ID NO: 124755 - DNA, 601 bp, Human; identical to SEQ ID NO: 124689

SEQ ID NO: 124756 - DNA, 601 bp, Human; identical to SEQ ID NO: 124690

SEQ ID NO: 124757 - DNA, 601 bp, Human; identical to SEQ ID NO: 124691

SEQ ID NO: 124758 - DNA, 601 bp, Human; identical to SEQ ID NO: 124692

SEQ ID NO: 124759 - DNA, 601 bp, Human; identical to SEQ ID NO: 124693

SEQ ID NO: 124760 - DNA, 601 bp, Human
catgcctaatggctagaattaaatgctgggaatataacgagctcagcacaggttatccgcgtgtcagatgttcctgctgtcttctacagtggggacatttcctagcctattcccaggctcctttagaagggaagtggaggtgccccatcttcacctgccgcgtcccctccagcgtctgcccgggccctgggcctgcgctccctcgcggtggcgccaggtggcggggctgcgcgccctggaggagctgcaccgccgtcgcggggctctctcagcactgaggacaccacgccctgcaaattgytgggaacttgtcggtggcaatcacactgctggctcctgcaaactggtgtgaggccctcaggggtgagaacaggattgcagaactgcgctcacccttttggaaagtcgtccagtggcagaagtagcctcccaggagcagagcgaagctgctcggtggtcccctctccaaccagggacccaagaagccgctcaagggaacacggccccgcggcgtccgggaggtcctgcaggagccctgcggctgcccgggttctgtgaaatggcagtgagggtgggggagatgtgcgctaaatcctgggaa

SEQ ID NO: 124761 - DNA, 601 bp, Human
agggcgtttaggaagttgctcaaggaagactgtctgaggaaactgcgtactgggctgaagaaagacaaccggaaaacactgaaggagcgctcagccactgcaccttcaaaaaggcagaaaagtcagttcagggaggtgcctcccagctaccccacccgcctcaggaggggtcattccaacctagggtgctgagaatccgggtgggattaccagcaaaagctagagaaccatgggtcagcgacccttaggaagaagtggaaaggagtcttaacttacctgcaataaccttcctatgcgaagytgtggctaacgcatgcctaatggctagaattaaatgctgggaatataacgagctcagcacaggttatccgcgtgtcagatgttcctgctgtcttctacagtggggacatttcctagcctattcccaggctcctttagaagggaagtggaggtgccccatcttcacctgccgcgtcccctccagcgtctgcccgggccctgggcctgcgctccctcgcggtggcgccaggtggcggggctgcgcgccctggaggagctgcaccgccgtcgcggggctctctcagcactgaggacaccacgc

SEQ ID NO: 124762 - DNA, 601 bp, Human
agaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcrctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtg

SEQ ID NO: 124763 - DNA, 601 bp, Human
acttctactcaagcctagacattactacctcctagctgtgtgatcttagcacgttacttaagctttatgggcttcaatttcctcatctataacacaggaataaaaacggtatcgacctgcagaaggctgttgaaagaatttaatacatacagaattcttggcttggcacataataagtactcaatgcctgatacataataagtgctcaatgcctggtacataataagtgctcaaaaaattatttatatcagagacaaaataaatatactgccagactcaggactctaggaacagaggaagrcaggggtaagctaaggttataaatatagagggattaagttaaagcctgcacacaaaaggactctgtgtgtctcttctaccgggtctagaatacctgtagtcaggcaatcagtgagtccttctagagaatgtcaactctaaagaggcctaaaggtgttaaaatgcaaaggtgcacaataaaaaagccaatagctggatgatgatgatgataggagggtaaaagggtggatgatgggagggtaaagggtaagttaaaattcaaatacactgtaacaggaaacccaatttctgaaattaacaa

SEQ ID NO: 124764 - DNA, 601 bp, Human
gagacagtattaggagggaaaagcaaaatacagaatatagcacaattacaaactatgctttaaaaaatcatatctagaaactgggcagacatggtggctcacacctgtaatcccagcactttgggaggctgaggcaggaggatcgattgaagccaggagttcaagacaagcctgagcaacacagcaagaccctgtctctataaaaaattttttaaaattagccaggcatggtggcgcacatctgtagacctagctacgcgggaggatcacttgagcctgggatttcaaggttgcagtgaaytgtgatcgtgcctgtgactagccactgcactccagcctgggccacagagcaagaccctgtctcagcaacaacaacaaaaatctatacgtacaaagtagtagtatctggttaggaggactacagaaaatactagttatttctattttgttttattttccatgattttctagaataagtatatattagtatataataaaaacacacatatttttaataggtaagagttctttttttttttaagagacaaggtttattgtcacccaggcactggagtgcagtggcacaatcatggctcattac

SEQ ID NO: 124765 - DNA, 601 bp, Human
tggtggcgcacatctgtagacctagctacgcgggaggatcacttgagcctgggatttcaaggttgcagtgaactgtgatcgtgcctgtgactagccactgcactccagcctgggccacagagcaagaccctgtctcagcaacaacaacaaaaatctatacgtacaaagtagtagtatctggttaggaggactacagaaaatactagttatttctattttgttttattttccatgattttctagaataagtatatattagtatataataaaaacacacatatttttaataggtaagagttctttttttttttaagagacaaggtttattgtcacccaggcactggagtgcagtggcacaatcatggctcattacagcctagaactcctgtgttcaagtgattctcccacttcagcttcctaagtagccaggactacagatgtgcaccatacacccagctaatttttttactttttgtagagatgaggtctcactatgttggtctcctgggctcaaggaatcctctcatctcagcctcccaaagcgctgggattataggcatgagccaacgcatctcgccaggagttctaaaattatattgtg

SEQ ID NO: 124766 - DNA, 601 bp, Human
tctcccacttcagcttcctaagtagccaggactacagatgtgcaccatacacccagctaatttttttactttttgtagagatgaggtctcactatgttggtctcctgggctcaaggaatcctctcatctcagcctcccaaagcgctgggattataggcatgagccaacgcatctcgccaggagttctaaaattatattgtgatgatggttgcacaactctgaatatataaaaacttgtgaattgtacactcgaaattttatattatgtgaaacacatacacacacacataaaaatgtgtatttttttttttttttttgaaacagagtctcactctgttgcccaggctagagtgcagtggcacaatctcagctcactgcaacctctgccttccaggttcaagcgattctcctgcctcagcctcccaagtagctgggattacaggcacccgccaacatgcctggcgaatttttgtatttttagtagagacggggtttcaccatgttggccaggccagtctcaaactcctgacctcaagtgacctacccgcctcagcctcccaaagtgctgggattacaggcgtgaaccaccgcgcctggccct

SEQ ID NO: 124767 - DNA, 601 bp, Human
actgcacaaaactggactcgatgacttccaagcttctgtcctaaccgagactttttattctaaatgaaaagtcaatatcacaattatactacaattacaatctgaaaatatttcatttcagtattgagatattctcagcgcctgatacagatccataatacaatgaatttctcccaagaaaggtgcttcaaggacagcatggactcaggatctacataaaccatgataaactgtattactaatggctgaatatttaaaaatctaagtattaaaatatctacaatgagatttgcaaatatayagtcatcattcattctcctcatatttaaatattaattaaaaaatgtcttaccataaagaacacactggatggatgtgtgcactaattattttagcaatgcctcttgtcaagaaatcccagatgacaattcggccatcattacagccaactgcaagcagtgtgccccacctgttaaaggtgcaagtcaaagccatgctgatacaatccaaagttccatcagcttcctaaaaattgaaacaaatacaagaatagaggcaacaatagccaggtatccaaattatttcctaaaggttctttatc

SEQ ID NO: 124768 - DNA, 601 bp, Human; identical to SEQ ID NO: 31780

SEQ ID NO: 124769 - DNA, 601 bp, Human
tgttttctactgggaggtaagctgaagtctgtgaattttgcatcatactttcgtggataataagaatttttaactgaagggttgaaggacttctgatgccgaggaaacctatcagaagactgtctccaataccacgatgtggaagcatggaaattccaaggctggccgctgggttgaggctgagaatcaaggggggactgtgcgtggaaggggggttgcgccccgggaagaagctgggcgtcaaagaggggcggagccctggggagagactgggcctctatggggggctgcgagaggaagsctttgacccggctgcgggaagcgaggacgtaagcggtggtggcggtggcggcagaattgcccagaacatccagctgtcccgcggcggggcagtgtcggtcaggggccctaacgtgggagtcagcccgggagatgcaggccacccgataggagtcgcgaaatcactagtcggctcagccataccaccggccgggtccggagtctagcacgcaactgtctagtcttaatattttagaaaggataacttatcaaaatgaaatctggataatttataagctcaaataaatatattcaagaggtt

SEQ ID NO: 124770 - DNA, 601 bp, Human; identical to SEQ ID NO: 18719

SEQ ID NO: 124771 - DNA, 601 bp, Human; identical to SEQ ID NO: 18720

SEQ ID NO: 124772 - DNA, 601 bp, Human; identical to SEQ ID NO: 18721

SEQ ID NO: 124773 - DNA, 601 bp, Human; identical to SEQ ID NO: 18722

SEQ ID NO: 124774 - DNA, 601 bp, Human
tcctgacccctagtgtctttccttactacctcttcatattttccccggacagtgccctaccacagtatgagaggctgttccgtaagaatgggattgagaaaagatccaggctactctgacgtcttgtggagttgggagttgaacttgagagtgaacttgagaagtgaaagcgggaaaagaatcagctttcgctcgtgcagggctactaagcaccctatgttgggagaggggccatttttgacctgggctttacggtgggcccactgcatttccctcatccacacgcgcgcgctttccattaccaggtggtcctagttagcgcctgggctccacagtttgcagctgacaactgtcctgaatcagggcgctttgagcgacggaaaggtgatctgggattcagtggtctccctcggggccaatccggcaaacctattcccaccccctactcctcccccgcctagggcatttaagagactatccccagggaagctacggggaaagaaaggggttaagagtccctgatctttgacgtccttgtcctgccccacggctgaactgagtcccggacacagcgcagttgcttactctagcctggggcgga

SEQ ID NO: 124775 - DNA, 601 bp, Human
ctctttgggttaatttgttcatcataaatgaggtccattaaattactgttagttgtactcctcagttgccttatatagttggtgttatgtgaaattgagtttatagtagaactattccaaaaagaacataacctgatgtagcacaaataatagtattgctctcaaaacttttagtagtaaaattgttctcaagtgacaattgaaaacaaaatcctttaaggcaatttttaaaattacaaaaagaaagtatattgaaggtgagacgagtatcagtgtaaggaagagggtacagcttgttttaaaaaaaaaaaagtatcaccaagaaaaagaaaacgtaaaaatactttataatatccatatacatttgtttttataaggaaaattcttatttattttttaaaaaaaggaaatgactgatgtatattgagtttcattttctttaatactattatctgaaagtagtgatatctgctctagagagtaccttagattactagatatcaagtagaacaaaacccattgaagtaatagagtatgtaggccgtatctgaaggccacaatgatgttcttcaaattcttccattccacatacttggatata

SEQ ID NO: 124776 - DNA, 601 bp, Human
agattactagatatcaagtagaacaaaacccattgaagtaatagagtatgtaggccgtatctgaaggccacaatgatgttcttcaaattcttccattccacatacttggatataatactgtactctgaagattaagttataaaatcaacacttgctgacttttgagctattctctttcttcggcatatttaaagaaggaaaattctggagactcttagtaataaaaacctgagtgtgagaggcaaatattagctggttccatcccagcactgtgagtgagttgctgatcaggctgaaaaargtgtccactacagtcctcagttaaagctcagtcattttgaaaggatagtctgtcattctggtcttacacattagctcttgtgaacttagttaacatgggtcctcatactaatgtctgatctactctgaaacactggtaagatcaaatttctcagaccacaaagctgaaaaacagactctgagctgggataaactcacataagcaaatgcctccatttgaaacttgcaggcagccaaactgtcactcttggccataaccctctgcattagcatgaatctcatcttcaaatttccacatagt

SEQ ID NO: 124777 - DNA, 601 bp, Human
gtatgtttcttcatattcactaatcctgtcagtctgttctgcagctgctcttaaggaaaattctgaaaacatttaagagaggaactatgtaaacctgagaggagctgacagatgcagtctcatctctacaaaatgtaatagcagttaaaatttataataatctcttgcctgtgtttcgtactctatagctctcaataagcttatgtagccactgtctcaatgacacacccaacaatcttgtgagctacgcaggacaggtatgaataggaatgtgtccagagtacccagatcaaagaaaacyctaaaatataaaagagtgctttttaaacagttttaaaatgtagtttccacacttcaaaaaattgtaccagatcaaaaatataaatatttgatttataaaaggaggaaatataagtggttaataaacatttgaaaaaaagagctcaacttcacttattaaagaatgcaaacagaatgagtagcatcttcacctgtcaaataatagcagttgtgatgacaccctcatattctgtagcaggaatttatagtgatacagtcttttaacttaaacccttaaaaatatcatactctttagcccagt

SEQ ID NO: 124778 - DNA, 601 bp, Human
gtgtgttgttacccttaactatgcagcctgcgcaagtcacctctttgccccgccacgatcctcatttctgaatgagaatgtgggctgtggttgtctcaagagtactttccagctttcaaagtccataagttcatgccctccagtataaaacttttcttacattgttacaaggattggttttcggttattttagtttttgagggaacaggagcttttatagactaggtaacctgtccaaaatcaaacagatataagatgtgccgctgggatgctaccttagaaccatgtaattccaaaatcytgaactacagtgtcctttgtgattttaaagtctagtagacctgtcccctaaaatatgctttttctccaacttgttagaattacagttaatttttacatagtctcataatcttacaatacaccaagaatacaatattcattagaactatagtaaggtaagggtcgtgtatatcaaaagaagagtatggctgttcttgaatgctatgataaagtatattttacagagaaattcagcctagattttatttataccccagtaaatgagtttaccgaatcctttcctaagaacctattttcatag

SEQ ID NO: 124779 - DNA, 601 bp, Human
aaacttttgtttttattctggaaagataatttattccaaataatgtttcacttaagggtctaatcgtaagtccaagatgattcagatggtgaagtccagctgtaacaacaacagtatcatccagaaaaataaccacatgtatattgaatcccttgaaagttttccataacagatctgggggtgataaatcatgcaaactcattctataattaactaaagtgtttcttttccttcaccataatccaaaaggattagcccatgacatttagctggataaatcagggggccataatttactccrctgtacaaaattaaattcagattttaaaatctaacaacaaaaaaatcaaacacaccccaaagtgagccttttctgaaactttaaaataagtcttcacagttaataaaagtttgaacaatgaacaatatctctatgataaatagcacagctttcaataatatatttcagaacttttccgtaggactctcctgaaatgtcatgattatatcatctggaaaacttattgagcaagtgacatggataaactaagagagccaggcttctacagtttactcctgatctcggattgtcacaggttaa

SEQ ID NO: 124780 - DNA, 601 bp, Human
aagagagccaggcttctacagtttactcctgatctcggattgtcacaggttaatttttcatcgttttatccctatcactgaatacagtacctgtcacgagtgtctgttaaatgaaagcaccaagaaaattgaaccataccttgtttcctaatctgtaatagtatgaaagtatggttagcctctttagatggttcactataaaattataaggactagtgaagcaacattgctgcagtttttgacattttataaatatgctccttgtgtattttatcctatactaatttctgctcttgtctgmaacaggccttggttctgttcttatttggcttttgttttctgttgtcacaccactgatacattcaatgaaaatgtattgagcagtcacttaagacctttctgcaacaaagcagaagatggatggattgatagaaagataactttctctagaaaacatttataattactgaattttagcagtaaacttagtaaaattactgtattttagcatgccttcaatttgttttacattttcagccctctaaaaaattggctgtctttggagaattgcattgtgttgaacttattgatttccactgaa

SEQ ID NO: 124781 - DNA, 601 bp, Human
atcactgaatacagtacctgtcacgagtgtctgttaaatgaaagcaccaagaaaattgaaccataccttgtttcctaatctgtaatagtatgaaagtatggttagcctctttagatggttcactataaaattataaggactagtgaagcaacattgctgcagtttttgacattttataaatatgctccttgtgtattttatcctatactaatttctgctcttgtctgcaacaggccttggttctgttcttatttggcttttgttttctgttgtcacaccactgatacattcaatgaaaatrtattgagcagtcacttaagacctttctgcaacaaagcagaagatggatggattgatagaaagataactttctctagaaaacatttataattactgaattttagcagtaaacttagtaaaattactgtattttagcatgccttcaatttgttttacattttcagccctctaaaaaattggctgtctttggagaattgcattgtgttgaacttattgatttccactgaacatgctgaaaatgcccattatttgatgcatcattaatataataatagagatcaagcatttttagattcaaaat

SEQ ID NO: 124782 - DNA, 601 bp, Human
acagtacctgtcacgagtgtctgttaaatgaaagcaccaagaaaattgaaccataccttgtttcctaatctgtaatagtatgaaagtatggttagcctctttagatggttcactataaaattataaggactagtgaagcaacattgctgcagtttttgacattttataaatatgctccttgtgtattttatcctatactaatttctgctcttgtctgcaacaggccttggttctgttcttatttggcttttgttttctgttgtcacaccactgatacattcaatgaaaatgtattgagcartcacttaagacctttctgcaacaaagcagaagatggatggattgatagaaagataactttctctagaaaacatttataattactgaattttagcagtaaacttagtaaaattactgtattttagcatgccttcaatttgttttacattttcagccctctaaaaaattggctgtctttggagaattgcattgtgttgaacttattgatttccactgaacatgctgaaaatgcccattatttgatgcatcattaatataataatagagatcaagcatttttagattcaaaataactgacatc

SEQ ID NO: 124783 - DNA, 601 bp, Human
gtgtaggttattcttcacaaggaacaacttgtaagccaaagtcattgtttggtgctccactgtacccagataatcaaccaaagaatggaaagaagtgttttgatgaataggggcatcactgcaaatcactactggtctaaaaaaagaagcagaatgtaaaatgcatgtgagcacctcttttcttacttctagttctacctaattcttattaacctagcacatcacactgatttataggatagggatggtgccacttgagtttaggtgcataacaagcagtaaacatttggtagatatttcytgaggtttgactctggttgttatctgttgattctctcaaattcctcctcttttaatttaaaaattaaaatttaaatgcagtcttttaatttgctatagtcttatgtttttcccttacattttcttacaagtctgtttgttttctgtcatttctcagtttttccattatctcatagttctctcccttaagattgatgcattttctgtcttcttttgttatcctttcatcttttcgtcttgtttccctctttttcattgattttatctcagtagtcttctaattttttttccatttattttc

SEQ ID NO: 124784 - DNA, 601 bp, Human
taatgaaattgggtaaaaacttgccttgagtgattgatactacagcagagtcattataatctcttacatactaaatcttaagagatcttgaaggaaattcaaaggtcttgacttctgctgaaaagctaattacctttattttttgctgaccttttcatttcctttctacaagatgagctgttgatttaaatgcatgcataaaagattccactaatttatagaagaatgtaatgtttaaatacctatcctattgtttgttcaaaatatgcctgtggtatcttctctatttgcataatgtaamtacttttttttaaccactattgattctttccttgtcgggtaatcaaagcttagatcaaccattgtaattcaaatatgaaaagccacattcaaaaaattataatatttgtctttttttatgttcaacaatgaaagagaaaaataaaagtattatatagcctgcaaagatcacatctggaagcctggtttttctttaaatttgttaaaaattttttgaaaaatatgtctttgattctaatttcctaatacctaatatttcaatattctaataatctaataaggaaaatctttagaaagggaa

SEQ ID NO: 124785 - DNA, 601 bp, Human
ctgttttttgctttccatccccattctaacagaacctcgatgaaattcaggaaccctttgcgtcccgaaattcccaactaaatgaatcttttttaaagattcaggtgattttcacgtagagccaacgctgagagacattgagaaagcaaatgcaaatttactagagttaattactaaattttttaaagtataggggaaaaaattgcaaaatgactagttagaaaatacaaggatgggttacagtcactttaagaaaaaattgtttgtgccgatgaatctaatttacagcttcttcacacayggtctctttcacaataagaaaccaaaatgggctatcaaaaactcttctaatttggaatcactcaagttgtagtaggcactcctggcttgcatcagaatcacaagagaatttatttgaaatgcagattactgaatcaaaatctgtaacagagggacccaataatttaacaaacatccactttcactttcacaaaaacccccaaaatgattcttactctaaagcttgagattcattactccagttaactcacacactttccccttagaaaataaaaggtttacatttaactatgtggcttga

SEQ ID NO: 124786 - DNA, 601 bp, Human
accccacgacaggccccggtgtgtgatgctcctcatcctgtgtccaagtgttcttaattttttttcctttttattattttcatttgttaaacgttattcttatcccagaaatgatttataactcttcctttttccttgtttcataaggcactagattattatattgttaatgatactatcctgcaatatagtactcccccaatgatgctatttatgtcatgaaaaagccttcaatacctgagaacattttgctaaggagtcagtttacttttaaatagttatcagtcagcatgagtgagcwcacatctttgtaaacatgtaaactgatggcctaaacactgggatttcactgattattgtatcaaagcgacaatgattgatcaaagtcaagttttctgctttttaaaacgcagccattaacccaaagctgcctaccaacaatgggtgcaagatgccaccttcagactaggtccatgtgcacagccaaatcaaaagtggccccaaagttttcagttttctatgtattatgcccaagataaactgaagatctggaaatactgagaagctgaatttcccctcctgaatgaatggcattcccatt

SEQ ID NO: 124787 - DNA, 601 bp, Human
gggcctggtcaagcttatttaaattgattgcagggctgagcatcagtccagagagacaatgctgtcagttctcacacgtttggctttgccattatatccatcagctatagtagttatgattccttaattaggaggagcctagataaatgtctaattcctttttactaaatatattcgtgctgaaatttcagacttttaagaatattgaacttgttctcttactgaaaagttaaaaagttaatgacattcttgaaaaaaacttgtgcattaggggttggtaaaggggacattaaagaaggaygctgtactgttgacttgtttctttaatcttgaattggggagaaaatctctccaaatagtggatggccactgtggtatcaggatagccgttctatgacgaaattatttatatctctacttggtgttcttcaggactgagaccacatttaacttttctgaagctgttccttcttctatttcataattatcttttccctatgtttgctattttcttcctatggttaaaatggcgaggttcatatacggataaaaatagactaaatgccttttagcactcccttaaggagctaagagggttctg

SEQ ID NO: 124788 - DNA, 601 bp, Human
catcagctatagtagttatgattccttaattaggaggagcctagataaatgtctaattcctttttactaaatatattcgtgctgaaatttcagacttttaagaatattgaacttgttctcttactgaaaagttaaaaagttaatgacattcttgaaaaaaacttgtgcattaggggttggtaaaggggacattaaagaaggatgctgtactgttgacttgtttctttaatcttgaattggggagaaaatctctccaaatagtggatggccactgtggtatcaggatagccgttctatgacraaattatttatatctctacttggtgttcttcaggactgagaccacatttaacttttctgaagctgttccttcttctatttcataattatcttttccctatgtttgctattttcttcctatggttaaaatggcgaggttcatatacggataaaaatagactaaatgccttttagcactcccttaaggagctaagagggttctgagaaagaagtttctctcagatacggaatggtgaatggaggttggtagttaaagggcactagttaactatgattgataatggcctgatattatttcttt

SEQ ID NO: 124789 - DNA, 601 bp, Human
agcctgcctgcccacccatacaccctagatgctaacttgaaccccagtgccaccatatataaattctctctgcaatgcctaagaaaagatgctgacgttgctgctgcaccccctatggtggatacagaggaagggaatattttgacataatgatcacaataatattttcattctgcagctactgtaccccaaagtggctatgtcaggacattacttcgtctttttctgttttctcaaccacaaaatcagactcacaattggatttggcagctgccaagctaccctaatatagcagcagacraatccaggcaaagaacagatctatcactgtatctgactgatctttctgcttatgcacagtgacaaattctcacctctccatatagatcagcgggctctgtaaccagtcagtcacgcataagttgtgacagcgcatcacaagactggcaatttggagccctggagaacaaggtgaaacatgcagttattttacatgaaaactgcagtctttcccagagcaccataggggtgtgtgtgtgttgtgtgtgtgtatgtgtgtgtctgtgtgtacaacattttacaaaaagaaacagattgttct

SEQ ID NO: 124790 - DNA, 601 bp, Human
ttttgatatttgatatttgcaaggattttagagaaactccctttgtcattttatggtaagcatattaacaaaagaagatgtctggctgcttcagaaatgtttcagggtatgaggtgacaatacttcccatgagctatccaaattcagaaaaaaattggggaattgctaaaaaaaatctagtaataatgcatgcatgttggaatttataggttagtagtatacaaattaaatatattttaacattactcatttataagaagccaaatgtaagtacaaatgactggaaaataaaatggcatargattttagggttgttgttgttgttgattatctataaattatggatataagggatagtaggtcctggtcttaggacactcttaggtcattgattcaacagatattcccaaatggaaacaatagagtcatatctaaaaagtaaatttattacgaagtctcataaaatataacgtatttctctgcttacatgaagtattcttctgttcagttacttccatcaagaaaagacaagactttattcagtttatggtttattatgatttagataattaatataacatcttgtttttaaaaggtttaa

SEQ ID NO: 124791 - DNA, 601 bp, Human
gaggaggaggggagggaagaggagaaggagaatgaggaagaaaagaggtagtagaagaggaagaggagattagaaaaattatactaactctgatgtatttctgcaggataatagacagagaggatcctttctatgttaactagttcttcgagttcatgtaagtccttggaaatacattaactgaaatccttcacctcttttggggaaatgacagagccattagttcaaatatttggtaaattaattataaacaactgtaaacctccctgctctcactttctggagcaaactcaattgactrcattattccaaaccaattgttcactctgactgtcccgtagcaataagaccaagtcagtaacttcaaggttccagaaatggactgtgtatctggactcatttgttaaattgtttccatagcaagaaaaaaaattctgaaaatgtaagaaatacaaaaagaaaacatcagcttactagcccacagtcacctggtgagacagcaataaagacagtagtttgatatctgccattcaaaaagcttttaacttgcagagagagagagaaagagagagactttttaaacttttctatagtgtgttaa

SEQ ID NO: 124792 - DNA, 601 bp, Human
aatggtaagtttcctatataggtgtaccacttttatcttttatactctatttttactataccttttctatatttagatatgtttagatgcacaaatatttactgttacgttacaattgcctacagtatttagttcagtcacatgctatacatgtttgcagcctaggagcaatagttaaaccatatagcctagctatatagtaggctataccatttagacttgtgtaagtacactctgtggtgtttacacaacaatgaaatcacctaacatgcatgtctctgaacttatcccccaaattaartgatgcatgattgtattcttgttctcaagaagccctcttggatgatttttaaaatagtaaaagaaatgttaacaataaagaaatttatttggttttgtccactgttcaccacctcagttaaaaaattaaagctgaatgaaagaaataaaactttaggatttgaaaagcagggaaaaaatttcaagagattatttgttttgcataatttattgtgaaagtgcttcctctgttagtattttgcttcagcaatactattataaatactgtacacctcaattgttattatttattagcaattat

SEQ ID NO: 124793 - DNA, 601 bp, Human
aatgaaagaaataaaactttaggatttgaaaagcagggaaaaaatttcaagagattatttgttttgcataatttattgtgaaagtgcttcctctgttagtattttgcttcagcaatactattataaatactgtacacctcaattgttattatttattagcaattattaattaatcaatgcacaaataaaatcagaaaactttgggaaacatttatttatatatgtgcatgtatgtacagattatacctgatctacttcataaagtaatttttattagcttacagcaaaagacaaagatgcaaaaaaaaaaaaaacagaattaaaaggaagggttaaatagtaaaagggaaatattccagtcataattaagagcatcgtctttagagtcagataaaactggcagcttggcatttctaatccaagattgtctggctgtgtgaccttggacaattcactcaacttccctgatccccagctcattacttaatcaaacacagataataatgcccaccttgaagaagatagtggcagctattgttttcattcctgaaatgctcttgctaatgaattctacactaattaaatacaaaaacaaaaatct

SEQ ID NO: 124794 - DNA, 601 bp, Human
aattaaaaggaagggttaaatagtaaaagggaaatattccagtcataattaagagcatcgtctttagagtcagataaaactggcagcttggcatttctaatccaagattgtctggctgtgtgaccttggacaattcactcaacttccctgatccccagctcattacttaatcaaacacagataataatgcccaccttgaagaagatagtggcagctattgttttcattcctgaaatgctcttgctaatgaattctacactaattaaatacaaaaacaaaaatctgacctacactccctgcsccacttatgattatatagaaatatatatttaaaaagctaaactcaagttcattttctatgaaggttagaaataccaagttaaattttaaaacaaacactgtagaatggtattcatgaatacacctcacatgttgagcaatatcttatggaagtaagcaatcaattaagaaccacagcagaaaattgtaagcaaacatcagagataatgacatatatttagttttaaatttataggcatgttttgcattaagatttcatttagatgttgctggtttctctttataacaccccttgaaatgc

SEQ ID NO: 124795 - DNA, 601 bp, Human
ttttaaaaatcctggctgcagaaaataggctgaaaggaggcaagtaagaaaccaggaagaccaactaccaggctactgtaataatccaggctagaaattagagtgacttagaccagaaatgtagctctgaaaatggtttaaattgtttttaatgttgagttttcaatatagtttttaaagaaagaacaaataggttgctgatggattaaatatggagtgtgagaaagcactcaaaaaatgactccccatgttttttagcaagagcagccaggtcataacgttacccataacggcatgaccrtgtggggagagggtgagggcggggcagatcaggagctaatgagtgtgagttagctgttagtattgtagcttctcttatgatcaccttctcttatcctagaaattatctttttttcattgagtggcattggctttattgagattataaattaggtatttttttatatttggaaagatcttcacaacttcagcttctctgaagcagcagtttctgctggttgagaagtatgagaaaactataatttcaaaataatgcagggacaaaccctacactggaaatgagctttctggttagaaaata

SEQ ID NO: 124796 - DNA, 601 bp, Human
tagtattgtagcttctcttatgatcaccttctcttatcctagaaattatctttttttcattgagtggcattggctttattgagattataaattaggtatttttttatatttggaaagatcttcacaacttcagcttctctgaagcagcagtttctgctggttgagaagtatgagaaaactataatttcaaaataatgcagggacaaaccctacactggaaatgagctttctggttagaaaatattttctttatcccatggaattcactacttcttgtccagattaattctttttagtgttycttattttgcaatttactttttcagaataagtggatttacagcataatctaggtttgctgcacaaacagcacactgcacaactttgtttatgttgtggcttcttgctccctagagtggctcggtgcagctaccctgagagcagtgtgaacttcgaaagtaataactggtcattgcagagaatgtggaaaatgcagaaacataaagaaaaaataaacatgttaaaatatgtcagtgaattctcttccagccttattttctatacataataccgtaaacaaatttagtattctactcttttc

SEQ ID NO: 124797 - DNA, 601 bp, Human
gcactgacacaaattaaatttgttgttttcacattatggtattcctcatttgtctgaggggggatatattccaagaccatcagtggatttctgaaactttggatagtagtaaaccctatatacagtatgatttttccttattgtaagtcaaaacttttacccttttcacttaaagcactttatggcttcttttggcatatgtaaatcgccagcaaatgcactggggccatttttaaataaaagaagggtgacttgaacacaagcactgtgatatcacaatagttgatatgatcaccaggtyagctactaagtgactaaggggagggcatcaacagcacggatacagtggacaaagagatgattcatgtcccagacgagacagagcgggatgacaagagatttcaacacactacttaaaccttatgaattgttcatttatggaattttttatttaatgtttttggaccaaggttgacgactggtaactgaaaccacagaaggcacagattggggcagactactatattggaaattaatttagggatcccaagttatacaatataattagagacttaacagtagatagtttagtttaacttaa

SEQ ID NO: 124798 - DNA, 601 bp, Human
caaggttgacgactggtaactgaaaccacagaaggcacagattggggcagactactatattggaaattaatttagggatcccaagttatacaatataattagagacttaacagtagatagtttagtttaacttaatcttaggttttttcatagtgtacatggaaatatctcagagtatctctcaggaatgcaaaagtttgtcctgggaaaaaaattatagtggttgccattcgtttgattttcaaaagtttattatggagtactttttcacccttttttgttgactggatcataccaaaaatatggtatccagtgctgggaccaaatttttagaggatatagactagatggagcatattcagggaagagcatagtaagagagctgaggtatcactacacaagaggctattgaaaggacaaaggacggtcagtggagaaggaaagattcaaggaggcaatgctgagtagcttgcaaatgctggggggccgtcaggtggaagagaggttacagttcttctataggtctcaaggagtgaagcttcgactaaagggtggaggtagctgggagaaatttggggtcagaaaagggagaatttcttat

SEQ ID NO: 124799 - DNA, 601 bp, Human
caaaagtttattatggagtactttttcacccttttttgttgactggatcataccaaaaatatggtatccagtgctgggaccaaatttttagaggatatagactagatggagcatattcagggaagagcatagtaagagagctgaggtatcactacacaagaggctattgaaaggacaaaggacggtcagtggagaaggaaagattcaaggaggcaatgctgagtagcttgcaaatgctggggggccgtcaggtggaagagaggttacagttcttctataggtctcaaggagtgaagcttcractaaagggtggaggtagctgggagaaatttggggtcagaaaagggagaatttcttatcagagctttcactgtaagaaatgggctgattctaaggtaatgagaatctcatcagtggaagtgatcaagtgttattgggtaatcatttggcaaggatatgttttgtggggaggattttcagaatttcatcttatcatctataacataatgattaagaacacaggctctgaaaacagacaacctgagtttgaatcctggccatgtacttcctggctttctgactttgagcaagtcaataactt

SEQ ID NO: 124800 - DNA, 601 bp, Human
agtattcaacagtgaggtgaaatttatgtcaaaaatgtgatttttaaatgcaaggagtaaatggattcaaagagaaagcacaagttctataagcatgaacttaaatgaatcacccactctatctttgcaggccaatttgtacaaccactaattgatagaccgtgtacctgtttgaaaaaattattttgcactttcaattattttacaccctctgttttaagtatcaagcaaatgacttcaaagaaaattgggatcttatgatttcctacaaaaaccagagtaggctgagctatggagccarttttagttttcttgacccaggcgtaaacaatatgcaaccatctagaactgacatgaaatgatctgtagcactttagaacttgaagatctcttggaaatcatctaattcaacagttctcaatgagtgactccctgacccacagcgtcagcatcacctgggaaattgttaatttccaattaacagttggagatcgcgaattctcaggccccacctgctgaatcagaccttagagatggagtccaacaattggtgctttaacaagccctttcgttgggagatctcagtccacacttaagtttg

SEQ ID NO: 124801 - DNA, 601 bp, Human
aagaaaattgggatcttatgatttcctacaaaaaccagagtaggctgagctatggagccagttttagttttcttgacccaggcgtaaacaatatgcaaccatctagaactgacatgaaatgatctgtagcactttagaacttgaagatctcttggaaatcatctaattcaacagttctcaatgagtgactccctgacccacagcgtcagcatcacctgggaaattgttaatttccaattaacagttggagatcgcgaattctcaggccccacctgctgaatcagaccttagagatggagtscaacaattggtgctttaacaagccctttcgttgggagatctcagtccacacttaagtttgacaaccactgatttactccaaactcttgattgcacaggtgagataaatgagaaccagaaaagtaaagtgatttgcttggggtgatccagcttagcatcaaaatcaggaccagaatctgggcctcctgactcctagtgccatgtatttgcatcttgaactggacttccttcccttctctgcaattgcaacctgagaagcccaggttaggtccaatcatcattgctttttgtctgtgccctc

SEQ ID NO: 124802 - DNA, 601 bp, Human
agtctgaaatcagatctggcatgcggtttgttttagcctgtcacagacgcagggcactgtgttgccctcgacaaggctgttcagcatagcatatgactgtaaatcttctttttcatgtaccacagtggggacctttgtcctagcagtgatttagcagcttttattagcctgagaagcagccagtaatcaggagacatttaaagtggaagcttgctcatttcgatggagaagaatccagaaaccaacggctctttgaaaattacttttgatgggagagaaataaaaccttaatacatataartatatggtatgtttccattttaaatttattattgctcaaacaaatctatacataattcagcaaagactcaaagtcacatatctttaaaactttgcattcatcaagtcatgaagctcaagggtttatttaactctgagttttcagaagtatgcatcttgaaagaacgtaggtcttggatggcagctccctgtatgttattcagatcctggagtgtccacagcttttaaattcactgtaattccaattagagcttgggctcaggggttggcagcagctgcaaataagaactaataatgtttc

SEQ ID NO: 124803 - DNA, 601 bp, Human
acaatctgaaccttaatggtattgaaccttgagcttttcctatctctggatattttaagggaattaataaattctttaattgtttcagccaatttgagtcaggagttctgtgacttgtggttggaacatccaacctcatgcacactaatataatcaggtatgcaaatataccaatacttatgatttggactaaggaaatggttttgcttttacagaagatcccactatcattgttaacatggctttctgcaactttggccttaattacgtaacggccgaggactctttataatatccctcrcaactcaagtaaccaggacaaacttattagggcctcagcacacaaattgcaacaagcagaagcatagagagtaaagttctgtcttgttccttttttttggttttgcttttgatttcctaacaaggaggaaacattatgtttgatttctttctggttgctcttatgaggcacatttattggttcatgttgtgtttttctctaagttttaagtttatacaacttaagatacgacaaccaattactgtataaaatttagaaaatatttaaacaacaagaaaataagaatggcctgtcatagtc

SEQ ID NO: 124804 - DNA, 601 bp, Human
cccatttaattaagactttagtctcttggattggagcatggttgtccactttaaaatgttgtatttggtggccatattttccaaactccgtgcatacgatttgataaccaccatgggcccagggcaagaggcaaaatatataaaattactactgtttcgaaaaatccaaggcaccagatctctgtaaacaatatttcccaatatttccttgtagatttgtgtctttttaacaaatcattttatttaccatatataccagaatgccaggcttctaaaaccccggaagaggtagagtgaatcrttataccttgcctcccaagctccaaggtacagaaattaatggaaggcagacacgtttgacctagctgctcctgccagaatatgaaaatgagactggtattgcgtggagttactggatgacaactccctcgacccagacccatgaaacccatttcatataaccttagctaccatgattccttgcatgtttttaagtcttggtaagctgtttttctttttaatatagctatggtttcacctttgactttgcacattattgatagagctaaaaacctgatgaaatttaaaaacaaatccagat

SEQ ID NO: 124805 - DNA, 601 bp, Human
aatttaaaaacaaatccagatatttcagactggatttttatacacaaagacaggacctttggactttaaagatcactcaggctagacaggataataatagtaatattctggttttctatgacattttcctaccaaagagatgaatgcaccttgatagcaatattgaaatattcataaccttctcatacagtagatgtaatactgttatcctcccttgtttatgaaaaaaacaaggcctgcttcttttgaaggcattgttcaaggtcatatagaaggtagttgagttaggactctcaggatmtttcaagcaaggacagtaaggaaagatctaagaattccacataaatgtcatatgaccacattgcaaaccatttgcaaaatgtcatttgaatgtattaatattgaatagtcatatggaatgaatcctgcttgaaattcatgtctcaaaaaactaaagcaaagctattcagaaaatgccaagagaattggagcatttgtttcctctacggtttacccatttctattcactattcttcagtgacatgtgagaaccttaaggttctcatacaatatgtcgtttaggagtaagaatccatctcta

SEQ ID NO: 124806 - DNA, 601 bp, Human
tcctcccttgtttatgaaaaaaacaaggcctgcttcttttgaaggcattgttcaaggtcatatagaaggtagttgagttaggactctcaggatctttcaagcaaggacagtaaggaaagatctaagaattccacataaatgtcatatgaccacattgcaaaccatttgcaaaatgtcatttgaatgtattaatattgaatagtcatatggaatgaatcctgcttgaaattcatgtctcaaaaaactaaagcaaagctattcagaaaatgccaagagaattggagcatttgtttcctctackgtttacccatttctattcactattcttcagtgacatgtgagaaccttaaggttctcatacaatatgtcgtttaggagtaagaatccatctctagaagcatcctttgggtgtttaccttacagcttagtctacagagttcatgttgcaagtcacgacttgaaatgcaaaatgtttttaatttattgtgtgcttgtcagtgtggcttaatgaaagtactcagaattcgaagtagggtggcggaaggctcaatatgccacatcccttaaattctctagcaatgtaagaacacatccacataaa

SEQ ID NO: 124807 - DNA, 601 bp, Human
aaggtagttgagttaggactctcaggatctttcaagcaaggacagtaaggaaagatctaagaattccacataaatgtcatatgaccacattgcaaaccatttgcaaaatgtcatttgaatgtattaatattgaatagtcatatggaatgaatcctgcttgaaattcatgtctcaaaaaactaaagcaaagctattcagaaaatgccaagagaattggagcatttgtttcctctacggtttacccatttctattcactattcttcagtgacatgtgagaaccttaaggttctcatacaataygtcgtttaggagtaagaatccatctctagaagcatcctttgggtgtttaccttacagcttagtctacagagttcatgttgcaagtcacgacttgaaatgcaaaatgtttttaatttattgtgtgcttgtcagtgtggcttaatgaaagtactcagaattcgaagtagggtggcggaaggctcaatatgccacatcccttaaattctctagcaatgtaagaacacatccacataaagtgtattaaagagcgctgtatctccatctacgaacaatcatctccaactctaaaccaggttattg

SEQ ID NO: 124808 - DNA, 601 bp, Human
cccagatttcccaattattaacactttatcactgttgctgtttcattcttgttccctttctccctctcccccatctaaaaatcattttaagtggaaacatgttcttttacttctctaaatacttcaatgtgcatttcttaaaataaaaacattatctcatataatcacagtacactcatcaaaatcaagaaattaacaatgatatgttgccactacctaatgaacagaccttatttatatttcacctactttcccaataatgttgtttttagcaacaactaaaaatcttaactggagccckatccaggatcatgcacgccttcagttgtcatgtctcttcagtctttttttttttttttttttttgatggagtctcgctctgtcgcccaggctggagtgcagtagcacaatctcggctcactgcaacttccaactcccagattcaagcgattcttctgcctcagcctcccgagtagctaggactacaggcacctgccaccacgcctgactaatttttgtatttttagaagagatggggtttcaccatattggccaggctagtctcaaactcctgaccttgtgatccacctgccttggcctc

SEQ ID NO: 124809 - DNA, 601 bp, Human
tattattctgtctctactactatcaacagttttgtgtttccacagtggttctttacatcttcttctccaaatcttcatcttttataaaataagcccttccggccgggcacagtggctcacacctgtaatcccaagactttgggaagccgaggtgggtggatcacctgtggtcaggagttcgagactagcctggccaacatggtgaaaccccgtctctactaaaaacacaaaaattagctgggtgtggtggcatgcacctgtagtcccaggtactcgcaagagtgaggcaaaagaatcactkgaatccaggaggtggaggttgcagtgagctgagatggtgccactgcgctccaacctggaaacagggcgagattccatctcaaaaaaataaataaataaaataaagaagcagggtaagatataaggctgatagccccaaataaatcagagatgtcattagtatttcagttattcagccatactgacgttgtcatttgtttatgtgacttttctttctatgtaggaacctaaaataacccagaagtttctgtgggttttggttttccaaaagctgttgcttgcctacctcatttggggcaac

SEQ ID NO: 124810 - DNA, 601 bp, Human
tccacagtggttctttacatcttcttctccaaatcttcatcttttataaaataagcccttccggccgggcacagtggctcacacctgtaatcccaagactttgggaagccgaggtgggtggatcacctgtggtcaggagttcgagactagcctggccaacatggtgaaaccccgtctctactaaaaacacaaaaattagctgggtgtggtggcatgcacctgtagtcccaggtactcgcaagagtgaggcaaaagaatcacttgaatccaggaggtggaggttgcagtgagctgagatggygccactgcgctccaacctggaaacagggcgagattccatctcaaaaaaataaataaataaaataaagaagcagggtaagatataaggctgatagccccaaataaatcagagatgtcattagtatttcagttattcagccatactgacgttgtcatttgtttatgtgacttttctttctatgtaggaacctaaaataacccagaagtttctgtgggttttggttttccaaaagctgttgcttgcctacctcatttggggcaacaaatgcccaccccaccctttttttttttctgagacaga

SEQ ID NO: 124811 - DNA, 601 bp, Human
ggttttagcaactcaagaggctttatatgtgttcattaaccgcaaatctgtaatttaaatggacaaattatcctggttaataatctaacacatcattcccaattcttcctgctgtcaatattcgaaacagagctcaatattccaaatttttataacacctttcacatgttaagtgggtacagttttgacacacaagacaaaataaaataaaattccgtactggacaacactcacaaaagctgcttgattcaggtgaaaagtattttgcttccatattggcctagagcatctatttatgtatttttttttttgaaaatagaaactcaaaaaaattattgtgatttttttaggtcattatataagggatagagagaggtcacctaaaatgatgaaaattagcacaataaatatgactgtgagagcagcaatcaattcttttcttaagaaaattaaaccggagccgggcacggtggctcacgcctgtaatcccagcactttgggaggccgaggtgggtggataatgaggtcaggagttcaagaccagcctggccaagatggtgaaaccccgtctctactaaaaatacaaaaattagccaggtgt

SEQ ID NO: 124812 - DNA, 601 bp, Human
ttttaaaagtagggccaattcaagagtgtttattacataccaaaaaaaggaaaaaatatttaccttgtattttttgatgtctggggataagattaatttataaatcgatgtgttgcattgaaatagcaaatgtaaaaaccagtcacaaatactagccttaaaggtagaatgtgtgctgtttttataaggccctgctcatcattgaaaccaggtgactttaaaaataatctacaaaattaaaaaatttgaaatttggtttaaaattttaaaatacctcagaaaaacaataaaaaggaaattrtatactgcatttgtcacaaatctgacaactctaatacaaatatgcatttctctttctttgactgtatataaataaggccaaatatctagcttgttaaattaaagattcacctgtatgttttctccaccaaatatttggaaactcttgaaatttttattcgatttttttagatctcactaaggtttttgattaagatcttttttattttctcctcccctcctatgttcctttaaaaataacagcatatccattttaacaatataaaacttcagttgatattttttagagctagtaaaattg

SEQ ID NO: 124813 - DNA, 601 bp, Human
ttgtctcgattaaatttgaaacaaaaaatttcacctaaaccatgactaaatcattcatccctcaaattctagacctcttttagaatattgtggtatgcagacacatgaaaattgatgcattacaatagtacacagcagagagtactccggagcagtatttttcactacagcacttgctactttcctttaaaaaaaaaaaaaaaacacagttttaattactagagttggggaacagttgttctctccaaaaaaagggtagaattctctattcactgtctcacatttttacttgaaaaagttrtcgttgttaaaagaattttaaaaacttaatttgcatcctatttttatttaaattacctctgatattttaaccaaatattatcactgctggagagcacctaatattactcaatattatttttttcgtaatagtaaaaggtgaactaattttgttttaaactttgaggttaattttttaaatgagagttctggtttttaatatggtaactttgacctccacaatgtcatgctcctatagtttgacaaaataggaggttgcagatgttaaatatagccctgttctcgtagaggaaaggcaagg

SEQ ID NO: 124814 - DNA, 601 bp, Human
gggtatcaaagctgcaaggggaaataaggtctgtggtcaggatagggtttcagtaaggctagaggcaccctctcggaatgcgtgggaggccaggccattatctgagcagtattttaaaggaacagaggcgccattatgatgcctgcatcaacccagcaagatgaagatgatgtccgttctagatttccacagcttttattgacggcctcctcattgtgtctttcctgattgtctggcagtctcattatcatacccactccttcccctgaaaaggagcaggaacagctttgactcacacatrcaactcccactacctgattagcaaacagatccagccctgagtcagtttcaggggtcctccgtaaatacaatgtcaagtaaataaagtatgatcttaattgacagaaagtttacgaggggaaataagccagtattctgctgtgttgttatatcactttaacacttcaagatggtttacttcaatgtttatcctcaaattaccttctccattttacctcacagatattttcccttaatatttctttctttattaatttaaatatgctgttaacaacaattgcataaatagtagcattaagga

SEQ ID NO: 124815 - DNA, 601 bp, Human
aatcaccattaactggacgagccttgcaggaattcccagttgtatgccagccattctgtggcctgccttgaagtatggaaacatcacagaagtgggaataagggcaacagtggcagaccacagcattagctaggcttagggagaaagagatttgaagggaattcaagatttcataggggacaaaagagggcccagtaggagggagaaaatggaattgtccttgtacatgtcacgatgattataatgcaaacaattttttttaagactagcagggaaacctctggatttcattttggaaaartatccatcaatctgtatagcttcattttaaaatgaaatttttaatcagtgtatattttttgaacccgcctgggaaagcaattggtgggcttagaaaatgttattttgaaagccttttttagtttcgtgctggtagggttccaaaagccttttttaaagaacattcttatataataatgatagctaacacttaactagtgggtactacatgccatgtaccggcaagtgctttatgtatgttaactctgtcaatactcataatgaacccatggggaaaccgtggcagtaatgctcattcatt

SEQ ID NO: 124816 - DNA, 601 bp, Human
gtacctgtcagtaagcaaaatagtgtgtatatttctatttggaagaaactgtgagctatgggcatgcaattgcaaggtgaatgatagatggctccaaaaccaagagcaaaacacttcctgagagaaagttagcagaaggtgacacccattatggatgcaaagtgaaatggggcagagacaccaaaaccaaataagtgggtttgccccagctcttttactttccagttatttagcctcactgatccgcagattcccaccctataaaatggaggcaaaaacattggctctgtaggtttattawgagaaataaatgaaaacctgtataaaatgcctgacacactgacagatgagttatggtgccaagtagtaattgcttttgttcaatttggtttcttaactaaaaggaaccttgtgaccctccttgagactgtctccacagttctcgggccccaactcaaagaatcctaagtattagcagaactgaaagaaatctcaaaatattatgtagcctaactggataaagtattaatccctacccaccctcccattttacagatcaggaaactgaggacctgagaaggtaagtggcttgctcaaggtc

SEQ ID NO: 124817 - DNA, 601 bp, Human
acccattatggatgcaaagtgaaatggggcagagacaccaaaaccaaataagtgggtttgccccagctcttttactttccagttatttagcctcactgatccgcagattcccaccctataaaatggaggcaaaaacattggctctgtaggtttattaagagaaataaatgaaaacctgtataaaatgcctgacacactgacagatgagttatggtgccaagtagtaattgcttttgttcaatttggtttcttaactaaaaggaaccttgtgaccctccttgagactgtctccacagttctygggccccaactcaaagaatcctaagtattagcagaactgaaagaaatctcaaaatattatgtagcctaactggataaagtattaatccctacccaccctcccattttacagatcaggaaactgaggacctgagaaggtaagtggcttgctcaaggtcatacaggagcaaatgaggaagataaacttgggactaaacactgcctccttattgggcatttttcactatgcttgctgtttttctttgtactaaaagtcttaggacagtaggggtcatccaagagcaatcctctctaaattttt

SEQ ID NO: 124818 - DNA, 601 bp, Human
gacctcacaaggccccaagggggattttagattttgcagacatacatcgttgccctttaggagatatttgtattttcacttcaaaaatcttcctaatctgtttttttgttttgttttgttttgttttgttttattttgtttttgagacagagtctcgttctgtcaccttggctggagtgcagtgcagtggtgcaatcttggctcactgcaacctctgcctccggattcaagcaattcctctccctcagccccccacgtagctgggactacaggcgcatgccaccaggcccagctaactttytgtatttttagtacaggtggggtttcaccatgttaaccaggatagtcccgatctcctgacctcgtgatccacccacatcagcctcccaaagtgctgggattacaggcgtgagccaccgtgtccagccaaattggttattttaaaagaagtttcagagccagctgaatagaatgaaaagaggtaacgatgaagatcccttcttccaagcattagaaagcactaaaatttctagttgagtttttgtaaaaaggaccttagtgtagactgaacttctaaaattcaactagctttacgtcacct

SEQ ID NO: 124819 - DNA, 601 bp, Human
cataagaaggggtgaattggagtcaatggaaaagaagggacaggacagtgaacaatgttgctgcaggaaaatgcactaatccagccagaagagcaatagattctcagcaaacagaggaacagagacctacaaatagaagacacaagagcttataaagcatggccatctggtgccatttttgtgtaaacaccaacatttctacatacctcaaaagacctaggtcttgatatagtacatcagtgcaatgggttctgaaaagggagctgagtcttcacaaaaagttaactcatattcagaataytataatcagaaaaaataaaaattatgtaatatattttagaaagcgctccatgcaaagagcctccagtagaaaaataatggtgcttgaaatagcaaccacagtatttttggggaatttgcaaaggctccatctataaaattctggatggctgagacttcagtatgtttttataagaataaaacttacttagcataatgtcaattgactgaaataaggaacatttaccctgatgagccctgagttatccatatgccttttgcacgagtgagacctttgcattatctgcatcagctgtgcatg

SEQ ID NO: 124820 - DNA, 601 bp, Human
tttttagtggatgataaaacccaggccctaaggatgaaaaccatcctgaagccataaatccagccctggacacagccaaaaactggggacccttcaccagttgagtcactgtcccagaaacataaggtatgctgtgaccttctgcttcagttccataatgcagtcaggttatcttcctattcagaaacatgcctacaaaccgagaccaatctttggctcagaatgatgatcatcctgtcaatggttagtacacattaggacaggcagtagaaagtgacaactttggaaataggcttgctgwcattcaagaagccttccctgaagctcatggctcaccaaaagtaagcagagcttaagtaacctaacaaagcagtcttactttattcactcctgaccatgccctttctttgtatgctgttcaagactaaacagtataaaacaagattgacattatgtaattacttgccttttacactgtgctaacttaatttgcttttcattctcaagtatttaagaaaccattactttcccatcagactttactgtctgccaattaaagcattagatcgatgaggtggagagagcacagtgtttggcaaga

SEQ ID NO: 124821 - DNA, 601 bp, Human
gctgtttttgctacatttttaatgtggctactagaaaaatttgaattccatatatattttgcattatatttgtattggactgtgctgatctgcaactcgaactcactctcttggcgtgtcaattgcccatcaaccgattggggcctggggtgttggaggtgaagagcagtagattaatgacctctaaggccacttacatctctgaaagtctgtgattcctagacaatctactaggagatcatcttttttaggttctgtttttcctccaaacactgggcaaaatctaccatttattcccctstgaagatcctaacagcccactctcgatctgcagttcagagaaaaagagcaatcataattgaatctccttaagctacagagcaggtcagcatgttggacccacacacgcttttccaactgagctgtacttttttaaatttttttttaaattatatattgacaaagtatagtttatatttgtatatatttgtgggtacaaagttgtgttatgatttctaaatacaatgtggaatatgatactaatccatagttttgtgttgaaaacattagaaatttcctcttagcaatattgaagtataca

SEQ ID NO: 124822 - DNA, 601 bp, Human
gtacttttttctttctttagggaaatgagagtttaatatgttttcattcagtcccgaaataacattcaacattaagtatagcatatgtattaatgatgataagtaaaaatggtaatgatgaaaatgtcgacccagcctaatgtctatgattaaaaggtagaaagaaaaaacaagtgacaattctcattcggaaacagatttacggcaggtagtcaaatttcacgagggttaggaggattgtagatagcctttcaaaccaaaaactcatggtattgttggtcagtaacctcctatggaccascagtatcccaacaggggccttttggggaatttaaacttcaacaacaatgacatactgtattttccacagtataggcggtgtgtccaccatggtagccaccaaattgctcctagcaaggaagtgacccggtgtctgtctgctccttagattaaagaggaaaaggcttctgtaatacgtagtctgtctttgctggcaaagatcacctagccctactgaaagtatgggggttggaagcacaattcttcaagacttcttcaaatagaagaaatgtcaatatttagtacttaaacattaaaaagt

SEQ ID NO: 124823 - DNA, 601 bp, Human
ggaaatgacttcagactgcaaggaggtagaacaaacatcattaaggcaggattgaagttcaccactgagttgaggattgtaacggtgaggcttgccactttacataagcctaagtgtccagatgaaagctatgttgggggactacagatgtgtttcttctttgatggcaatctttgtgattcctggataaatgaaaacatttcagaagttagaaataagtgaaatgtcctacattcaaaagcagacagggaaagacacatttcatatagacacatgtttatactatatatatatttatttttatatatacacacacacataagtgtattcataagtacataagtatatctatatacatatatacatgtattcatatagacacacatgcactgcagacactatagatactctacaccatggctgtaggacaaattactgactagagccttacgacttgggaagtaaagtggtatcattggtagtcatcttgggcataccagaaattaagtaatgacaaactaatctcatagcatttctgatactatactgttaagatcagtgaagcaacacagaattgtgtttttattttagcaaggtttct

SEQ ID NO: 124824 - DNA, 601 bp, Human
ataagaaaattgctagtttctgggccgggagcggtggctcacgcctgtaatcccagcacttgggaggccgaggcgggcggatcatgaggtcagaagatcgagacctcctggctaacacggtgaaaccccgtctctactaaaaaaaaaaaaataagccgggcgtggtggcgggcacctgtagtcccagctactcgggaggctgaggcaggagaatggcgtgaacccgggaggcggagcttgcagtgagccgagatcgcgccactgcactccagcctgggcaacagagtgagactccgtctcaaaaaaaaaaaaaaaaaattgctagttcctttgttttctattctgttatctgtgttatctgtataactttccctctgatgaaaaataaatagaagtactgttgggaaaatacttaaaactgtgaatggtttttataacatggatttgaatcaaagttaagatatttgcaaacccagtcgccagaataattttactactaattaaagcaataatccctattctacgttgcacaaaaattaaactgcacaagtttcttcttgcatttgccaaactgtaaatagattaacccattctttcagcc

SEQ ID NO: 124825 - DNA, 601 bp, Human
aggggcaacactggcatctagtggatagaggccaaggatgtttaaaatacacagaacagctccagagaaaaaaagaattatccagcccaaaatatcaatgacaagcataagaaaccctgctctagaacctgccttttggcatttctctgtacttctgtactactgaatttgggcaaaatcatggaaataatgtatacagcgtctcacattactgatgattaattctcagctgcttttaatctcacgacactttctcatgacaatattgattataatacattgcaacagcagattttactgyacctcataaagatcttggtatcttctgtaaaataaaaatgcctggtttcacttcccaaaatttcgtgctaaattagtctgatgtaaatctcttgggaatcagatattttttaaaaagctccccaagtgattttaacatgcagccaagttttgagaaacatgtagagaaaaataacagagatttttgtagagaaaaataacagagatttttaaagtatggaacactttctattctccactaaaatagtatcctagtaatggttcaaagttattgaatgtttattatgtgcccagggctgga

SEQ ID NO: 124826 - DNA, 601 bp, Human
catcaccattttacagatgatgaaactgaaacatctgaaaattaacttatccagactacacagttagtgagtaacagagctgtttattaaatgtagctctttctgactagaaaacccatggtgtaaaccagcagttctgaaacatgagcatgcctcagaaccatccagaaagctagtgaacacatagattgttgagctcagcccccagagtctctgattcagtaggtctggaatggtatctaagaatctacatgtttaacaagttcccagtgatgccgctgactttgctggtctggggacyacacttttcaagaacctccgtgggatggtttctataaaatcaagctatttttaatgacatttcttctatttgaggggatttatccctcatttccccctgaatcttggcagctgtgggtggttggagaacttttctgtccccctagcataatgtcttctgatactagggacggttgtaagcactacgttagtgtgaaaagtgcataatagctgctgcctactgtgagatggggtcaagggagagctacccaggggagaaatcaactcccccttgcctctaaagctaagctcccttaaccag

SEQ ID NO: 124827 - DNA, 601 bp, Human
tgccagatcaaggggatgaagggacaggttgtatattaagggaaaacaggaaatgaagagaagatttttgtttcaacttccttgttcctacacttagaaccaactatgattaaataaagaacaaaaagaggcaagtgtttttctttttaaactatctctcatccccactaaacatcagcaagcaaggaagcaaacatatcccaaagatgagccatcgatgtaaaacacaagttaggggaaatcatgagagtaggcggtgagactcctatatggtcccccagtgttgagtcaagcaactagygtgtattcacccattgatcaactccattcttggtttatttgtttgtttgtttgtttttgagatggagtttcactattattgcccaggctgaagtgcaatggcaatcttggctcaccgcaacctccacctcccaggctcaagcgattctcctgcctgagcctcctgaggagctgagattataggcacccaccaccctgcctggctaacttttttgtatttttagtagagacaatgtttcaccatattggccaggctggtcttgaactcctgacctcaggtgatccacccacctcggcctcc

SEQ ID NO: 124828 - DNA, 601 bp, Human
tcctgtctccaactctgccctttgtttctaggcgacaagcatactctgtgctattaattctcctttgattctcttttgtacccatttcctggttgcgagagcgggagctggatttttatcaaggctcagtagacataaagatgtataagtttctacccctaatacttggcttttagcaccctatgaatggtgcctattaatttcatttactcaggttaatatttaataaccttgaagtagttcacagggaacaattctgtctacaatttgaactataacacatcagatatttggtatcccmcagatcgatttgctttctgacaaaaaaaaagaagttcttaaatggttttcttacttatcctcattacctacagatcttctaagttagaattttatttcttgtaaaatacagaaaaataacaattacaatgaaaacaatcaaatcggattaaatccacaggatttaaatacacactggactgtgagcttcatcacatttatttccaagtacaaatggtagtaattacttatgaattaattaataaatattgaaagaatgaacgataaccagagtcaacagccaaaatgcatatctccacga

SEQ ID NO: 124829 - DNA, 601 bp, Human
tacaatttgaactataacacatcagatatttggtatcccacagatcgatttgctttctgacaaaaaaaaagaagttcttaaatggttttcttacttatcctcattacctacagatcttctaagttagaattttatttcttgtaaaatacagaaaaataacaattacaatgaaaacaatcaaatcggattaaatccacaggatttaaatacacactggactgtgagcttcatcacatttatttccaagtacaaatggtagtaattacttatgaattaattaataaatattgaaagaatgaaygataaccagagtcaacagccaaaatgcatatctccacgatgaacaaaggcatgaagattcatattgaactatgtttactgaattcccagtgtgtttcagacacaatattaagcactttcacatttactccttttatgacttaatgagtgttacaatctgatttcagacatgagtagcctgaggtacaaatagttaagtaatttacccaagaagtgacaaccagatgtgttaactcaaagcccaaggttctttgctaaagtttttaccaaatgtatctaatcataacaaatacctaagtgc

SEQ ID NO: 124830 - DNA, 601 bp, Human
agtttgtgtatgtaagtatttggggcatcagtggctaaaggcacattaaaaatcaaaagtgtctgcaaacgtgaaaaagggacaaataacaatacaggcaaattgttaagatgttatgaaccagttaaataaagttactattagattaggaagagaaatgttagtagaatactaacattctaatcttacatggacattgtctcagtgtggggtgatagtccactcacatacctcatgagaagatatgatgtcacttttattttaccaggtttcttttttctaaaacaaagacattgaaatyggttctgatcactatattttagaacatagcctccttcttttctctgccgtcctggctcgtctctttttttaacacactcaagagatttagtctttctttgccaccaaccagaaaaagacatgttttacttattttcaaactctctgaacaagtgctgagaacttcaggaatggtctctactgcgtctatcaatgaacagaatgagaaacagcgtgtatgctttctacaccaaactttagtcacttgacttttgctcgtgtgtgtgtgtatatgtgtgtgtgtgtatattgtggggggtgg

SEQ ID NO: 124831 - DNA, 601 bp, Human
ggttgttcagtttccatgtagttgagcagtgggagttggttgttcttaaagtactccttacttgtctttgctggaccctctcagatgctcctcactatctccagcaaaagaagcacctctgtgcaattcacttttttgaaaaattaataaacatttttagcaccactttagatttacaaaataattgagcaaatagtacatagagttctgtgcactcaccaaccccccagacacaatttcctctattgttattttgcataagtatggcatacttgttacaattataaaccaatactgatayattattattaaccatttattctttgtgttgtactattctataggttttgacaaatctgtaatgatgtgtatctgtcattacagtattgtacagaatagtttcacttccctaacaattccctgcccttcaccccttcatcctcttcctccactccaaacccatggcaactaatgatttttttaattatctttgtagttttgccctttgaaaaatattatgtagctggaatcaaactgtcttgtttcactcagtaatatccatttaagtttccaacatatattttcgtggcttaatagctct

SEQ ID NO: 124832 - DNA, 601 bp, Human
ccccccagacacaatttcctctattgttattttgcataagtatggcatacttgttacaattataaaccaatactgatatattattattaaccatttattctttgtgttgtactattctataggttttgacaaatctgtaatgatgtgtatctgtcattacagtattgtacagaatagtttcacttccctaacaattccctgcccttcaccccttcatcctcttcctccactccaaacccatggcaactaatgatttttttaattatctttgtagttttgccctttgaaaaatattatgtarctggaatcaaactgtcttgtttcactcagtaatatccatttaagtttccaacatatattttcgtggcttaatagctctttttatattgccaaataatatttcaaagcacaaatgtaccacagttggtttgtctgttcacctgttgaaggacatcttagttgtttccagttttgggtaattatgaatgaagttgccataaatatttgtgtgcacgttgtcatgtggacataagttttcagttcaatggtaaatacctaggcacacaattgttaggtggtttggtaagactatgggtagctt

SEQ ID NO: 124833 - DNA, 601 bp, Human
tacagtattgtacagaatagtttcacttccctaacaattccctgcccttcaccccttcatcctcttcctccactccaaacccatggcaactaatgatttttttaattatctttgtagttttgccctttgaaaaatattatgtagctggaatcaaactgtcttgtttcactcagtaatatccatttaagtttccaacatatattttcgtggcttaatagctctttttatattgccaaataatatttcaaagcacaaatgtaccacagttggtttgtctgttcacctgttgaaggacatcttmgttgtttccagttttgggtaattatgaatgaagttgccataaatatttgtgtgcacgttgtcatgtggacataagttttcagttcaatggtaaatacctaggcacacaattgttaggtggtttggtaagactatgggtagctttgtaagaaactgtcaaactgccttccaaagcgggtgtaccattttgcattcctagcagcaataagcaaacattccatttgttctgtatcctctccagcatttggtattatcagttttttaagtaggtttatagtggcacctcattgcttttaatttg

SEQ ID NO: 124834 - DNA, 601 bp, Human
tagtctgtgtctaggaatacagtgtctggtgtccaggaatcatagccgggtcagatgtccttaaggcaaaaaaaaaagaaagagagcagaaaacaaagatgctacaagtatagccccaaaccaaaagtgagaaaacatagagagaattcctggtgactctttaaaatgttcagatctggcctgtccctgggtttttccaccttcgcaggtgatttatgtggtagagaaaattcctagctaataacttaactcatttaattcccaatgggtgtctcatcatatacaagaatcacttgggggycttttccaaaatatatatcccccacaatctctggttcattctctttatcccaaatatgaaaaatcagacccagcatggtggctcatgcctgtaattccagccctttgggagggcaaggcaagcggatcacttggggccagaagttagagaccagcctggacaacatagcaagagtctgtccctacaaaaaatgtaaaaattagccaggcatggtggtgcacacccacagtcccagatactcaggaggctgagatgggagtatcccctgagtctgggggtttgaggctgcagtgagctaca

SEQ ID NO: 124835 - DNA, 601 bp, Human
aaaaaaaagaaagagagcagaaaacaaagatgctacaagtatagccccaaaccaaaagtgagaaaacatagagagaattcctggtgactctttaaaatgttcagatctggcctgtccctgggtttttccaccttcgcaggtgatttatgtggtagagaaaattcctagctaataacttaactcatttaattcccaatgggtgtctcatcatatacaagaatcacttgggggccttttccaaaatatatatcccccacaatctctggttcattctctttatcccaaatatgaaaaatcagacccagcatggtggctcatgcctgtaattccagccctttgggagggcaaggcaagcggatcacttggggccagaagttagagaccagcctggacaacatagcaagagtctgtccctacaaaaaatgtaaaaattagccaggcatggtggtgcacacccacagtcccagatactcaggaggctgagatgggagtatcccctgagtctgggggtttgaggctgcagtgagctacaataacactgcactccagcctagatgacaaagtgagaccctgtctcaaaaaacattaatattgcttattg

SEQ ID NO: 124836 - DNA, 601 bp, Human
atcccctgagtctgggggtttgaggctgcagtgagctacaataacactgcactccagcctagatgacaaagtgagaccctgtctcaaaaaacattaatattgcttattgcctcttttataagaaggagtatatcaaatctcgtggttgtactgaaataaataaaacacttagaaccactactttaaggagttataaaaattctcctttagacaccatagaaaacaaagtatgatcttgtccctctcttcaatggatttaaaatgcccagaatataggaatggccaagttgaattgtaagasttggaagggtgagaattgagagccataagaacaaacacagtaaaaatgttacctccaaccagaacgtacgtgaaaagtctgttattattaccattcttaatgtatgcttttaagagttaaggtattttgttgaatcaatgtgatgcattttctagttaactcattagctggattagtttatataatcttaacacctgctgttactagcggaggttctgagggggcagaactaaaaatgtgtgtgttttgacatgcaggaagaagtgaaaacatggtagttttgtgcaaagttgtggcagg

SEQ ID NO: 124837 - DNA, 601 bp, Human
aatattgcttattgcctcttttataagaaggagtatatcaaatctcgtggttgtactgaaataaataaaacacttagaaccactactttaaggagttataaaaattctcctttagacaccatagaaaacaaagtatgatcttgtccctctcttcaatggatttaaaatgcccagaatataggaatggccaagttgaattgtaagagttggaagggtgagaattgagagccataagaacaaacacagtaaaaatgttacctccaaccagaacgtacgtgaaaagtctgttattattaccatkcttaatgtatgcttttaagagttaaggtattttgttgaatcaatgtgatgcattttctagttaactcattagctggattagtttatataatcttaacacctgctgttactagcggaggttctgagggggcagaactaaaaatgtgtgtgttttgacatgcaggaagaagtgaaaacatggtagttttgtgcaaagttgtggcagggaactctaaacaaagaaggggttttcagggggagcttgggggagagaattgccatcttcaaagagggagagaaattttgtttattccataattgt

SEQ ID NO: 124838 - DNA, 601 bp, Human
ttttataaaacacatagtatagaccgggcatggtggctcacacctgtaatcccagcactttgggaggccaaagcaggctgatcacaaagtcaggagatcgagaccatcctggccaacatggtgaaaccccgtctctactaaaaatacaaaaattagctgggcatggtggcacacaccggtagtcccagctgctggggaggctgaggtgggagaatcgcttgagcaggggaggcggaggttgcagtgagctgagatcgcgccactccactccagcctggcaacagagcaagactccatctcaaaaaaaaaaaaaaaagtataaactataaagctgcagctcagaagcagtttatttccttacatgagagaaaatgaaaagaattagtattttaaatgacttaaatttacctttacctatcataaacctcggatgatttattatattgcaataagttaaaatggtcacagatttccaaactgataacccctttccacacacagctatacacatataccattttaagtgacttatttctctttaaaaatgttgttaagatgtttatagttcttcaggattacatgttgagtctggattataaat

SEQ ID NO: 124839 - DNA, 601 bp, Human
ataaactatggaaatcccttctacctagagcctaagacatagacaatgccctgacactttctgtctttatgtcagtcagtgtggattctgggcctctggtcgcactccctctagtgaaattcaaggctgtatagacacacacaaaacaagaaacttccaaattttaaagaaatgtgaataattggcatgcatttagtataaagggattttgtgagtgattagattctttaccttttctctaattcccaatccatctaaacttgtcctgcagaaaagtacacctataaaacaaatttgaccaaaaaaaaaaaaaaaacagaatctgacctgaaacccttcagtttataggtagcttccaaagctacagagacgaggtttccaaaatttttctattaactgatttttttttgttttacttgttttacttggctcactaaccagatatatttactcctaagataaatttatagcaatgggtacttctgtataatcaaggcaaataaattaagagagaggattaagtagtttttgatacttatttcgtgtaattatatgggaatctgagttgatgactttgcacttcatttctaccatgtggcag

SEQ ID NO: 124840 - DNA, 601 bp, Human
cgcactccctctagtgaaattcaaggctgtatagacacacacaaaacaagaaacttccaaattttaaagaaatgtgaataattggcatgcatttagtataaagggattttgtgagtgattagattctttaccttttctctaattcccaatccatctaaacttgtcctgcagaaaagtacacctataaaacaaatttgaccaaaaaaaaaaaaaaaacagaatctgacctgaaacccttcagtttataggtagcttccaaagctacagagacgaggtttccaaaatttttctattaactgatttttttttgttttacttgttttacttggctcactaaccagatatatttactcctaagataaatttatagcaatgggtacttctgtataatcaaggcaaataaattaagagagaggattaagtagtttttgatacttatttcgtgtaattatatgggaatctgagttgatgactttgcacttcatttctaccatgtggcagtaggtagcactttaattcgcagtgtccgaaaagctccattaataattgtgcaaagagataagccatagggtatttgattttgttacttcttcctacaata

SEQ ID NO: 124841 - DNA, 601 bp, Human
gagaagaaggggctgtagcagaagagaaaacaaatgattctctctaagagaaaaagctgcctcttcactatatcatacagagaaagtttggtctgaaccttgattagaaagggtgccttatgccaagtaaattatgctaataccagggaagctgaataggttttacctcctattgataagtattgcctagtatgtagtattgaatgattcaaaagccctgaaattatggttgattacctatgtctagtaaaggctcaagaatgaaagacacggttatttctgagtcagaagaatccctacmttcttctgattcagcaagtattcttaaagtgctctagaaattgtaccaatagccaaagtgaggtgccctcatacctaactgctttctacagccccctacttccctcagagataaagtggcatcttcattttggtatatgcatttgctctctgtcaattaggctccaagaatgtttatttcatcatacctggctgcttaatgtggccactaggaaatagcttaaaataactgttgaaaacactggattttcattctctcctgaaatttcactgctatatcggtttattagctatcgaatat

SEQ ID NO: 124842 - DNA, 601 bp, Human
acatctctgaagctgaaaagagttaaattgagaccagtttcattggtaagcagcaaaatgtaaatatagagaactttacaaccgaaggtagtagataaaatgattttggaaatttatagaaagtcatagattgatagtcagttgggctctcttgaaaccaaaaacacatgtccatgtgctatgttaatagaaatctttgaaggagctatgactttactttttagttatatccaaaacttctattccatttagaataccacaattcaaataaatataaaatgatttccgatactttcacatwaaattgttctttagtattatgggatcaaaatgagggttaagagcatatcatgagcaaataccacatcattgaatatttataagcacttgcaatgtatacagaattgtgctggtttctttaagaggtagcagtttaacaaaaggctgtctttatactcaagtgaatgtcattaacagaataactcaagtttgagaggggcagacagttaaaatatatgccagtctgattaatatgtagtgataagaagaatgctaatatctgaaatattaacatggcctttgttaaaatagttctatgcat

SEQ ID NO: 124843 - DNA, 601 bp, Human
ccctacaagttactgtagaattcggtacatagacaaactggaaatgtcactgcaattagtaagcaaataaatttgtctatgagaatcagaatctaataaaggtagtgtctctacaaacaaagttaaaaacaaccatctaaataattcaagaccatgtaaaaccaaccactaagatggaaaggggagtttagtctgaatgagtcagattgtttgtcttcacacagtaaaaattactagataattatcactttgttttcctacttaggcagtatcagaaagccagaatgtaggggttggttgyttggttggtttgttgtgttttgttttgttttttgagacagagtctccctctgtcacccaggctggagtacagtggctcagtctcggctcactgcaatttctgcctcctgggttcaagggattctcctgcctcagcctcccgagtagctgggaagacaaagcacacaccaccacgcccacaagcacataccaccatactcggctaattctgtgtgtgtgtgtgtgtgtgtgtgtatttttagtagagacagggtttcaccacgttagccaggatgatctcgatctcctgacctcgtgatct

SEQ ID NO: 124844 - DNA, 601 bp, Human
tttgtcttcacacagtaaaaattactagataattatcactttgttttcctacttaggcagtatcagaaagccagaatgtaggggttggttgcttggttggtttgttgtgttttgttttgttttttgagacagagtctccctctgtcacccaggctggagtacagtggctcagtctcggctcactgcaatttctgcctcctgggttcaagggattctcctgcctcagcctcccgagtagctgggaagacaaagcacacaccaccacgcccacaagcacataccaccatactcggctaattcggtgtgtgtgtgtgtgtgtgtgtgtatttttagtagagacagggtttcaccacgttagccaggatgatctcgatctcctgacctcgtgatctgcccgccttggcctcccaaagtgctgggattacaggtgcaagccaccgcacccagccctagaatgtaggtttttaagaaggattaagaagatacagaaagagtttggcttcttcaaacccagccctcacatccacaatccagcaggcaagaaggaggaaaacatgccccaatacccccaagtgaatgcgacacttgcatttacttcccc

SEQ ID NO: 124845 - DNA, 601 bp, Human
tacttaggcagtatcagaaagccagaatgtaggggttggttgcttggttggtttgttgtgttttgttttgttttttgagacagagtctccctctgtcacccaggctggagtacagtggctcagtctcggctcactgcaatttctgcctcctgggttcaagggattctcctgcctcagcctcccgagtagctgggaagacaaagcacacaccaccacgcccacaagcacataccaccatactcggctaattctgtgtgtgtgtgtgtgtgtgtgtgtatttttagtagagacagggtttcaycacgttagccaggatgatctcgatctcctgacctcgtgatctgcccgccttggcctcccaaagtgctgggattacaggtgcaagccaccgcacccagccctagaatgtaggtttttaagaaggattaagaagatacagaaagagtttggcttcttcaaacccagccctcacatccacaatccagcaggcaagaaggaggaaaacatgccccaatacccccaagtgaatgcgacacttgcatttacttccccttaatcagaacttaatcacctgcacatacctgccagtgagggggcttag

SEQ ID NO: 124846 - DNA, 601 bp, Human
ctatctgtaaagaacagatgctatctgttgaatttgggttctcactgaaggaaaaatgttattggtataaacagggaaatttcggcatgtattcaaagttgatgctattcaaagtgaaattgctgaaggatatagaaacagtgtggaataaccaaacgaacaggggcccaactcttcctctaagataaatggggacaaactttaagcaaacagtatctcagcttccttcttggtgaagtcagggcgatagaccagaagaccgccaaggctcttggaaatctgaattcaagaattccatatrggattctgaattacagcaatgaaaagagtgtagtctggaatcttatagaacatgagagcaacaaataagctagtcataggcatgattgcatcagaaagctgatcctctttccttcgattcctaaggagcgatcttcaagagtgccctgccttaggcaagctctcttctgacccactgcaactttgttttactccatcgaactcaggagtctattaaatgtttaaccagttaatctcatcaactaactgccataaaaatattgaagtaggtttaacacattactctcctgggtaacagggt

SEQ ID NO: 124847 - DNA, 601 bp, Human
atgtttaaccagttaatctcatcaactaactgccataaaaatattgaagtaggtttaacacattactctcctgggtaacagggttgcatgttaacagtaggctagaagagctaagcaaacagtggcgatgtgatcccaggcttcactgcaatatttagtgtactggagaaagcaggctagagctcaggaaccttcaagggctctttacatttcttcaagggctctgcccaaagaggtggcagagcagagcaattaagaactgtgctacctgagtttaaatcctggctctttggcttactayttaagctggagcaagtttctcaatcccagttccttcatctttacaagggggaaagcattagcttgtagctcacagggacattgtaaagcttaaatgagttaatacgtgtaaaccatagcaaggtttggcactcaggaagtgctcaataactcttagctattactgttttatgctacatgctcggtcaccttctctgtctaacctgcaaataggagcctaaagcctacaagtgttttaaattaagctgctgtgaacacataatgaaatacatggccatattcttggctacttgtaccatct

SEQ ID NO: 124848 - DNA, 601 bp, Human
gcattgtcaactaatagggacggtcatttaaaatagtcattcaaacttttcaagagggaaaaggcaccttcctttgcatttatactacttaatatctaagttcctgagtctactattaatttgagagatatgtttgaatccttataaaacaaaaactcacaacagtggagcaatcttctggcctatattcaaaaggggagtcttctaagaattaataaatcataacttgtttatgatttagcaaccacattaaatattatggaaagagaactacagccaaaccatcaggtctgcgttaccmtgaacaagtcatttttcctctctgaccctgagtctattctgtgaactgacagaactggactagagaatctcaaaatttatccagacactctgcacagacattgacatgcaaaataaactcgcgtatattttactcaattatttcaagatacctctagtctttagatatctttaaatatgtttcaaattttggaggatttttttcatcagacatttagggatgcaaatgggctgtcctgccagtgctctcaaatttaggagacccctaagcctaaatagtggtttggttcacatttcatta

SEQ ID NO: 124849 - DNA, 601 bp, Human
aacccattcttttaaccgttatactgtatttcctcccaccaatggcagctcctcacaagttgattgccattctcaccacaacacaggtttggtgtttgctgcctacctgacctccttctaggcactacaaactggagctttcagagtatgcacgctgtcattttgacttgatttgattaatgggcatctaaaccaatctggttggtggcaagctgccatagaaaaaaaccctatgcatataaaacagaaaatcagattttgccacatcctgactgggtgaatttgagattatgtcacaccaaaaaaaaaaaaatttaacatcacccttggctaccagaagtcctgatctgcttcctctggattctaagagaataatgaaatgtatgcaactaggtcattatgcttctgatattgggtcatcttaaaagcagatcgcttttaaaaaccagtttttagaccagtccatatagactaagatctcatgagtttgaaatttttgataaaaacacacatgtaagaaccataacacaactatatgagcaactgcatgcagatcccaaaaagtcagtttttgaatattagcagagtcaggaatactctc

SEQ ID NO: 124850 - DNA, 601 bp, Human
tgttcataaaatgaagataggttcttttttttttttttcgacggagtctgcctgtcacccaggctggagtgcagtggtgcgatcttggctcactgcaacctccacctaccaggttcaagtgattctcctgcctcagcatctcaagtagctgggattacaggcctggctaacttttgtgtttttagtagagacagggtttcaccatgttgactaggctggtcttgaactcctgacctcaggtaacacacccgcctcagcctcccaaaagtgctgatattacaggcatgagccaccatgcccrgcagaagatattcttgactactgagggaccaagctacctaagtcacctgggtcattggagagggtcttacttgactcttctgaaattttagcaccaccttgttctgtgccaaccacagaatatctcccaaagcctgcttatttccaaaatcttgctttctatctcaaaaaggaattctcccagtttggggccaatttgtcatattcctaggacctctaccatggttacatctatagtattaaccagtctatgactatgaattattgtagaggatacctggagccacggactgtacagtta

SEQ ID NO: 124851 - DNA, 601 bp, Human
ggagtgcagtggtgcgatcttggctcactgcaacctccacctaccaggttcaagtgattctcctgcctcagcatctcaagtagctgggattacaggcctggctaacttttgtgtttttagtagagacagggtttcaccatgttgactaggctggtcttgaactcctgacctcaggtaacacacccgcctcagcctcccaaaagtgctgatattacaggcatgagccaccatgcccggcagaagatattcttgactactgagggaccaagctacctaagtcacctgggtcattggagagggwcttacttgactcttctgaaattttagcaccaccttgttctgtgccaaccacagaatatctcccaaagcctgcttatttccaaaatcttgctttctatctcaaaaaggaattctcccagtttggggccaatttgtcatattcctaggacctctaccatggttacatctatagtattaaccagtctatgactatgaattattgtagaggatacctggagccacggactgtacagttaatccctagggttatttgaatccatatctttctaggtatcctctaataaccccgcaaagatggtct

SEQ ID NO: 124852 - DNA, 601 bp, Human
aaattttagcaccaccttgttctgtgccaaccacagaatatctcccaaagcctgcttatttccaaaatcttgctttctatctcaaaaaggaattctcccagtttggggccaatttgtcatattcctaggacctctaccatggttacatctatagtattaaccagtctatgactatgaattattgtagaggatacctggagccacggactgtacagttaatccctagggttatttgaatccatatctttctaggtatcctctaataaccccgcaaagatggtctacaatcacctagtaacaygtatagtgcttccccacaactgcaataaatggtagaatgtatacaaagcactttgtaaccagccagtttccaaacaaatatatgatttacatcacaaacaacacacacatatatgctcaattcaagtactcatagacatacatatctacttacagtacatgtgtgcatatcagtcactacaggcttgtgcctctgtcaatacagttttcccaatgtgctagcaattcattagactacattcatctaaagcaccgtttttattttgagttgaaactatgcaaaatttatcttcctcagtgt

SEQ ID NO: 124853 - DNA, 601 bp, Human
catcacaaacaacacacacatatatgctcaattcaagtactcatagacatacatatctacttacagtacatgtgtgcatatcagtcactacaggcttgtgcctctgtcaatacagttttcccaatgtgctagcaattcattagactacattcatctaaagcaccgtttttattttgagttgaaactatgcaaaatttatcttcctcagtgtatttctcctggagatactagttaggtattacattttgccttagaattcagaacctcataagaagattctaaaatctaccaccaccaccamcaacaacaaaatcttattgagaagctactggaaagccaactccatttcaaaagccatagtaattataaaatattctacagtaagcaaaaggaaaggagatttcaggaggttctgcctgtgacttggaggagcagggaatgtttctacttatgaagtgacctcagaatcagtccctaatgacagtttccacattaaatagtatttcaagacattatactgcagagaagccatacgtttaaggcattgcaagctttgacattggcttttagagctctgaattacttttccactggctggggt

SEQ ID NO: 124854 - DNA, 601 bp, Human
tcacaaggttgatggggattagcatactttggtgtgattagcgtggtatgcaaccaatttaacaggtgctctctgctaaccaatacaggatttatttctgtgatgtttgcaaatgtggggaaacctgttagaaattgtcccaactggaaaacaatttttgttttattttatttattttttaaggtaagctttctcttgaaaacataatcttaatactgaggagaatgaatttgctatttaaatttgaggcatgtttatgaggcctactggggaactgctatttggttttcagcaagatttrttctggaacaatttgacacaataaggaaccatcaaaaaccactattttaaagctttagtcaattaaatgcattatttaaattaccatgtactttttaaaatttagggtgttagaaaatataaaaatgaccttcaaagattacttctaaattagttcttcctaaaggtcagaaatgcattgactaaacatccaaaagggtggtgaggtgggggagagattgcatctgtttaaattaacaatcaatccatatgtcaacaaaattcaaatggtgaaaatcaatcctagtgatggccctgagca

SEQ ID NO: 124855 - DNA, 601 bp, Human
aaagaaaattctcatgtcagccaggcgcagtggctcacacctgtaatcccagcactttgggagcccaaggcaggtggatcacatgaggtcaggagttcgaggccagcctggccaacatggagaaaccctgtctccactaaaaatacaaaaattatccaggtgtggtgacacgtgcctgtaatcccagcttcttgggaggctgaggcacgagaattgcttgaacctgggaggcagaggttgcagtgagccaagattgcaccactgcacttcagcctgggtgacagagtgggactctgtctcaaaaaaaaaaaaaaggaaagaaaattctcatgtagcctctccagactcaagttgtcaagcttcacacagaccttagaaaacatcgctgatgccaaatcctcttgcagatggaggatcaaaccccaaaaaactgagttaaataggttaagcgacttccccaaaagcacaaactaaaagactgaaagggaccatgttggcttccttggtcttactatataacccccttaaaactcatcaactgcaggacatttaagtaaattaatctttctgactgttctgtgaaggagatcttttactgtaa

SEQ ID NO: 124856 - DNA, 601 bp, Human
ctttcagctttactccctgctttcttaccttttattagaaaatgctatcttacttgaagccaggcgcggtggctcactttgggaggccgaggcgggcagatcatctgaggccaggagtttgagaccagactggccaacatggtgaaacttcatctctactaaaagatacaaaaattagccaagtgtggtggctcgtgcctgtagtcccagctagttgcacgactgaggaaggagaatcccttaagccagggaagcagaggttgcagtgagccaagatggcaccactgcactccagctgggygacagatcaagactccaactcaaaagaaaaaaaatgctatcttatttgagcttcctaaaatttgagaaaatgttaatcactttattaatctattcattcaatctttgcccagctattactattacttgcattaatctgattttttaattttttttccatttcatagtttattgaattgtgttttattatatttttattatttttaaaagttagcatagtatcttacattttgtcaacatattttttctgaagaactctaggagcaaattggtcttagaatattcaggtctgcatgaagta

SEQ ID NO: 124857 - DNA, 601 bp, Human
ctcaaaagaaaaaaaatgctatcttatttgagcttcctaaaatttgagaaaatgttaatcactttattaatctattcattcaatctttgcccagctattactattacttgcattaatctgattttttaattttttttccatttcatagtttattgaattgtgttttattatatttttattatttttaaaagttagcatagtatcttacattttgtcaacatattttttctgaagaactctaggagcaaattggtcttagaatattcaggtctgcatgaagtaaaaatcagttatgccattygctgatatgtcagttggcaatagaatttgcatgtaaaggagattgaaagctatcctgattaattgagggggaagtaatgagtggttggaccatgaactgagccaacaaataagttataaattattgatgcccccaatttctgcttaaaaaaacttgaggaaacgaaatgctaaatctcctactcttcctccgaatctacagatcactaatagattactgttttaagcttaaatatatcaatggttttattctgacagcagaattctatttatgctaaaaataatgatctctaaataggga

SEQ ID NO: 124858 - DNA, 601 bp, Human
tgacttgtttccaaactttgcttaactgtgtggatcaatatgtaagagaagttatttttcatatatttctttaaacattgcttcaaaatattattcttacacctttttacatcgtctgatataattgaccttttaaaactctatttacttgtataaaccttatcacgcacatctcaatcatgctgtaaatccttacattggactttctttcttacttctttgatttattaatagatcacaatgaagagtattgaggatggggtaggatatgtagaagtcctttacagtctcaggggagagagagagagagagagagagagagagagagagagtaaggagactcagctaatttctaggattatttagatacagtccatttggaaatggaggaaggaggttaggtccagccccagggttctataattattgcacacactattgagaattaccatcaattttattctagttttcccttcaaaaatttaatttctctcttcttattgcacacatcaaaagtaaagattacccttaagacttctagggaggtttgacaattttaacaatattttaaaatattttttcatcaaagtgatgcagaagt

SEQ ID NO: 124859 - DNA, 601 bp, Human
cacatcaaaagtaaagattacccttaagacttctagggaggtttgacaattttaacaatattttaaaatattttttcatcaaagtgatgcagaagtatatttaccaatatcaattattttaaaactttctgagacttctttttatttgattcacacattgtcatttctatcccataaagttgctcaatatataaagttataaattctgttaattgaatataaatcttggattccaataagccttccacaaagaatagtatcagggtcaaagttgaaaacaaaacagcaacttttggggggraaaagttttatgtgtttatacatgtgagaatatagaagggaaaggaagagaaagagagaaagtgatagcaagtgattgttcatgaaattaacaaatagaaaatgaggaatgtggatttaatattaacctgcaatacacacccaatttttccttgcctgcatcaatgttcactttttgccttatcatgattaaaaggaatgactggacagactgagcatataaaattgtttttctctttcctctatatcattatattaactatcaaagcagcccacatactcttagtaaattgaacaaacc

SEQ ID NO: 124860 - DNA, 601 bp, Human
tttaccaatatcaattattttaaaactttctgagacttctttttatttgattcacacattgtcatttctatcccataaagttgctcaatatataaagttataaattctgttaattgaatataaatcttggattccaataagccttccacaaagaatagtatcagggtcaaagttgaaaacaaaacagcaacttttggggggaaaaagttttatgtgtttatacatgtgagaatatagaagggaaaggaagagaaagagagaaagtgatagcaagtgattgttcatgaaattaacaaatagraaatgaggaatgtggatttaatattaacctgcaatacacacccaatttttccttgcctgcatcaatgttcactttttgccttatcatgattaaaaggaatgactggacagactgagcatataaaattgtttttctctttcctctatatcattatattaactatcaaagcagcccacatactcttagtaaattgaacaaacctctgtctcactgaacacatgtagggaatcttaactactgagaagatgtagctgcattttcattacaagttttctttcacacccacttaagaaatctcca

SEQ ID NO: 124861 - DNA, 601 bp, Human
gtaggggatggtggctcacgcctgtaatcccagcactttgggagactgaagcaggtggatcacttaaggtcaggagtttgggaccagcctggccaaggtgaggaaaccctgtctctactaaaaatacaaaaattatccaggtgtggtggtgggcacctgtaatcacagctactcgggaggctgaggcatgagaatcacttgaacctgggaggtggaggttgcagtgagccaagatcgtgccactgccatccagccggggcaacacagtgagactcggtctcaaaaaaaaaaaaaaaaaaaraaaagaaaagaaaagaaaagccaaaatctttgtttttttaatctgtaccttgacctgatatagggtaccttctcaaaaatatttggtgaatgaatatatgaaggcattatgctgggctctgctgtccagttcttaaggacctcataatcttaaagggtgtgggacaaacagagggattcaaataaccacagtatgagtctcactggaacaagggctcaattgaggcagaatcaaagtgtgatggcagccagcccttcttcctgaggacatggttggcagggaaactttcaccaggcatga

SEQ ID NO: 124862 - DNA, 601 bp, Human
tatgtttttttagattctaagtaattagactgccccggtgaaattgaaaaatgatgagccatgacataccaatctattttaatatgatggatagagtaatttttaccctttttataccataggagaatgttcaattaaactttgaatataggattttttaaagaaaggattttgtaatatcataagcagtgcaagtctagaaatgctcagtgctgaatccaatagagtagagctatcatcagaagttagcatttggtagcatcttctacatgtattattttattttgattgaaaaactctkgaaatatcttctttctgcaggatggattgcagaattaagtatctccactgaattgtatctccattggagtcatcatattgctcccctgatgacaaactatgtagactgtcctaataaggataaccggggctaccatttattcagtgtttccaacgtgccaggcaatggtctgtaggagatttttgtttagaaaatttattagaagcttaagtttacaattttttgttctctacatcactaaaatttaatttactttgtaccctatataccagaagcttagtgagatagaaaggagacagc

SEQ ID NO: 124863 - DNA, 601 bp, Human
ccctttttataccataggagaatgttcaattaaactttgaatataggattttttaaagaaaggattttgtaatatcataagcagtgcaagtctagaaatgctcagtgctgaatccaatagagtagagctatcatcagaagttagcatttggtagcatcttctacatgtattattttattttgattgaaaaactcttgaaatatcttctttctgcaggatggattgcagaattaagtatctccactgaattgtatctccattggagtcatcatattgctcccctgatgacaaactatgtagrctgtcctaataaggataaccggggctaccatttattcagtgtttccaacgtgccaggcaatggtctgtaggagatttttgtttagaaaatttattagaagcttaagtttacaattttttgttctctacatcactaaaatttaatttactttgtaccctatataccagaagcttagtgagatagaaaggagacagccaaatgctgctttgagggctgtcctggagaaatggggttggccatttagaaagaacagaacttacatttgaaatggcgcaacctgaaatacaagaaaattttatt

SEQ ID NO: 124864 - DNA, 601 bp, Human
atgctcagtgctgaatccaatagagtagagctatcatcagaagttagcatttggtagcatcttctacatgtattattttattttgattgaaaaactcttgaaatatcttctttctgcaggatggattgcagaattaagtatctccactgaattgtatctccattggagtcatcatattgctcccctgatgacaaactatgtagactgtcctaataaggataaccggggctaccatttattcagtgtttccaacgtgccaggcaatggtctgtaggagatttttgtttagaaaatttattaraagcttaagtttacaattttttgttctctacatcactaaaatttaatttactttgtaccctatataccagaagcttagtgagatagaaaggagacagccaaatgctgctttgagggctgtcctggagaaatggggttggccatttagaaagaacagaacttacatttgaaatggcgcaacctgaaatacaagaaaattttattttcaactagtgttcaactagcaggtgggattacaagggaccacctcctagctctagccaccttcaggggactcacagcaggcttgttttgttttgtt

SEQ ID NO: 124865 - DNA, 601 bp, Human
ccccaattacaaaatccaccagtagatggaactttaataaaatatataaatgtgtgtatatctaaataaatgtttacaatatgctgatttttctccaccagaacaactaaatctcagtacttttatataaatagggaaacaaaggcattgtgtcgctatggtcaataaaaattagaattaacacacatagatttctgtttctcatttcaaaaaataaactgaggactaaaaaatatttgggtgattctactgaacttaggtgaatgatttgatttgatgtaatgcctttttcctcggaatycttttttcctttttttttttttttttttttttttttgagacggagtctcactctgtcacccatgctggagtgcagtggcgcgatctcggctcactgcaagctccacctcccaggttcacgccattctcctgcctcagcctcccgagtagctgggactacaggcgcccccccaccacgcccagctaattttttgtatttttagtagagacagggtttcaccatgttagccaggatggtctcgatctccctgaccttgtgatccgcctgcctcagcctcccaaagtgctgggatttcaggcg

SEQ ID NO: 124866 - DNA, 601 bp, Human
aatccaccagtagatggaactttaataaaatatataaatgtgtgtatatctaaataaatgtttacaatatgctgatttttctccaccagaacaactaaatctcagtacttttatataaatagggaaacaaaggcattgtgtcgctatggtcaataaaaattagaattaacacacatagatttctgtttctcatttcaaaaaataaactgaggactaaaaaatatttgggtgattctactgaacttaggtgaatgatttgatttgatgtaatgcctttttcctcggaattcttttttcctttttttttttttttttttttttttttgagacggagtctcactctgtcacccatgctggagtgcagtggcgcgatctcggctcactgcaagctccacctcccaggttcacgccattctcctgcctcagcctcccgagtagctgggactacaggcgcccccccaccacgcccagctaattttttgtatttttagtagagacagggtttcaccatgttagccaggatggtctcgatctccctgaccttgtgatccgcctgcctcagcctcccaaagtgctgggatttcaggcgtgagccaccgcg

SEQ ID NO: 124867 - DNA, 601 bp, Human
aaggatgtggtcagcccttagcactgtgttggttctagaaaatcctccttccgatatgcagctcgtttctaccacccacattgtcagccaactcccaaaggaaactctcagtaataaaaatgccctgatactcattcagttcccctttgaagtcaaatacaattttgcttattgaaagtggagctattaattgcggaggttgaaatacccagcttgacaggcagtgcaagtaattagcgtgtcaaggtggctgaattgctgagccggcgctaaaacgtactccttgccttctgtgaaaggaaaaaaaaaaaatgcaggctagctgagttctgcctctgtggtcatttccaatcattttaatgaggatagcctgcagccagtatacaccaggagaaactccacggtactctaatctttccctacccttccctaacacactgtctgacacacacaattgctacaatcgctgcggaagtagctcaagaaactctgcatatgactgactttgcggatgttattaccaaacaggaaaaagaaattatttgtctttcttgggcccctttgaaaatagaaaataagaaccatgatggtgtttatgcga

SEQ ID NO: 124868 - DNA, 601 bp, Human
gaaactccacggtactctaatctttccctacccttccctaacacactgtctgacacacacaattgctacaatcgctgcggaagtagctcaagaaactctgcatatgactgactttgcggatgttattaccaaacaggaaaaagaaattatttgtctttcttgggcccctttgaaaatagaaaataagaaccatgatggtgtttatgcgaattttcatggtcctaggccataataataataataacatactcataagtaaaataacatacatatgtgtttatgtttccctatgacatctcargtaatcttgtgagatccatattattatttccatcttacagaggaggaggaaaagattcagagaagtgaagagctacattcaatattacaaaaccagtacacggcaaagttggcatttgaacttgggccaaatataactgttattctaagatcccttctttaccaaatgactcaagttgatgaaaaccttgactgaagtgtcaacttgatgtaccagtcatctaaaccactgcaaaatttaactaaaacaacaagaattatttctttcgctctcaaagctacaatttgggcagggctcagt

SEQ ID NO: 124869 - DNA, 601 bp, Human
gagacataaagataaagtgatggcataagacaggtaccaaagttgtaggctaatcaccagtatgatgctctcatgcaaatctgtggctgctgagtctggctgttaacttcaactgcactatggggcaaaagcccatttctccaaaacatgggaagctatgcagcagtatttcctcaggatgttaataatgctcaaagggaaaaacagtggtagtaaacaaattcattcaataaatatttgcttagcacctactatgtgccagaaacttttcttggtcctggagatgcaagagtgaatacartaatcatggctgcctatcactgcagacaaaatttctgccctcatttcctcaattgtgaattcaggaatcaaaactagctttaatattagtggaaaaatagagaaaaatgtattttcaaaaagtaatgtccagcttagccacctgtaaaatatattttctccttaattcctcatataagtatcaagaaaactttatttctaatatattaagttggtgcaaatatattaggtttttgccaatactttcaatggcaaaaactgcaattatttttgcaccaacctaatagttattttaggggaa

SEQ ID NO: 124870 - DNA, 601 bp, Human
tagtaaacaaattcattcaataaatatttgcttagcacctactatgtgccagaaacttttcttggtcctggagatgcaagagtgaatacagtaatcatggctgcctatcactgcagacaaaatttctgccctcatttcctcaattgtgaattcaggaatcaaaactagctttaatattagtggaaaaatagagaaaaatgtattttcaaaaagtaatgtccagcttagccacctgtaaaatatattttctccttaattcctcatataagtatcaagaaaactttatttctaatatattaarttggtgcaaatatattaggtttttgccaatactttcaatggcaaaaactgcaattatttttgcaccaacctaatagttattttaggggaaggaacttaagggatttctgtatgtgtgtgcctgtgtgtgtgtgtatgtgtctctctgtgtgttttaaagttcttgaaagtctcttacctatatgcagtaataatttctttattattggatatatatgtgtatttttattttatttttatttttattttttactcataggttgcttggaagtggttttagtgagaatgtgccgtgccttca

SEQ ID NO: 124871 - DNA, 601 bp, Human
gcatggtgacacacacctgtagtcccagctacttgggaggctgaggcaggaagattgcttgaccctgggagattgaggctacagtgagtcatcttcacaccactgcactacagcctgggtgacaaagcgagaccctgttaaaaaaaaaaaaggaaagaaataagaaataaccggaggctgatgctaaaagagtaaaagagctgggctgaattatagatcattctttgtgaaatcagcttttttttttcaactttattgcatattgcatagacccctggtcatccatggtggtgacctcttrcgtttcttatgtcaatttatcatcatgagttaagatacttaattaaatgaggagctcctctacttgtttctcacccacagaagttaattcacaaagttctgggagcacagagttcatgccaacctgtccacagtgatcccagaccattcctgtgggaaggcactaacagagtcagtctttgtttggaagtgttatatatcatcacatccagtcatcagtgcatggcatggtaggaagaacattagcaaagatgggctgatgccaggaaaggttttaacgattgatagtgccatttgttcc

SEQ ID NO: 124872 - DNA, 601 bp, Human
ccacagaagttaattcacaaagttctgggagcacagagttcatgccaacctgtccacagtgatcccagaccattcctgtgggaaggcactaacagagtcagtctttgtttggaagtgttatatatcatcacatccagtcatcagtgcatggcatggtaggaagaacattagcaaagatgggctgatgccaggaaaggttttaacgattgatagtgccatttgttccatatcctgcccatggacaccaaagaaggccactgccctttcacctcttgtgctgttagttgatatggcagccaacaacaagtccatcggggctggcaatgtttcccttctacagttgatacacatccatgtcatctccaaggctagattttcaagaaaggaggaaaagccttggcaagcaacctcagtatatttccagcttcatcaaataaacattcaccagggatcagtgtagagatgcaacattattttgccaaaatacgcaacagctaagcaactgacctgtgagtcattcattagaaggtaataataaataaactctagctcctcagtgaaatttccaaggaaattgcgaaactgaagtgcatctcatctc

SEQ ID NO: 124873 - DNA, 601 bp, Human
tattgattatgagatttttcttactcttgccccatttcaagttcaagtatttttattccatttttcttcttcctttataggttctgatgacctagtgaatgaagcatttgactttgcaaagaatttgtgttccttgcagctgaccgaggaggagatcgctttgttctcatctgctgttctgatatctccaggtagggcagtctcagttctcttacctttttaaaaaacttgttttactatttttaacactgatgacacctgcctaagccaaagtgttcaggagaaactttaacagagctayattttctttaccaagtttttgatatttttggacagtgaaaagggaagtagcctcaagtttattaaaatgaccaattttggcccgaaagcaagagtagagcataggttaggggttattccagattcagatacgcagaatcattccttagcaaataaaggaagacaaatagtggcctgagttacagccaagttctattttgactttaagaataaagtacatagaaaataaatgtccagttggatgagacacagtagaaatgtacctaaatgaaagctccagaatggggacctacataagtaa

SEQ ID NO: 124874 - DNA, 601 bp, Human
ccttgcagctgaccgaggaggagatcgctttgttctcatctgctgttctgatatctccaggtagggcagtctcagttctcttacctttttaaaaaacttgttttactatttttaacactgatgacacctgcctaagccaaagtgttcaggagaaactttaacagagctatattttctttaccaagtttttgatatttttggacagtgaaaagggaagtagcctcaagtttattaaaatgaccaattttggcccgaaagcaagagtagagcataggttaggggttattccagattcagataygcagaatcattccttagcaaataaaggaagacaaatagtggcctgagttacagccaagttctattttgactttaagaataaagtacatagaaaataaatgtccagttggatgagacacagtagaaatgtacctaaatgaaagctccagaatggggacctacataagtaaaaggaacactttctactctttaaacacctcttgtgttggcatctttgcccaaattcatgttgaggtgctcacttcagacaaatgctggtgcctattttcttagcaatacatttgaccttgaacaatgcagg

SEQ ID NO: 124875 - DNA, 601 bp, Human
ttcctgttcattaagtggaagtggatcatcataaaggtcttcatcatggtcgtcttcatgctgagtaggctgaggagaaggaggaagaggagggtttggtctcgcagtcccagggtggcagaaacagaaggaaaatcttcatataacttgacctacacagttcaaacctatgttgtagaagggtcacctgtatcaggagtttttaaaaggaggtgaggacagcagaggggaaaatgactcatactgaagactgcccagtagaagaggaaaaacttcagacatggaggtggacattctggtrccagctctgtgaccaagtatctgtgtgatattaaacatttgacccctcagagccctagtttcctcatctataaaataagagggatggactccataataactaagacctctactagctctaaaatgcactgaaatgccaagttcttaaagaattcaaggtgtggcaatatttatggatcaactagaactgtagtgagtaaaatatttttttaaagtatatactaggcctggcatggtggctcacgcctgtaatcccaacacttcgggaggccgaggccagcggatcacctgaggtcaggag

SEQ ID NO: 124876 - DNA, 601 bp, Human
aggtgaggacagcagaggggaaaatgactcatactgaagactgcccagtagaagaggaaaaacttcagacatggaggtggacattctggtgccagctctgtgaccaagtatctgtgtgatattaaacatttgacccctcagagccctagtttcctcatctataaaataagagggatggactccataataactaagacctctactagctctaaaatgcactgaaatgccaagttcttaaagaattcaaggtgtggcaatatttatggatcaactagaactgtagtgagtaaaatattttttwaaagtatatactaggcctggcatggtggctcacgcctgtaatcccaacacttcgggaggccgaggccagcggatcacctgaggtcaggagtttgagagcagcctggctaacatggtgaaaccccatctctaccaaaaatacaaaaactagctggatatggtggcagatgcctgtaattccagctccttgggaagctgaggcaggagaatcacttgaacccaggaggcagaggttgcagtgagccgagattgtgccatttcactccagcctgggcaacaagaccgaaactctgtctcaaaa

SEQ ID NO: 124877 - DNA, 601 bp, Human
ttttaaagtatatactaggcctggcatggtggctcacgcctgtaatcccaacacttcgggaggccgaggccagcggatcacctgaggtcaggagtttgagagcagcctggctaacatggtgaaaccccatctctaccaaaaatacaaaaactagctggatatggtggcagatgcctgtaattccagctccttgggaagctgaggcaggagaatcacttgaacccaggaggcagaggttgcagtgagccgagattgtgccatttcactccagcctgggcaacaagaccgaaactctgtctcaaaaaaaaaaaaaaaaagtatatgccaacttaaaatataataataaataatataatcataataatataacaacaataatatagtaataaatacatgagtctctaaccagaatgagaattcagttacttcctcagctgttgtttggttacattttgggttaagggataacagcatcactgacaggtctctacagaaagaaaagcaaattcctgcctaatttttaaggtcaagagtctcatttcttctgttacccgtttatctgtagagaccagatgtcttttcttatatatgctctactata

SEQ ID NO: 124878 - DNA, 601 bp, Human
atgacatgtcttcagaagcaacttagaactaaataatatgaaatgggtctgaagcttggcacttatgtatgtgggtgaagcaaaacaaagttgatgttccctccacttacccactctttctttcatcagaccgagcctggcttatagaaccaaggaaagtccagaagcttcaggaaaaaatttattttgcacttcaacatgtgattcagaagaatcacctggatgatgagaccttggcaaaggtaggtccacagatcacagagccaccaccaccaaaagagagcacagtgagcaaaaaggmctgcttataaatcaagggaaatttctcagcagcaacaatttctgaaagttaccaaagactgcataaattgtgaggtatgcaatttaaaagagaggctagtgaattgtaatagattgcaagaagggctttcttatagagggatgatattgacagatctgaatccaagcttcaggaggacaaatcaatgaaaccaagggtgtttcatcagaagaacaagcactcaaagcaaggaaacaggtcttcaaaattcatatgtgaagaaagagagggctttgtgccagttcaggagccaggtctggg

SEQ ID NO: 124879 - DNA, 601 bp, Human
tcatcccatcacagattcttcttatctttgcagaaaggctccttatgccattgtagtcatggagctcttctgccttccacaatacctctaaaacagtgagggccattctgaatatttgttattcatagaccccttggggactccagtgaatgttgtgaaacctgtctctaaaaaaatgcacatgtacccgaaatgttgtgttgaattccaggggctccggtgaaatcgccagtaggtagaggatacctctgctttctgtgtcgtgtgcaaaagattatttctaccgctgacctgttcaactctgaataggtgttaacagacatcaggttagaggtacagggctcatacacagtcactgaacttcatcttgcaagggcaatctccaacacactttctacatgcctacttcctgaaattaaagttcaggtagcagtgccttctactttgggccaaactttaaccttagaaggtttgaaaatttggggattatgtatcctaacattaactagaagatttcaattcccatgtgttaacctgtgttgtggtttggggagaggagagagttggttaggggaaaaaaaaaccctattaaaacatctag

SEQ ID NO: 124880 - DNA, 601 bp, Human
tgctgttgctgtgttgtagctgttgttgttgacagaaaaaaaaattatttcggcagagacatttttatctaagagatggcgtatttgagctagtcactgatagatgaaaaccatttcaaaagatggaagttgggaggttgaagaagtgcaggatggcattccaagtgatgggggcaatggcatggaggtaggaaagcataaggtatattcaggctataaataatagttagatttggctggatcctggatttgagaagccaggaaatgagataacactggtcactttcactaaagctcatgaaaaaaaaaatacatacatatatatatatataaaataaatatacatatatatttttaagccccatatgactagaggaggcagcccatctgttctctgggcttcacttttcttgtctgggaaatgagtaggttggactgcatggtctttaaggtctctttagtattatcttgtttgactccgtaaagagaaaaacaaaggttcctcctgacatcttgtgttgccttccaacgtccagtccagtgtgattgttttaagtactctttggatattttactgttataaaaagtgaagaaaaagact

SEQ ID NO: 124881 - DNA, 601 bp, Human
agtactcattgcactatggtcatttagttgaggacgatactccagcttcaaagctgcaaagcatacagtgtgtgcaaagcccgggttcagaggtcagcgtgcccgtcagtcttccaggaggagctccatgacttgtgctttggatgctgccatgactcactttaggaggtttacttcctcagtgaagacagctgtggggattaggaacctgtgatgctctttccccactcagttgagaacagcaggaccactgccgaggttagagagagggtgagagatagggcagcaaatgtttgaactrtaaagactgttgctcttccattctagggctttctctattaaagtcactgagtctgccattcttgttgccctgaccagaggtgcagagggtagaggataaggaaggccggtccagctggggccaagttgtggcagtgtgctcacggccaagaccaaagcttggatctgtagtgtcttgctcacatcttgtcctcagatgcatgggtctagcccattcccaaatgcagcctacaggtcaggcccatagctggagccttgcttaatgttggccttccccagtctagcccctccttttgtgcct

SEQ ID NO: 124882 - DNA, 601 bp, Human
cactatgattaataatgggatgggccaggcgctatggctcatgcctgtaatcccagcatttgggaggccgaggtgggtggattacctaaggtcagttcaagaccggcctggccaacacagtgaaaccccatctttatcaaaaatacaaaaattgtcccggcatggtggcaagtgcctgtaatcccagctactcaggaggctaaggcaggagaatcgcttgaacccaggaagcggagatggcagtgagctgagatcacaccactgaactccagcctgggagacagaacaagactctgtctcaaaaaaaaaaaacaaaaacaaacaaacaaaaaaaaaaacaaaaaaaccaaccaaacaaacaaaaactgggtgttatattagaattcctagcaggtgggactagagatttgggttcactttcatcttaaatagcacagtctgactaatcagcacttgaggagccactacccagatgatgtgactcgtggtcttagtctccctattttcatttctatttggtcaggactttgatttatactttaaaatgtctatactttttaaaagtataacatacatagggaaaagttcccaagtcataagt

SEQ ID NO: 124883 - DNA, 601 bp, Human
ccaggaagcggagatggcagtgagctgagatcacaccactgaactccagcctgggagacagaacaagactctgtctcaaaaaaaaaaaacaaaaacaaacaaacaaaaaaaaaaacaaaaaaaccaaccaaacaaacaaaaactgggtgttatattagaattcctagcaggtgggactagagatttgggttcactttcatcttaaatagcacagtctgactaatcagcacttgaggagccactacccagatgatgtgactcgtggtcttagtctccctattttcatttctatttggtcagsactttgatttatactttaaaatgtctatactttttaaaagtataacatacatagggaaaagttcccaagtcataagtatgtacttcactgaattatcacaaagttagcatacccgtgtgaccactgctgaggtaaaactggcatccccaaagcttccctcaggcttcctcccaacagtaaatatactttaaactaatgcaagaataggcaaaattatagaaaacagttcaacagatcccccaagtttttaaatttcaaatctagactgaagaaacacagctctctcctgggatagttttc

SEQ ID NO: 124884 - DNA, 601 bp, Human
gagaggttaagtgacttgtccgagatcacatagctgtaaaggacagaaataggattcaaacccaagcagcccaactccaaagtccatgttctttatcaatagactaatcctctctatgtagtatttgtgtgtcacagggaactcaggaatttcattacttgacccccaccaaactaatagctctgagcacatggaacctttcctctctagatgtgagaacttccatgtctgcctcccgaaaagcagctaattctacacttagttcagaggactgtttcaaattcaatgtataatttacttktttaagaattttcttaagagacaaagtcttgctatgttggccaggctggtctcaaactcctggcttcaagcgatcctcttgcctcagcctctacagtagttgggattacagatctgagccactgtgcctggctcaacttttcaattctgaaaaccagttgtaaatttataaaatttgaacctctgaagcagtgtttttcaaaatcgatcccatgaacccactgcatcagtgtctgcagggaatgtttgtttcaaacatggagtctgagcttcacccaaactcactgaaactgaatcctct

SEQ ID NO: 124885 - DNA, 601 bp, Human
ctgcatttttaagaagcaccccagccactcttattgacaagattgacaataattatagagttgcatctggaagtttcaagagctctgcacatcatcaattcaactgcagatgattgtagaaagcgttcaaagccactctgcattcaacagctatttcagggagaattacaatgtgcaagaactgttcctaaattgttgtagtctccttctgtgtgagccagctggttaagagagtttgaataatttcccaagcgactccagttaagtggacacttgaacactctgtacctatgaaaatatrgaaaagacacagttttccaccctggacccaaagtgagtctttcagaatgggactctgaatcatctttcttttttgcttaaaaccctctcagagaacataacgtgaactatgagggcttacataatctggccatgcacacctctctggcattacctcacccactgctgcagcgactctgaactgccttcagttcttccagagtgcaaagcgctacagcatctttgcacatgatcctagggcatgttatgtaccctctgccccagcacctaattaggtctctcactcttccatcagagctca

SEQ ID NO: 124886 - DNA, 601 bp, Human
ccactctgcattcaacagctatttcagggagaattacaatgtgcaagaactgttcctaaattgttgtagtctccttctgtgtgagccagctggttaagagagtttgaataatttcccaagcgactccagttaagtggacacttgaacactctgtacctatgaaaatatagaaaagacacagttttccaccctggacccaaagtgagtctttcagaatgggactctgaatcatctttcttttttgcttaaaaccctctcagagaacataacgtgaactatgagggcttacataatctggccrtgcacacctctctggcattacctcacccactgctgcagcgactctgaactgccttcagttcttccagagtgcaaagcgctacagcatctttgcacatgatcctagggcatgttatgtaccctctgccccagcacctaattaggtctctcactcttccatcagagctcagcttcaatgtcactttctcaggacagccatcccaggcctgccacaagtcagggcatcttcttacctcccatttttcctcccgctattcttctttggcactcaccacagtttttcagtctgcttttgactgtg

SEQ ID NO: 124887 - DNA, 601 bp, Human
tgtgcctaaactataagtatgttaaaagctggaattgttcatctcctaagacccatacggcatttaaattattataaaacactgtcttctgggtatcttaactcaaaaaattacatcttacatgatacatatatcaaaacctaacaattgtaagtggatatccttccactcatttttagaacaccttcctaaggaagctaagtgccagtgacctcccaaattctctatgtgtttcatattatgcattacagtggaaacggattagagagccactctacaagtgggttagtgagcttgatarccaagcagtccagatcattatagattgcacctcatacagtttggttgtatatccctaaatattgtcaccttccaaagctaaaaatctaatattcatgtcacaaaaatctatgggaaattatgggtaataacagtgttcactaacaattacacttcacatctccagtgttgttaacacttttgtaggaattacctccctcagtccacacaacaacccaatgaagtaggtactgttagtaagcccattttatgaatgagaaaactgagacatagacaaagtcacagctacaccattactaag

SEQ ID NO: 124888 - DNA, 601 bp, Human
ttctccatagtggtttcaaacatctctcactaattgtatttctggatgtcttgttttttttaatatgttttacttgtaaagccacccgggcctgctgatttctctgtacaaacaattttgactatagattcaatcattttaatggcaaaaatacttgtcttaatagaatgtctaaagacactaagcggttaaaaatacttttctgcagagaggaattgaattttcttctgctgggagccagggagcacgtctgagctagagccacttcagcgcctttgtggggtccccctcccctgcccayggccctgctgcctctggattgctgctggcatatggccctcagagaaaccaagctttcctgtgaataatacctagtgaatgatattttatgtgaataatacctagtgaatgatacttttctgtgaataatacctagtgattgatagatacttttatgtgaataatacctactgaataatagtttatgtgactaatacttagtacttagggccctgattttaattcaagttattacaataaaaatttattttctttattttgtaattgccccttttgatatttctctgatttccggtgagct

SEQ ID NO: 124889 - DNA, 601 bp, Human
atttaagtctttaacccatcaggaatttactttagtgtatggtaatagtagggatccagcttttcctcacatggatgaccaactgtccccacctgatcttttggaaacctgatcttttcctcagttacaggcaatgtcaccactgctgtcttatttcagttttctctatctgtgagggtctatttctcgacttgtgatttcgttcctctgttcagtttgtggatcctactgcccgtgccttaactaacattgctttacagcctgtgttgatatccgccaagaactgctctcagagtctcarcagagtcctgtctattatatgtttgttattccatgttaactttagaatcatatttttgtcatgtttgtcaaaagtggcagaagaaagaaaagaatctatgggggtttgactggaattggattgagtctagcctatactattgattgtactgtcgcaaacttggtaatattgattctttccatccatgaacatattacagaatcttttcatttcttttgtctttatcattatctttcagtatagtttttttttttttttattctccatagtggtttcaaacatctctcactaattgtattt

SEQ ID NO: 124890 - DNA, 601 bp, Human
agctttgtttgtttttaagttacactaaatatttttccaggctgtatgctgtcttcagcaaattgctcttttcattcaatatttgatttttaagatattttattttctgtaacagtttatccatgttctgctaaatcatattccatcatgtgaaatagcacaaaatatttatgcatttgttttgcatcagtggacatttgggttgttgagaacttttttctgttgtgaacaatgataaatggaattttcatgtttgtctcctgtgcacccatgtaagtatttacaactgggtatgaaattrgtgggttaaggacgagacaagtattcaaactcatgaaatgctgccatactggtttccaaagctgttgtgacaatttgagttatcagatcttagttttttccagtctactgttgataaaataatacgtcattgagatctcaggacgtatttcctgagaagctaatgagggtaaattactttttgtggttatttgtaatttgggctttcttctctgaaataattcttcatgtcttttgcccattgttttttgttttctttgctaggtagggattttttggtcaaatgtagtgtatgtatgta

SEQ ID NO: 124891 - DNA, 601 bp, Human
gagaagaatacataagaaccctctgtattttatgcttaatttttctgcaaatctaaaactgctctataaaataaagtctactaatttttaaaagtgtacaccgatttggaaataagtcctactacacaaaacgtgatgggtgagcctgaactccgggtccagactgcttgagtgagctgggacaaatgacgtgtggaaaatagcaggaacagtgcctggccatagggctggtttgaaagggcagatgaaaatctatggggagcagatggccaagtgcctccagatggttataacattagayagagttctcataagataatttctactagtaagaaccactcacaatgggactcggctctcttctgaaatagtttcatgtcgctcaagtatccaagcacagactgatggatgaattcagtattcagtattggttttgaaaagaaacacggcattataaggatgatcaaatagtacgttctgtaatgtgctggaattttgggatcgtctgaaagaaggtgacatgtaaaaccacttaggagattgtaaaagccaaacattcaagacgttgtttgtgaggatcgtctttttttttttactgcac

SEQ ID NO: 124892 - DNA, 601 bp, Human
cagttttaacaaatgtcctccgctaatgcaagatgttaggagaacctggaagggtaggagaagaatacataagaaccctctgtattttatgcttaatttttctgcaaatctaaaactgctctataaaataaagtctactaatttttaaaagtgtacaccgatttggaaataagtcctactacacaaaacgtgatgggtgagcctgaactccgggtccagactgcttgagtgagctgggacaaatgacgtgtggaaaatagcaggaacagtgcctggccatagggctggtttgaaagggcakatgaaaatctatggggagcagatggccaagtgcctccagatggttataacattagatagagttctcataagataatttctactagtaagaaccactcacaatgggactcggctctcttctgaaatagtttcatgtcgctcaagtatccaagcacagactgatggatgaattcagtattcagtattggttttgaaaagaaacacggcattataaggatgatcaaatagtacgttctgtaatgtgctggaattttgggatcgtctgaaagaaggtgacatgtaaaaccacttaggagattgt

SEQ ID NO: 124893 - DNA, 601 bp, Human
cattatacatttgtcaaaacccataacatctacatgtaaccaagagttagccctaatgtaaactacagattttagctaagaatcatgtaacaatatgttcatcagttttaacaaatgtcctccgctaatgcaagatgttaggagaacctggaagggtaggagaagaatacataagaaccctctgtattttatgcttaatttttctgcaaatctaaaactgctctataaaataaagtctactaatttttaaaagtgtacaccgatttggaaataagtcctactacacaaaacgtgatgggtragcctgaactccgggtccagactgcttgagtgagctgggacaaatgacgtgtggaaaatagcaggaacagtgcctggccatagggctggtttgaaagggcagatgaaaatctatggggagcagatggccaagtgcctccagatggttataacattagatagagttctcataagataatttctactagtaagaaccactcacaatgggactcggctctcttctgaaatagtttcatgtcgctcaagtatccaagcacagactgatggatgaattcagtattcagtattggttttgaaaaga

SEQ ID NO: 124894 - DNA, 601 bp, Human
tatagcttaattcaaacacagcccaggagcagcaatcgccactggagccagtactggggtaggaaaacttagactgcaattgacaaatttctgaaggctcttgtagataagcttgagcattaaaaatgccagaagggggcctggtctggggtgggggcacacttttgtgagttttacctccagaagccctgcggttctcatggtgagaaaagagaaaaatcccctcttgcttcccaaagggagccgttttgagatatgcccagagcattttgtgctccttaacaagacccatcttctaaayttacaaggaaaggcaaaagatccagatgactagacacaatattaaaggaaaagaaccaagttgaagagttgacattacctaacttcaagacttatcgtaaagctatagtaatcaagacaatgtggtattggtgaaagaatagaaaaatcgaccagcggaacagagtagacagcccacacccgcacagatcccatcaagcaatctttgaaatagacaaatcgagcagcggaacggagtagacagcccacacccgcacagatcccatcaagcaatctttgaaaagggcgcaaagacgtttca

SEQ ID NO: 124895 - DNA, 601 bp, Human
gaggtcgcgagttcaagaccatcctgaccaacgtggagaaaccccatctctactaaaaatacataattagccgggcatggtggcgtgcgcctgtaatcccagctactcgggaggctgaagcaggagaatcacttggacccagaaggcggaggttgcggtgacctgagatgacaccattgcactccagcctgggcaacaagagtgaaactccatctaaaaaaaataaaaaggtcaagaaatgttgcctcctgttgtgacgatcacttggattcatggggagaaatctcacttgggattaccmgggggtcagtcaactacaaagttgcccagacacacagaggactttgcacaagtgagaagtcaactcgttgggttttaaccacagacttgagcgttggtggttcacatggcatcgcctggccttcccggcaaatgggctctccgttagcccgttacctccagtttaggtgataggcacactgacatgctccctccccgccatgctcacaatttatcttctataattttgaaataattcagacttctttggaaaagcttctgtcatttacttcagtctggaggttgaggatcctccgtagag

SEQ ID NO: 124896 - DNA, 601 bp, Human
cttctaaggctcattcatatttcagcctcctctccatctgggcttctcccaccccccgattctgctgcaattaggcagagccatgctactatttctgatgaatgaattgtggtgaaaaataatgtagcttaaatatagcttaataggcaggaacatgtatttacttgttggtataaaatgtgtagaaataggccaggtacggtagcttatgccgtaatcccagcactttgggaggccgacacgggcggatcagcagaggtcgcgagttcaagaccatcctgaccaacgtggagaaaccccrtctctactaaaaatacataattagccgggcatggtggcgtgcgcctgtaatcccagctactcgggaggctgaagcaggagaatcacttggacccagaaggcggaggttgcggtgacctgagatgacaccattgcactccagcctgggcaacaagagtgaaactccatctaaaaaaaataaaaaggtcaagaaatgttgcctcctgttgtgacgatcacttggattcatggggagaaatctcacttgggattacccgggggtcagtcaactacaaagttgcccagacacacagaggacttt

SEQ ID NO: 124897 - DNA, 601 bp, Human
attaaggctgggctggagctaatgtacagtagcggagacttctaaggctcattcatatttcagcctcctctccatctgggcttctcccaccccccgattctgctgcaattaggcagagccatgctactatttctgatgaatgaattgtggtgaaaaataatgtagcttaaatatagcttaataggcaggaacatgtatttacttgttggtataaaatgtgtagaaataggccaggtacggtagcttatgccgtaatcccagcactttgggaggccgacacgggcggatcagcagaggtcgsgagttcaagaccatcctgaccaacgtggagaaaccccatctctactaaaaatacataattagccgggcatggtggcgtgcgcctgtaatcccagctactcgggaggctgaagcaggagaatcacttggacccagaaggcggaggttgcggtgacctgagatgacaccattgcactccagcctgggcaacaagagtgaaactccatctaaaaaaaataaaaaggtcaagaaatgttgcctcctgttgtgacgatcacttggattcatggggagaaatctcacttgggattacccgggggtc

SEQ ID NO: 124898 - DNA, 601 bp, Human
ctgacgggttaggtggcttgtctgtggacactccctcaataaggagcagggctggctggcaggcttgctctgaccccatcagcaatactctccactcccctgccacggtgcctgctgccggagggatctccaatcactcagctgaattttaattttatcttatggatgaagagtcacgtttgagagtatactgaatggaatttttccacgtaccgttggtactatgaattgtaactacgtaagattgaattgagagctggcaggggagctttgcttggcaaaaatcagaagtggggaaatyaaggctgggctggagctaatgtacagtagcggagacttctaaggctcattcatatttcagcctcctctccatctgggcttctcccaccccccgattctgctgcaattaggcagagccatgctactatttctgatgaatgaattgtggtgaaaaataatgtagcttaaatatagcttaataggcaggaacatgtatttacttgttggtataaaatgtgtagaaataggccaggtacggtagcttatgccgtaatcccagcactttgggaggccgacacgggcggatcagcagaggtcgcga

SEQ ID NO: 124899 - DNA, 601 bp, Human
aagtcactgtgagggttaaacgagtcgtagaaagtacattttgaggagtgcttggcatattttaggtgtacaaagtatcctattagagataaatcagctgctcttttcgttcttctgatggattgctaatgaacaaatatccatgaaggaagaaaaccagttgtagctttttgtggttcaggagaagggctgccatgtctctttggacaaaatttgtatctactctaaggcatacaaaacagtgccaagagaatacattttaaaatgagctttaaaaaaaaaaaaggccaggcgcggtggytcatgcttgtaatcccagcactttgggaggctgtggagggcggatcgcctgaggtcgggagttcgagaccaggctggcgaacatggtgaaaccccgtctctactaaaaatacaaaaagtagccacgtgtggtggtaggcacctgtaatcctagctactctggagactgaggcaggagaatcccttgaacccaggaggcagaggttgtagtgagctgagattgcgcgcctgcactccagcctgggcgacaacagcgaaactccatctcaaaaaaaaaaaaaaaaaatttagccattttaat

SEQ ID NO: 124900 - DNA, 601 bp, Human
tcaggagccacactctgagaagcacggggaagcaggtgaatgttgggaagacattctgcaagacaggagtggcagaggcgacattctcatggtggagaaaaggaacaaagcacccgagacagtcctggaactgcttcctgccagtccacttgctgtagaatcagccgctgtgggaggagtgaaggcatggggccaggagcttgacgttctgaattggaatcttccctctaccatttactgactgggtcatcttgggcaacttactgacccattccgtgacgcagttcccataagacggggmtggtgatgacaatagttacctaagtcactgtgagggttaaacgagtcgtagaaagtacattttgaggagtgcttggcatattttaggtgtacaaagtatcctattagagataaatcagctgctcttttcgttcttctgatggattgctaatgaacaaatatccatgaaggaagaaaaccagttgtagctttttgtggttcaggagaagggctgccatgtctctttggacaaaatttgtatctactctaaggcatacaaaacagtgccaagagaatacattttaaaatgagctttaaaaaa

SEQ ID NO: 124901 - DNA, 601 bp, Human
gtgctctggaactggagggatccaagcgagttgtcccaaactaaaacaggaggtctaccctattgcccactcctggcaagggaaggaggcgtgaccttggcttgatcctatctgctgaggaccattcctgaagagaaacccagctagaagccattgtcagtcactacagcaggagagattctggcctcagttctgagggggatctgggcagtgccacacagtatccaccatttttggcttcacgtgcccctgtgggtatctgactctggccacagaaccagctgctcacaatggaagaaawgttgagatacttggttccacacgctctcctaacagaaacccaggctcagaacaatgaagcgagttgtccttgggcgtgccaatggttgtcagacgttcttttccatcggaatcacctggagggtttgttactactgggctccatccctggagtttctgactgggtagatttgggatggagaattggtgtctccaacaatttcccaggcgcctctgctgctgctggttcaggagccacactctgagaagcacggggaagcaggtgaatgttgggaagacattctgcaagacaggagtggca

SEQ ID NO: 124902 - DNA, 601 bp, Human
ttcccaactctgcccacggaagggtcgctgggcttctcaagggcctctggccaggatgtgggatgttactggaatagacgtgcaccattctttgattcattcattcactcactccccacttcacttgcttcttatgccccgcccagccaagttaaatctccttctgtctctcaaaagtgtcaaactgcttcaatctctggggcacagcatttgtcattgcttctgcctgccccttaataaccatatccacctgcttgtgtcttttaactgagttatcagtcacctcctccatgaagctgtygcaagctttctcaggatgacgcccctcttgctgcattgttgcctggtctgtgcctctgtgtagaacttgccacattgcattatggccagaggcttgtgtgtgtccccactaaccctgagctcattgttctacctactccctgcacttaacacagtgtttggctccctataaatgctgaataaaggttgctgattattgcatacaagaatgtattcaaaaatctgcagcatcagatattaatgcaaccaaaacaataagatcttggctattttgcagagtccatagctctgagagccaggg

SEQ ID NO: 124903 - DNA, 601 bp, Human
atgggggggcattcactctctaccgtcaagagcctgctaaggcgatttcagctgctccacgctccccttgcttccagcctcccacgtggccaggctggaaaactgccaccacctccacatcctacccagatctcacctgctagagcacgggcggcagggatccgctccccagcacatcagttttggtccatcagaaacagaacattagagaagactctcaatattgctcatgttagaataaagccagcttcttttctattaaaaaaatgcttgtccaactcgcgtgaggtttgtcagcgaygcagaggaggggcttttgttgttgcaggggtcatacttttccatttgtttttcctcgtggaattttctccagctctcccatttaacactgcgtgccccgccccagcctggccccatgcaatgctttggtgctccagggttgccggtggtcctgcagggtctgcagtcacacaggtctctctcctggaggcagagtccctgtgggtctcagccatgttcttggtcaaatgcagaagtgaaaacaaagcatttcaatatttattgaattaccctatttgctagcctgcattttcattttcaa

SEQ ID NO: 124904 - DNA, 601 bp, Human
ttaatattatatatataatatatatatgtgtgtgtgggtgtgtgtgtatcaaggtcctttttctgacagtctgcctatcagtaattaattgtatcctaaattatttctctattttggttttagagattaggtcatacccgctagtctgctttcctttctcattttgggtctcatttgagccccattcagctgttctccatcactaacatacaagaaatgtctgccgaggttgtgaaggatgaggtcatgattcacactcgaaggagaagaaaggaaaggctgatttccggagtgagactcyggtttttggcagagccagtgacctgagcagaatgaaatgacactgtgaattttcattccaacaaagaagaaagaaatccaattgaaaactagctttgactagattttgctgcaaaatagaagatgatattgagctaaataattcaaattcttattcagaacatagagaatgggggggcattcactctctaccgtcaagagcctgctaaggcgatttcagctgctccacgctccccttgcttccagcctcccacgtggccaggctggaaaactgccaccacctccacatcctacccagatc

SEQ ID NO: 124905 - DNA, 601 bp, Human
ccttgcttagggagtagagcatggataggagtgaaaaggtaatttacagaggagaaacaggctagttgatgaggtaacatcatcagtggtaagtcatcttgatagtgtgcactgtttaacaagcagatttattgatacataattcatatatacccaaacttccatttaaaatgacgattcggtgatttttagtatattctcagagtagtgtgatcattaatctaattttctatcatcttcatcactcccccaaagaaacctcatacctatgtgtagatttgcctcttctgaacattttacrtaaatgcaatcatacaacatggggtgttttgtgacctgtttctttcactttcaccttgttttcaaggaggaaccatgttctaaagcctgtacttcattcctttttattgccatataataaaaaggaattgcccttgtataattatacacattttatttacccattcatcgatggaaatgtgggttttctcactttttggccatcatgaataatgctgctataaatattcatgtatgagtttttgtgtagacacgtttatctttctgttgagtgtgtagtacccaggagcagaatttctgg

SEQ ID NO: 124906 - DNA, 601 bp, Human
agagcccctgaaaagttacagcgtctccacctgggcgtggagatctgggccaccccagccccgctgggcatcgcaggaatgggcttccagtggctcctcagtgtggccattacaccatcaaacgaaaaccacctcccatggaacatatctatataaaaaacaacaaaacagaccccttcagaaagtgagctcagatgactcccctctgctaagaggtgcctcctgggcaggtatttctgtgggtgccacatacttttggggaaaatgagcccttagcaactcatatttttattcacaaatragccattaaactgtttattgaaggaagagggtatggtctctattagaaaatacagaacaaacatttacaaaaaagtattattttggaatgaatttcagttcaagagctcccttttaaagtcaccctaagcataccggttgctacacaggcaggattcaaaaatgcaaatatcaaaaatactcaaaactctcagaaacaaaccagtgaaattcattgtcctactcattatccaatttatccaacagtaatcattacgattgatttccaggcctgtaactgcctattttcatggcctgtaga

SEQ ID NO: 124907 - DNA, 601 bp, Human
catgaaacaagcacacagcacacaaaatacacacatgaaacgcacatacatatgaaacacgcaaacacacatgaaacaagcacacagcacacaaaatacacacatgaaacgcacatacatatgaaacacgcaaacacacacatgaactacacacataaaacacacagagatacatgaaacacgcacgcaacgcacaaaatacataaaacacagatgcacacacacatacacatggaacacgcacacaaaacacacacatgaaatacacacatagaacacacacatgaaagacacaggaaaaacacacacacacacacacggaaggcacacacacatcgggaagcggcgatggtcacgctcactccaagaccccagctccccgcggaggcctcccgggccggtgttcgctgccagccaaacctaagcccgctccccgcggggcccgcggggcacccccaggttctgtgcagctgaagcttgtaccattttgtgactgtgacacaggaagcctcctagggacaaacttcggtcagcatttgaatcagccctgactcggtgacagtgtctcataaacgggtcagctggttagggacttggaaag

SEQ ID NO: 124908 - DNA, 601 bp, Human
aactggggaacagtatccccaaccttgatcccgcaatgtagtgttaaggctgtgttgtatttttaaaacaaacaaacataaacatttgaatgctgaaggcttagtgataataaaaatagtctacccacccccccacatcacatcacaacacacacacgacacatgcacatataaaacacacattcacacacgaaacacacataaaacacattcacacacatgaaacacacaaaacacacacaaaaaacatgcacacaacacataaaatacacacaaaacacacatgaaacaagcacacagmacacaaaatacacacatgaaacgcacatacatatgaaacacgcaaacacacatgaaacaagcacacagcacacaaaatacacacatgaaacgcacatacatatgaaacacgcaaacacacacatgaactacacacataaaacacacagagatacatgaaacacgcacgcaacgcacaaaatacataaaacacagatgcacacacacatacacatggaacacgcacacaaaacacacacatgaaatacacacatagaacacacacatgaaagacacaggaaacacacacacacacacacac

SEQ ID NO: 124909 - DNA, 601 bp, Human
gatgaactggggaacagtatccccaaccttgatcccgcaatgtagtgttaaggctgtgttgtatttttaaaacaaacaaacataaacatttgaatgctgaaggcttagtgataataaaaatagtctacccacccccccacatcacatcacaacacacacacgacacatgcacatataaaacacacattcacacacgaaacacacataaaacacattcacacacatgaaacacacaaaacacacacaaaaaacatgcacacaacacataaaatacacacaaaacacacatgaaacaagcacwcagcacacaaaatacacacatgaaacgcacatacatatgaaacacgcaaacacacatgaaacaagcacacagcacacaaaatacacacatgaaacgcacatacatatgaaacacgcaaacacacacatgaactacacacataaaacacacagagatacatgaaacacgcacgcaacgcacaaaatacataaaacacagatgcacacacacatacacatggaacacgcacacaaaacacacacatgaaatacacacatagaacacacacatgaaagacacaggaaacacacacacacacac

SEQ ID NO: 124910 - DNA, 601 bp, Human
gagaatacagataagactatcgccatattcacgtcttttgggatcttgctatgtgctctgcaccatgcagtgggctttccttctcaccagcactgtgcaagtaggatattattattattccctttataacataatccacgtgttttacaagtggaaaagaaagacaagacaaacctgctggtaaatattttgaacccaattctccatttccccactagatggcacttttatacctctctttgttccattttaaactcacagcagatgggcagagcgcacttaatttatggtaagtttaaayaaatcctatgtatatataatatctgggaactttaaatcaaataaacggcttccattcaaatatgctttccttttcaaatataacacttgtaaatatctggtccccggacagcaggttcgcctgtccaccagatgctccaggacggcgctgggcccttgctcctgcgctgaccgcccagcccgagccccggggccaggtccacggtgcccacgcgcgctgtgttctgctggggtccggcttagggctgcttcggccctcggcggcttcctctgcgctgttgctgccctccccacaccccta

SEQ ID NO: 124911 - DNA, 601 bp, Human
tctcctgtgcctcagtccttcaggggccaatttaaatgagaagggaagttggatggtagagttcatggaatagcagttcctctgtcaggcctgtgtttctctttgctgccactaacatataagaaagaaacatgtttctgagatgccacagttatcacttaaaggcacttttcattgtattgctgtcggtctgtgctcactgctgacagcaatggcaggctgccatccttggagtgaggacctgtgcttctacttcctgcttcctctgaaccccagcagctgccagcacagcgtctaggartagtggctgtggacataattaggagtttcttgagcagcctagttaacagccccacagagggcatgatcatataagaacgtcactcatgtcattatcatttaattctatccgaaaagagttaaaatcaacattctggagttaagtgaacagcttgttaaatgaataacatagacataaaatccagtgggtccaacaagcagtgattactatagttaataataataatatcatcttgatgaacaagaacaggaaagagaatacagataagactatcgccatattcacgtcttttgggatctt

SEQ ID NO: 124912 - DNA, 601 bp, Human
gtttctctggtatccagtgaaatctgctccttcggtttttttgcattgaccaaattgctaatggtgaggaagtaacgagaccaatggaagatgttatttggcacattaattattggggacccataagctgttagaggtgaaagagacttcagcaatcattccatagaaatgaagctccaggcggggctgtgacctctccccgctcacacggcctgtgagggtggacgctgagcccaggaaatgtaggtctcctgtgcctcagtccttcaggggccaatttaaatgagaagggaagttggayggtagagttcatggaatagcagttcctctgtcaggcctgtgtttctctttgctgccactaacatataagaaagaaacatgtttctgagatgccacagttatcacttaaaggcacttttcattgtattgctgtcggtctgtgctcactgctgacagcaatggcaggctgccatccttggagtgaggacctgtgcttctacttcctgcttcctctgaaccccagcagctgccagcacagcgtctaggaatagtggctgtggacataattaggagtttcttgagcagcctagttaacagcccc

SEQ ID NO: 124913 - DNA, 601 bp, Human
agtttctctggtatccagtgaaatctgctccttcggtttttttgcattgaccaaattgctaatggtgaggaagtaacgagaccaatggaagatgttatttggcacattaattattggggacccataagctgttagaggtgaaagagacttcagcaatcattccatagaaatgaagctccaggcggggctgtgacctctccccgctcacacggcctgtgagggtggacgctgagcccaggaaatgtaggtctcctgtgcctcagtccttcaggggccaatttaaatgagaagggaagttggrtggtagagttcatggaatagcagttcctctgtcaggcctgtgtttctctttgctgccactaacatataagaaagaaacatgtttctgagatgccacagttatcacttaaaggcacttttcattgtattgctgtcggtctgtgctcactgctgacagcaatggcaggctgccatccttggagtgaggacctgtgcttctacttcctgcttcctctgaaccccagcagctgccagcacagcgtctaggaatagtggctgtggacataattaggagtttcttgagcagcctagttaacagccc

SEQ ID NO: 124914 - DNA, 601 bp, Human
aaataaaaattaaaaaaacacctcatgtgaagagagatctctctgctacccttgaagatcagaataacataagttcaaagtttctctggtatccagtgaaatctgctccttcggtttttttgcattgaccaaattgctaatggtgaggaagtaacgagaccaatggaagatgttatttggcacattaattattggggacccataagctgttagaggtgaaagagacttcagcaatcattccatagaaatgaagctccaggcggggctgtgacctctccccgctcacacggcctgtgagggyggacgctgagcccaggaaatgtaggtctcctgtgcctcagtccttcaggggccaatttaaatgagaagggaagttggatggtagagttcatggaatagcagttcctctgtcaggcctgtgtttctctttgctgccactaacatataagaaagaaacatgtttctgagatgccacagttatcacttaaaggcacttttcattgtattgctgtcggtctgtgctcactgctgacagcaatggcaggctgccatccttggagtgaggacctgtgcttctacttcctgcttcctctgaacccca

SEQ ID NO: 124915 - DNA, 601 bp, Human
caacaaccaacaaaataaaaattaaaaaaacacctcatgtgaagagagatctctctgctacccttgaagatcagaataacataagttcaaagtttctctggtatccagtgaaatctgctccttcggtttttttgcattgaccaaattgctaatggtgaggaagtaacgagaccaatggaagatgttatttggcacattaattattggggacccataagctgttagaggtgaaagagacttcagcaatcattccatagaaatgaagctccaggcggggctgtgacctctccccgctcacacrgcctgtgagggtggacgctgagcccaggaaatgtaggtctcctgtgcctcagtccttcaggggccaatttaaatgagaagggaagttggatggtagagttcatggaatagcagttcctctgtcaggcctgtgtttctctttgctgccactaacatataagaaagaaacatgtttctgagatgccacagttatcacttaaaggcacttttcattgtattgctgtcggtctgtgctcactgctgacagcaatggcaggctgccatccttggagtgaggacctgtgcttctacttcctgcttc

SEQ ID NO: 124916 - DNA, 601 bp, Human
tggctaaattaaaggcttagattctcagtttgctcattctaatttagctgaattctgagtattatgcatttgtatctgaggttccaggcctctccctcctccttctcggggtattaaaactcatgttgccaggtgcatgactgtagtcccagctactcaacaggctgaagcaggaggatggctggggccaggagtttgagaccagcctaggcaacatattgagaccccatctcaaaacaacaacaaccaacaaaataaaaattaaaaaaacacctcatgtgaagagagatctctctgctayccttgaagatcagaataacataagttcaaagtttctctggtatccagtgaaatctgctccttcggtttttttgcattgaccaaattgctaatggtgaggaagtaacgagaccaatggaagatgttatttggcacattaattattggggacccataagctgttagaggtgaaagagacttcagcaatcattccatagaaatgaagctccaggcggggctgtgacctctccccgctcacacggcctgtgagggtggacgctgagcccaggaaatgtaggtctcctgtgcctcagtccttcag

SEQ ID NO: 124917 - DNA, 601 bp, Human
agatggatttatcatcatgtttatggctgtgctggtgtctgtaaaaatagtatacagataattttttttttgagacagagtctcactctgtcacccaggctggagtgcggtggcacaatctaggctcactgcaacttccacctcccgggttcaagcgattctcctgcctcagcttctcaggtagctaggattacaggtgcactccaccatgcccagctaattatttttttgtatttttagtagaaacggggtttcaccgtgttagccaggatggtcggcttccggtgttgtttcagcatayggctaaattaaaggcttagattctcagtttgctcattctaatttagctgaattctgagtattatgcatttgtatctgaggttccaggcctctccctcctccttctcggggtattaaaactcatgttgccaggtgcatgactgtagtcccagctactcaacaggctgaagcaggaggatggctggggccaggagtttgagaccagcctaggcaacatattgagaccccatctcaaaacaacaacaaccaacaaaataaaaattaaaaaaacacctcatgtgaagagagatctctctgctac

SEQ ID NO: 124918 - DNA, 601 bp, Human
gagaggtctatttttcagatttgaaagttagtttttctttattcagattccgttttataaatgagtaatttgtgatgtgatgggcagcctttaacattttaactgacaatcagtagatggatttatcatcatgtttatggctgtgctggtgtctgtaaaaatagtatacagataattttttttttgagacagagtctcactctgtcacccaggctggagtgcggtggcacaatctaggctcactgcaacttccacctcccgggttcaagcgattctcctgcctcagcttctcaggtagctrggattacaggtgcactccaccatgcccagctaattatttttttgtatttttagtagaaacggggtttcaccgtgttagccaggatggtcggcttccggtgttgtttcagcatatggctaaattaaaggcttagattctcagtttgctcattctaatttagctgaattctgagtattatgcatttgtatctgaggttccaggcctctccctcctccttctcggggtattaaaactcatgttgccaggtgcatgactgtagtcccagctactcaacaggctgaagcaggaggatggctgggg

SEQ ID NO: 124919 - DNA, 601 bp, Human
cagcccagcactggggattctaaaagggaagaggaagggaggggccaaaggctgaaaagctacctattgcgtgttatgttctctgcctgggcagtgggatcagcagaaggtcaaacctcagtgttacacaatgcaatgaacctgcatgcgcacgcccagaatctaaaataaaaataaaataaataaatagaaaaaataaaggcattaaaaataatttttcagctatatatatatatatatttcatcgtgtttgtgatttggcaagaaaaatcaagagaggtctatttttcagatttgaaarttagtttttctttattcagattccgttttataaatgagtaatttgtgatgtgatgggcagcctttaacattttaactgacaatcagtagatggatttatcatcatgtttatggctgtgctggtgtctgtaaaaatagtatacagataattttttttttgagacagagtctcactctgtcacccaggctggagtgcggtggcacaatctaggctcactgcaacttccacctcccgggttcaagcgattctcctgcctcagcttctcaggtagctaggattacaggtgcactccaccatgcc

SEQ ID NO: 124920 - DNA, 601 bp, Human
tcacttctaagtgggagctgaacgttgggtactcatggacatcaagacgggaacgtcgtctcatctccagcagcttccagcccagcactggggattctaaaagggaagaggaagggaggggccaaaggctgaaaagctacctattgcgtgttatgttctctgcctgggcagtgggatcagcagaaggtcaaacctcagtgttacacaatgcaatgaacctgcatgcgcacgcccagaatctaaaataaaaataaaataaataaatagaaaaaataaaggcattaaaaataatttttcagcaatatatatatatatatttcatcgtgtttgtgatttggcaagaaaaatcaagagaggtctatttttcagatttgaaagttagtttttctttattcagattccgttttataaatgagtaatttgtgatgtgatgggcagcctttaacattttaactgacaatcagtagatggatttatcatcatgtttatggctgtgctggtgtctgtaaaaatagtatacagataattttttttttgagacagagtctcactctgtcacccaggctggagtgcggtggcacaatctaggctcactgcaact

SEQ ID NO: 124921 - DNA, 601 bp, Human
gctcacgcctgtaatctcagcactttgggaggccgagacgggtggatcatgaggtcaagagatcaagaccatcctggccaatatggtgaaaccccgtctctactaaaatacaaaaaattagcggggcgtggtggtgtgtgcctgtagtcgcagctacttgggaggctgagacaggagaatcgcttgaacccaggaggcagaggtagcagtgagccgagatcgcaccactgcactccagcctggcaacagagtgagattctgtctcaaaaataaataaataaataaataaataaataaatamataaataaataagctgtttcgcagaaacagaaaacgaaatgccgcatgttctcacttctaagtgggagctgaacgttgggtactcatggacatcaagacgggaacgtcgtctcatctccagcagcttccagcccagcactggggattctaaaagggaagaggaagggaggggccaaaggctgaaaagctacctattgcgtgttatgttctctgcctgggcagtgggatcagcagaaggtcaaacctcagtgttacacaatgcaatgaacctgcatgcgcacgcccagaatctaaaataaa

SEQ ID NO: 124922 - DNA, 601 bp, Human
acagagcaagactccgtctcaaaaaaaaaaaaaaaaagaaagaaaatgaaaacgaccatttctgatacctgtaatgcttacgcactccagcttcactgcctgtctggtccctgggtttcctcatcttcagatgctgtgttactttcctctggattctgtaacaaattaccacaacccaccagggtggctgaatagcccagatttctccccgtggctctggaggctgtaatgctggaatctcggtgttggcagaactcggctcccttcgaggccttaggaaggaccctgccttgcctcttcmtcgttcctcggctgcctccttctccacgtgggcctctcccacatttcttatccctttcttgtaagtaaactagtaatattggttaagaacccaaactgctgtatacggtatgtactatatgcggcacacagtacatagcttactgtcattttccatttaattctaactttcagagaaaagactatattcaaaatgcctcccacagtaacgggcacacatagtgctcaacaaactagttccctctcttttgccttggggtatccggcaactgtcttacaaatgtaacagtgtatggtggac

SEQ ID NO: 124923 - DNA, 601 bp, Human
agtggaacgtcctgtgtgccaggactcgggttattgatcacaaccctgagtcaatgaaatgtaattgacttttattaggcatgcattttaccatagtgttctatgggacacagttttgtgttttccaattttaaaagttggaaatgttcttgaatagttttgatcctaaagcctcagagaaagtctgtctgtgacccgctccagagctgcctcactttctgacatgagcggtgctcttggacagccggcaacgaagccacgcttgtgaaggacgcagcggttctcacctgtggcacccggkgcaccagtggctggccactgccctacactctaaagagggaaactaaactttggactgagaattatatatttaagaaagccttcagaaataatacatttacattatacatgactcatttatggccttacctgtggtcctgcctcatgaaagcatcagaggaaacgttccccatttgctaaggggcatgtctccatctcgcctgttcgggtccacttctcccttcatcctcgctttgttctgtgattttccgctcccttcacaggtctcactcagaatgggtctttcccaggccgggcgcgg

SEQ ID NO: 124924 - DNA, 601 bp, Human
gcagtggaacgtcctgtgtgccaggactcgggttattgatcacaaccctgagtcaatgaaatgtaattgacttttattaggcatgcattttaccatagtgttctatgggacacagttttgtgttttccaattttaaaagttggaaatgttcttgaatagttttgatcctaaagcctcagagaaagtctgtctgtgacccgctccagagctgcctcactttctgacatgagcggtgctcttggacagccggcaacgaagccacgcttgtgaaggacgcagcggttctcacctgtggcaccckgtgcaccagtggctggccactgccctacactctaaagagggaaactaaactttggactgagaattatatatttaagaaagccttcagaaataatacatttacattatacatgactcatttatggccttacctgtggtcctgcctcatgaaagcatcagaggaaacgttccccatttgctaaggggcatgtctccatctcgcctgttcgggtccacttctcccttcatcctcgctttgttctgtgattttccgctcccttcacaggtctcactcagaatgggtctttcccaggccgggcgc

SEQ ID NO: 124925 - DNA, 601 bp, Human
accaactctgggcttccctcttccacagcaatggcccctttcattttaagccatgcatttcctaccacctgcagtggaacgtcctgtgtgccaggactcgggttattgatcacaaccctgagtcaatgaaatgtaattgacttttattaggcatgcattttaccatagtgttctatgggacacagttttgtgttttccaattttaaaagttggaaatgttcttgaatagttttgatcctaaagcctcagagaaagtctgtctgtgacccgctccagagctgcctcactttctgacatgagyggtgctcttggacagccggcaacgaagccacgcttgtgaaggacgcagcggttctcacctgtggcacccggtgcaccagtggctggccactgccctacactctaaagagggaaactaaactttggactgagaattatatatttaagaaagccttcagaaataatacatttacattatacatgactcatttatggccttacctgtggtcctgcctcatgaaagcatcagaggaaacgttccccatttgctaaggggcatgtctccatctcgcctgttcgggtccacttctcccttcatcct

SEQ ID NO: 124926 - DNA, 601 bp, Human
tccctgatggaatcgcatcctcgttgccctgggaatcagttcctggcagtgcaggccaaggcagtgggcacacgccttcaccccaccagagtgactggctcagagtcagcaacctgagcaaaggttgagaatttggatgttgtgtcggaataaatgctttctctttcccttccatgtgaatgaggaagtgttggccctggaagtggtggcacttatcatgagaagccgccggaggtcactgatgcccaggtagaggggctgaggtctgcaccaactctgggcttccctcttccacagcaayggcccctttcattttaagccatgcatttcctaccacctgcagtggaacgtcctgtgtgccaggactcgggttattgatcacaaccctgagtcaatgaaatgtaattgacttttattaggcatgcattttaccatagtgttctatgggacacagttttgtgttttccaattttaaaagttggaaatgttcttgaatagttttgatcctaaagcctcagagaaagtctgtctgtgacccgctccagagctgcctcactttctgacatgagcggtgctcttggacagccggcaacgaagccac

SEQ ID NO: 124927 - DNA, 601 bp, Human
tcatctccagttccaggggtggatcctgattcctacacattccctgatggaatcgcatcctcgttgccctgggaatcagttcctggcagtgcaggccaaggcagtgggcacacgccttcaccccaccagagtgactggctcagagtcagcaacctgagcaaaggttgagaatttggatgttgtgtcggaataaatgctttctctttcccttccatgtgaatgaggaagtgttggccctggaagtggtggcacttatcatgagaagccgccggaggtcactgatgcccaggtagaggggctraggtctgcaccaactctgggcttccctcttccacagcaatggcccctttcattttaagccatgcatttcctaccacctgcagtggaacgtcctgtgtgccaggactcgggttattgatcacaaccctgagtcaatgaaatgtaattgacttttattaggcatgcattttaccatagtgttctatgggacacagttttgtgttttccaattttaaaagttggaaatgttcttgaatagttttgatcctaaagcctcagagaaagtctgtctgtgacccgctccagagctgcctcactttct

SEQ ID NO: 124928 - DNA, 601 bp, Human
atacaatgaggagatctcctcttctgtaccagaagagtgcacattctacacactgcgtagcacctttctcacttacgttctgtctgggcacacttctgattgacacgcagagggctctctctgtctggggatatttctgatgggtaccgagagagcttcctctatcttgggttatttctgatgcgtagagaagggctgcctctgtccattatggaaggctggtgttcactgcagggattccacacttcatttaaccagagtccccgtggacggacacttgggttgttttcaatctttccckctttcatacacacgcaggaacatttgtaggataaagtccagatgtagaattgctgaagacaaaacaaaacgaaaacagcagatgcatttgtaattttgaatattgccaaatttctcttcaaaaatctgtagccattttttctcccaccagcaatgtaagagagggccacgttccagctaccataacaccacaattaggaatttttgacaatctgacaggtggaaaaaggtagctcactgtagattattttgcagttctcttactatgacaaattaatataaatgacgtgatgttaatgtg

SEQ ID NO: 124929 - DNA, 601 bp, Human
agcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgayggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatga

SEQ ID NO: 124930 - DNA, 601 bp, Human
agctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttgagatgaagtctcactctgttgcccaagctggagtgcagtggtgtgatctcggctcactgtaaactctacctcctggattcaagcgattgtcctgcctcagtctcccaagtagctgagattacaggcacatgccaycatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaag

SEQ ID NO: 124931 - DNA, 601 bp, Human
ggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttgagatgaagtctcacyctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagc

SEQ ID NO: 124932 - DNA, 601 bp, Human
ctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttgagatgaagtctcactctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatgga

SEQ ID NO: 124933 - DNA, 601 bp, Human
aaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactrcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttgagatgaagtctcactctgttgcccaagctggagtgcagtggtgtgatctcggctcactgtaaactct

SEQ ID NO: 124934 - DNA, 601 bp, Human
ctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaawttgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagac

SEQ ID NO: 124935 - DNA, 601 bp, Human
tgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatascagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaag

SEQ ID NO: 124936 - DNA, 601 bp, Human
gtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatrtttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttc

SEQ ID NO: 124937 - DNA, 601 bp, Human; identical to SEQ ID NO: 124888

SEQ ID NO: 124938 - DNA, 601 bp, Human; identical to SEQ ID NO: 124889

SEQ ID NO: 124939 - DNA, 601 bp, Human; identical to SEQ ID NO: 124890

SEQ ID NO: 124940 - DNA, 601 bp, Human; identical to SEQ ID NO: 124891

SEQ ID NO: 124941 - DNA, 601 bp, Human; identical to SEQ ID NO: 124892

SEQ ID NO: 124942 - DNA, 601 bp, Human; identical to SEQ ID NO: 124893

SEQ ID NO: 124943 - DNA, 601 bp, Human; identical to SEQ ID NO: 124894

SEQ ID NO: 124944 - DNA, 601 bp, Human; identical to SEQ ID NO: 124895

SEQ ID NO: 124945 - DNA, 601 bp, Human; identical to SEQ ID NO: 124896

SEQ ID NO: 124946 - DNA, 601 bp, Human; identical to SEQ ID NO: 124897

SEQ ID NO: 124947 - DNA, 601 bp, Human; identical to SEQ ID NO: 124898

SEQ ID NO: 124948 - DNA, 601 bp, Human; identical to SEQ ID NO: 124899

SEQ ID NO: 124949 - DNA, 601 bp, Human; identical to SEQ ID NO: 124900

SEQ ID NO: 124950 - DNA, 601 bp, Human; identical to SEQ ID NO: 124901

SEQ ID NO: 124951 - DNA, 601 bp, Human; identical to SEQ ID NO: 124902

SEQ ID NO: 124952 - DNA, 601 bp, Human; identical to SEQ ID NO: 124903

SEQ ID NO: 124953 - DNA, 601 bp, Human; identical to SEQ ID NO: 124904

SEQ ID NO: 124954 - DNA, 601 bp, Human; identical to SEQ ID NO: 124905

SEQ ID NO: 124955 - DNA, 601 bp, Human; identical to SEQ ID NO: 124906

SEQ ID NO: 124956 - DNA, 601 bp, Human; identical to SEQ ID NO: 124907

SEQ ID NO: 124957 - DNA, 601 bp, Human; identical to SEQ ID NO: 124908

SEQ ID NO: 124958 - DNA, 601 bp, Human; identical to SEQ ID NO: 124909

SEQ ID NO: 124959 - DNA, 601 bp, Human; identical to SEQ ID NO: 124910

SEQ ID NO: 124960 - DNA, 601 bp, Human; identical to SEQ ID NO: 124911

SEQ ID NO: 124961 - DNA, 601 bp, Human; identical to SEQ ID NO: 124912

SEQ ID NO: 124962 - DNA, 601 bp, Human; identical to SEQ ID NO: 124913

SEQ ID NO: 124963 - DNA, 601 bp, Human; identical to SEQ ID NO: 124914

SEQ ID NO: 124964 - DNA, 601 bp, Human; identical to SEQ ID NO: 124915

SEQ ID NO: 124965 - DNA, 601 bp, Human; identical to SEQ ID NO: 124916

SEQ ID NO: 124966 - DNA, 601 bp, Human; identical to SEQ ID NO: 124917

SEQ ID NO: 124967 - DNA, 601 bp, Human; identical to SEQ ID NO: 124918

SEQ ID NO: 124968 - DNA, 601 bp, Human; identical to SEQ ID NO: 124919

SEQ ID NO: 124969 - DNA, 601 bp, Human; identical to SEQ ID NO: 124920

SEQ ID NO: 124970 - DNA, 601 bp, Human; identical to SEQ ID NO: 124921

SEQ ID NO: 124971 - DNA, 601 bp, Human; identical to SEQ ID NO: 124922

SEQ ID NO: 124972 - DNA, 601 bp, Human; identical to SEQ ID NO: 124923

SEQ ID NO: 124973 - DNA, 601 bp, Human; identical to SEQ ID NO: 124924

SEQ ID NO: 124974 - DNA, 601 bp, Human; identical to SEQ ID NO: 124925

SEQ ID NO: 124975 - DNA, 601 bp, Human; identical to SEQ ID NO: 124926

SEQ ID NO: 124976 - DNA, 601 bp, Human; identical to SEQ ID NO: 124927

SEQ ID NO: 124977 - DNA, 601 bp, Human; identical to SEQ ID NO: 124928

SEQ ID NO: 124978 - DNA, 601 bp, Human; identical to SEQ ID NO: 124929

SEQ ID NO: 124979 - DNA, 601 bp, Human; identical to SEQ ID NO: 124930

SEQ ID NO: 124980 - DNA, 601 bp, Human; identical to SEQ ID NO: 124931

SEQ ID NO: 124981 - DNA, 601 bp, Human; identical to SEQ ID NO: 124932

SEQ ID NO: 124982 - DNA, 601 bp, Human; identical to SEQ ID NO: 124933

SEQ ID NO: 124983 - DNA, 601 bp, Human; identical to SEQ ID NO: 124934

SEQ ID NO: 124984 - DNA, 601 bp, Human; identical to SEQ ID NO: 124935

SEQ ID NO: 124985 - DNA, 601 bp, Human; identical to SEQ ID NO: 124936

SEQ ID NO: 124986 - DNA, 601 bp, Human
tatttatctaaacacaccaggacttagatcgaaaaacacatttaatggcatttttcataactatttagcttcctctttcacactaaaaggtaaatactatcctacaaaattctgaatacaaagagcaaaagaaacaaatcacactgatctaacctaaaagtgtgaattttaaaatatttagttgtcactcatatttactattaaaacagatgcttttatttacagtggccaaaacagacttctcattttcaacttatacctgcaatgtttatgtagctggaaaaatgaaaacgaaatgtgrctaaaagaaaagaaaacgaaagaaagccacaaaattcccaaaacctcagcataacttgcttctttcttcactcgctctcattaagtcttaattctccagattagctttgtctcaaatatttctcaaactagtaacctatttctgggtacagtatatttggcggggtaaaagaaacactgtcaagtttttctaaaacgtcgggtgcacgttaaaataattcctatccactctaataccaaaacgatatcaaaggaaagcatcccatctggagtagtcccatgaatctaaataggacgaagc

SEQ ID NO: 124987 - DNA, 601 bp, Human
caaatggggaaatttaaagaactagattttagaaatactattttcttgggtggggaaatggtatggtggttatgtaacaacattttgctcttatttataagagaatgctgaaatacttggggctgcaatgtgtcaaaatactttcaaataaacatgcgtggaccaggcgtggtggctcgtgcctgtctgtaatcccaacacttggggacactgaggtgggtgaatcgcttgagcccaggagttccagaccaggctgggcaacatggtgaattcctgtctctacaaaaaaaatacaaaaatyaggccaggtacggtggctcacgcctgtaaatccagcactttggaaggcagaggtaggcggatcacttgaggtcaggagttcgagaccagcctgggcaacgtggcaaaatccccgtctctacttaaaatacaaaaattagcggggcatggtggtgggcgcctgtaatcccagctactggggtggctgaggcaggagaatcgcttgaaccgggaggcggaggctgcagtaaggcgaaatcgcgccactgcactccagtctgggcgacagagcaaggctccatctcaaaaaaaaaaaaaaaaa

SEQ ID NO: 124988 - DNA, 601 bp, Human
tcaaatatgaataatccagatttaatacactaaataaactaagtcaaacattagaaaaacattaattaggacacacagaagctttgcccttctgattttattcaatatttactatgtatcctaagttgtccattaatctaaagatagtttaaacaactgccaactcaaatcccttttttagcccaattctcacaccattaccaactgtccaacaaaacaaaacaaaaagactcaaattcacaggtaggtcctatctaaagagaaagattcagagacatggtagaaaagcttaaaatcaccrtcaccaaatcgaagatttaaaaaaaaaagcttaaaatcatgaattggtatgggtaattgtccaataggtaaaaacacccaaatacagattttgcccttctgaaggtctatctgggatgtaaatgcctacattccctgaaataatgttgaaggaatgcagtatcacctaacacagtacctttctgctgtatctctaagaaaaacccaattctcattctttaagcacagagcaacttctcttaggaacaactgtccccaaacagaatatttgataatgctccagtttcctaagaaatatcaa

SEQ ID NO: 124989 - DNA, 601 bp, Human
gttttttcattaatgaatttttacatgttggagttacaaatcccttatcagacatgatttacaaaaattgtatcctattctgtgggatgccttgccactttccatgtttaaccgtctgttatgtgaagctaactaactcagagaaatagaacttacaatcttggcttcacagacatgatgtactattccaactattctcaaacattttgtaaaggattgcttcacattcttaaaaactgaggagcttgggccgggcgcggtgactcacgcctgtaatctcagcactttgggaggccgaggygggcggatcacaaggtcaggagttcgagaccagcctggccaatttggtgaaaccctgtctctactaaaaatacaaaaaattagctgggtgtgggcacatgcctgtagtcctagctacttgggaagctgaggcaggagaatcgcttgaacccgggaggtggaggttgcagtgagctgggatcgcaccactgcactccagcctgagcaagagtgagactccgcctccaaaaaaaaaaataacaataataattgaggagcccagagggattctatcattactcacataagaaattaaaacaaa

SEQ ID NO: 124990 - DNA, 601 bp, Human
cggagaattgcttgaacccgggaggcggaggttgcagtgagccaagatcataccactgcagtccagcctgggcaacagatggagactctgtctcaaactaaaaaaaaaaaaaaaaaaagaaaagaaaagaaaaaagaaaacagggcaagtttccaatgcccttctgtaacaaactgcttagtgtagcaagaacagctgtcccatgcttatgcatcccaaaaacttattactatcaaaaactatcaaaatccagttttgcttctgaaataataatctataatcctaatatcatttttcaggygatgttaatggggaacaggcagggaccccaaatcaaaggagtagagcaaaaactggactagttatcaagacatacatattaccaatgacttaattttatcttctctgtgaataacacaaccatgtacaactggctaaaagaaagaaggtaggggggccaggcacagtggctcacgcctataatcccagcactttgggaggctgaggcaggtggatcacttgagctcaggagttggagaccagcctggcaacattgcgaaaccccatctctacaaaaaacgcaaaaattagctgggtgtgg

SEQ ID NO: 124991 - DNA, 601 bp, Human
cctagttgaaaaccatggctcatcgggtgcagtggctcacgcctgtaatcccagcattttgggaggccaaggcaggtggatcacttcaggtcaggagttcaagaccagcctgaccaacacagtgacaccccgtctctactaaaaatacaaaaattagcaggcgtggtggtatgtgcctgtagtctcacacactcaggaggctgaggtgggagaaacgcttgaacctgggaagcagaggttgcagtgagccgagattacgccacagcactccaacctgggtgacagaggagactccatctcaaaaaaaaaaaaaactatgctctctagttggttgctcctttggtgccacagaatctttctgcagtctagtgaaacctatgagccttttctcagaataatattcttaaatacataaattctgagggatttccaaggaaaaagcatgtgtgtgtgtactgttgctgtgttttttttttttttttttaaagagacaggctctctctacattgctgatctagagatcctgggctccagtgatcctcctgtctcagcctcccacgtagctgggactacaggcgtgtaccaccgctccttgctccag

SEQ ID NO: 124992 - DNA, 601 bp, Human
gttaaaattaaataaatacatataaaaaaggaccaattaaataaattatggaatttgtagtcacttaaaaaaaaaaaaaaaggcatggcaggtagccacatggaaaataaaaagtgatggtgagcagggagacatgcaaacaacacatacacttactctgccatatacccttctggtttgtttgaatttttcttattcgtctgagaaatattcactcagtgcctagtatgtgtcagacattgtagtggcccttgggatacataacaaaataaagaattctttcaatgggtttacttcttgaaaaaaaaaaaaattaaaagaaattttaggccaggcatggtagctcatgcctgtaatcccagcactttgagaggccaaggcatgaggaccgcttgaggccagaagttcaagagcagctgagcaacatagtgagacactggtctctacaaaaaatataaaaattagccaggcatggtggtgtgtgcctgcagccctagctactaggcaggcggactgcttgaggccagaagttcaagaccagcctgggcaacacagtgagactctgtctctaccaaaacaaaacaaaaacaacttagccagg

SEQ ID NO: 124993 - DNA, 601 bp, Human
ccccaccactccccctttttttttagtatttcatggaacaattcagtcaaaacaccagtttggaaaagtttaaaaaaagtatctgttcagatttttttaattacctaggagaaataaactcttttctttggaataaattagcttgcaccactggtaagcatttacttatttagaaaaaaagacatgttgactactgtaattcaaaattaaaattaggatgctttcctaacatataagaactttatgaatagcttgctcaaggaactaaagctgtaaagtttataagggactattggctctwcccatatatgaaactacaggctcagaaagaacagcaaatggaaaatcagcaaataataaaggtggcatgttcaaatcagaatggtgaattgttcaataaatggtttcagaataactatataatcatctgttagaataactgtgaagtcaattttatcaaaataaagttgaattcctactttactctttctgcccaaataaacttaagagagatcaaagatttaaatgttaaaaacaaaacacaagacagaactagagcagaatacggtgaaatgtatttctgcattggaaaagctcttca

SEQ ID NO: 124994 - DNA, 601 bp, Human
attagctgggcgtggtggtgtgtgcctgtaatccctgctacctggaaggctgaggcacaagaattgcttgaatccaggaggcagaggttactgtgagtgagattgcgccactgcactccagcctgggtgacaaagccacacagcactttgggaggctgagacaggcagattacaaggtcaggagattgggaccatcctggctaacatggtgaaaccccatctctactaaaaacacaaaaaattagccgggcatggtggtgggcgcctgtagtcccagctactcgggaggctaaagcaggagaatggcgtgaacccaggaggcggagcttacagttagccgagatagcaccactgcactccagcctgggtgacagagactacgtctcaaaaaaaaaagttaatttatatgaagttttgttttgccttttttctaggacatcctgacatctataaatggcaatatatattgataatatccgagcataaagagggaagcactgcccctatcacttttctcccccaccactccccctttttttttagtatttcatggaacaattcagtcaaaacaccagtttggaaaagtttaaaaaaagtatct

SEQ ID NO: 124995 - DNA, 601 bp, Human
atttcaaaactacatttgaatcctatcgctgatgtcaatttgtctttagaactattgcttaattaacacttgcaaatagaaaatttttctttggaggtctagcatacaaaatggtaaaacttacccacattatgctttcctgagtcttagaaaagcagctgagtttctcaagaagttgtattcaaagcaaatattcacaatttttttttcaaactgttgtggattctggtatgtgggggaaaaaaatctagatgcagacttcaacctattatgccattatacaaaccaactatttgttttytgctaccaagttgctaggagcaaaccggtttaataataaaatttaaagtttaaaaattcagtaaaattaaagtaataaaattgaaagtaataagttacaactaataaatgcattgtccacatttatttagaggtgcaactttttacagatgtcactggtaatattttagacatcttcatttcctggaagtgccttgaaccagactcattccaaaggaatagctgtttcaaagctgatgcgttaaagaaaatacaaacaatccattagaaaatatttaagcttttgacttaaactggtcct

SEQ ID NO: 124996 - DNA, 601 bp, Human
gggaggtggagcctgcagtgagcagagatcgtggcactgcactctagcctgggctacagagactccgtctcaaaaaaacaaagatttgaacattattgttccttttaagtgtgataatggtattgtggttttacagggtactattctttgtggttttacagggtactattctttatataagcagagtaatataaagcatttattgagcctatgtagaggtgcacaggtattgactatatattattctttcaaatttgtttgaaaatttttataataaatagttggaaagaaaaaacgttamattgtttggctaaggtcctagtaataaggaagctgcaagcagaatatcctagggtccccagatttcaaattctttcattcctatttctgcatatatcctttatagagttacctgcagattccttgcactgcatttctttaaataaatgaagacatttttaaacataccttttccatactaccaaatatgatcagaccactgttacagtaacacagtaagaaaaattctgaccctgcagttgaggcacaggacagagtagttcccctcccccataataaaaaactgaacttgaataataat

SEQ ID NO: 124997 - DNA, 601 bp, Human
gagaattgaacaggaagcttccacagtcatttaacttataaatttatgtaggcatttgagtaaaataagggcccagaattataaatgatatctcaacttaagctcttcctagagcaaaattacagccaacttattaacctagcaattatttcagatgttcatgcttattctccaattattctccctcactgcttagttacaattctagatgagctaatgaccattaagctcatatttctataatatttctatattattctcatatttctataacgttcatgtaagccacaagtcatctgcyttaatatactgggaatgactagaagcaaaattcagcttaaaaattaaaaaaacacgccattcatctatttctaaaatgtaaaaaattataaatcatcaagctaaaattgtttcaactcatcaaataaagcatgttttctctctttcctttaaggcctctgcactggcagtctctgccaggtattctctgcttaactcatacatgtacttcaaacctcagttcacaagtcctgttcttccagatttccttgactcaccatcccccatcttcccatgcagtgtctggcatgcatttacacaa

SEQ ID NO: 124998 - DNA, 601 bp, Human
taaattcatttaaaattcatcaatttaaaaaattgtatcagaactctaattcagtgatcaaagttccattataatcctcatttactcttaacacccataaaaacattttatttcatgtaataccactgtcttttaaaaaatgtcattactattacatcaacacattcttatttatatttctctcctcataccacctaggtaggcaattctccctaatttttggatattacaaatcaataaaattagaaaagaaaatttagaaactgacatgatctgccaacgtttttgagttttattttcyttttctgagacagagtcttgctctgtcgcccaggctagagtgcaatggcgcgatgtttttgggttttgagagatgtttggaaactactgttcttgtgctttcgcttttctcaattttaaccagtctttgggtattccaaaagtatccagaagacatcaaaacattttacagggttctgtttaaaactaagtttcagactttgatactagaatcagtaaaataagtagtatctcttaatcttggttattaaatatttgtccctttggtaaaattatcccttttagtaaacacatgcaaatt

SEQ ID NO: 124999 - DNA, 601 bp, Human
ctataagtaaattattcagtacattaggtgatgagtattataggggaaaaggagaacttggtaaaggataaggagttctgcaggggatagaagtggcaattttaaacagagtggtcacagtagatctcaatgagaagttaacatttttgtagatctgaagaaagcaaagcagctagcaaagcagctatctggaaaaatatctttagaacagataaaagagctaatgtagacaaaagccctaagggaggaatgtctggaataaatttaaggaacatcaaggaggccagtgtgactagagaakagactttactattaatatgtggattatctatcatgcagacattatgcacaaatttttatacttgtgggtatcctagcatttaataattttctactaattattaaatcagcctacctgaatgtactaaaaaaacctgattcttaaacatacaaatgttaggcttttcacataattactaagaatacagatataaattcatttaaaattcatcaatttaaaaaattgtatcagaactctaattcagtgatcaaagttccattataatcctcatttactcttaacacccataaaaacatttta

SEQ ID NO: 125000 - DNA, 601 bp, Human
aatttttagaaattcaacttgtaaaatacaattatttcccactgtggatttttaattcaacaagtattcatagtgccattatatgccaagcattattgtagcttcctggaatatagcaacatacaaaagagacaaactataagtaaattattcagtacattaggtgatgagtattataggggaaaaggagaacttggtaaaggataaggagttctgcaggggatagaagtggcaattttaaacagagtggtcacagtagatctcaatgagaagttaacatttttgtagatctgaagaaagyaaagcagctagcaaagcagctatctggaaaaatatctttagaacagataaaagagctaatgtagacaaaagccctaagggaggaatgtctggaataaatttaaggaacatcaaggaggccagtgtgactagagaagagactttactattaatatgtggattatctatcatgcagacattatgcacaaatttttatacttgtgggtatcctagcatttaataattttctactaattattaaatcagcctacctgaatgtactaaaaaaacctgattcttaaacatacaaatgttaggcttt

SEQ ID NO: 125001 - DNA, 601 bp, Human
gtccatctaggtattattctgcttactcagaaaacaagcgagtcaacataatttaaaaaattccacaaaggcataacgttttttatttcacagcacctagaacaaagcctaacatatagcagacattcaataataattgctaaataaatgtggataaaactaccagttactattcacatattcattcaaaaataggttttagattatactgtcttaaatatcaagggaaatgaaaaatgtaaatgtataacttttacagaaaggtctttatgagtcctataatccttgttaaaatattgayttaaaacctcacttcaataaaaaggtttagaaagggtgctaagtataatactatcagtaaattcagactaaaatggaggaataattgaagctctaatatggattttgaaagttagatttttcacaggatttcgatctttccgtgagcacacccaaatcaattccattttccattacttttcttgaatgaaaacatgatttctatttgaagcaaaaatgctgtttcaaatagccatgtaaaagatgggaaattaggaactttggaggtttgaaaagtagacatagctaaccaattaagaaa

SEQ ID NO: 125002 - DNA, 601 bp, Human
tagtccatctaggtattattctgcttactcagaaaacaagcgagtcaacataatttaaaaaattccacaaaggcataacgttttttatttcacagcacctagaacaaagcctaacatatagcagacattcaataataattgctaaataaatgtggataaaactaccagttactattcacatattcattcaaaaataggttttagattatactgtcttaaatatcaagggaaatgaaaaatgtaaatgtataacttttacagaaaggtctttatgagtcctataatccttgttaaaatattracttaaaacctcacttcaataaaaaggtttagaaagggtgctaagtataatactatcagtaaattcagactaaaatggaggaataattgaagctctaatatggattttgaaagttagatttttcacaggatttcgatctttccgtgagcacacccaaatcaattccattttccattacttttcttgaatgaaaacatgatttctatttgaagcaaaaatgctgtttcaaatagccatgtaaaagatgggaaattaggaactttggaggtttgaaaagtagacatagctaaccaattaaga

SEQ ID NO: 125003 - DNA, 601 bp, Human
tcagcctactttacttaataaacatctaaactctgtaaataacttgtcaacagcatgccaaacattacctttcaaagaataatctgtaatttttgggtaagaaaaatacagcagggtatttgctttttgagaaaagtgagtaatttagccagaagtatcaaaatcactagttaacattcatggctcaattggttttgctactctacctcccattaggtcatctcccctgtctctcctcaaaattgctgagtggcatagatctttctaaaggttaattaaaattgagactaagaaatgtgtrcaatcatttgagacgctccagctatcaggaaagtcaagaaatcaagttcataaacctctgatctaaaaaaaaaaaacaaaaaatgacattaattccatactgcacagccagaatggtaatcaagtagattgctgatttgcttccctcaaacgtctaatattagtttattgcacatcaacttatagtcttttctaccttaatttgcagcttttatgaactatcatcttaataaaagtccttccaggcaaacttaaaatattaaacaatataacttctctagtattactacaggaactttat

SEQ ID NO: 125004 - DNA, 601 bp, Human
ataaacatccccactttaaaatctacttttaaatcctctcaaattcttagccaggcctatgaggatttaaaaagttaaataaatgctagataaattagacaatactaatttcagtcaagaatctcaaaggtaaaaccttggctcagatttgattttgtcccaatatatagggcatctatcaacaaccatcacttaacatttatagactcagcctactttacttaataaacatctaaactctgtaaataacttgtcaacagcatgccaaacattacctttcaaagaataatctgtaattttkgggtaagaaaaatacagcagggtatttgctttttgagaaaagtgagtaatttagccagaagtatcaaaatcactagttaacattcatggctcaattggttttgctactctacctcccattaggtcatctcccctgtctctcctcaaaattgctgagtggcatagatctttctaaaggttaattaaaattgagactaagaaatgtgtgcaatcatttgagacgctccagctatcaggaaagtcaagaaatcaagttcataaacctctgatctaaaaaaaaaaaacaaaaaatgacattaat

SEQ ID NO: 125005 - DNA, 601 bp, Human
gatctggcaataagaaactcattgcttattacacacttaaaagttgaagcaattcagcttcttataatttaaaatgactaaatactgctaatactagcagcatttattaaatatttaatgtttgtaagcactactccaagattttatatgtattaactcatttaatccataaacagcactcaggtaaagtactattccctacttaaagatgagaaaactgaggcacaaggagatttaataacttcccccagatcacacaactgagctcttaaccactatactatactgctctcagcacaatatatatatatatatgaggatgttcattgaaagagtacacagaaaatttgagaacctatattaccaaaaggtagaatgattaaactgtgctttgtctaagtaattgttttgtctaaacaatgggatgagatatagatatatacacacccacaggaactttaaaagcaatgatgtataatactgaatggaaatatatccatagtacatttaaaaagtgaaatccaaaaaatatatactgagtaggaagaaatgcacacaataactgttgaccaaaactattttcactggaaggattgagaca

SEQ ID NO: 125006 - DNA, 601 bp, Human
aggatctggcaataagaaactcattgcttattacacacttaaaagttgaagcaattcagcttcttataatttaaaatgactaaatactgctaatactagcagcatttattaaatatttaatgtttgtaagcactactccaagattttatatgtattaactcatttaatccataaacagcactcaggtaaagtactattccctacttaaagatgagaaaactgaggcacaaggagatttaataacttcccccagatcacacaactgagctcttaaccactatactatactgctctcagcacaatatatatatatatatgaggatgttcattgaaagagtacacagaaaatttgagaacctatattaccaaaaggtagaatgattaaactgtgctttgtctaagtaattgttttgtctaaacaatgggatgagatatagatatatacacacccacaggaactttaaaagcaatgatgtataatactgaatggaaatatatccatagtacatttaaaaagtgaaatccaaaaaatatatactgagtaggaagaaatgcacacaataactgttgaccaaaactattttcactggaaggattgaga

SEQ ID NO: 125007 - DNA, 601 bp, Human
caggagttcgagaccagcctggccaacagagtgaaaccccgtgtctactaaaaatacaaaaaattagctggacatagtggccggcgcctgtaatcccagctactcgggaggctgaggcaggagaatcacttgaacccgggaggcagaggttgcagtgagctgatatcacaccactgcactccagcccaggcaagagactccatctaaaaaaataaaataaaaataaaagcaacagaatagagaggtaattgtacaagattacttactgtaaactttgtagtagcaaaaacagtttaaaaaycaaatgtccaccagtggggaaatagtttaataaattatgatgcattcgcatcatggaatattatgtattcagctttaacaggtaattgggaggaattgccacaagatcttattgaatgaaaagatagtaaaatttatataatctatctttataaaataaataaaaataaatcctatatatgtttatgtattattagcatagagaaaaataaggaatacccacaaggttgttaaacataattatggttggcagggtgatacgggtggatgcaaaaatagagacaagaaaaaagactttact

SEQ ID NO: 125008 - DNA, 601 bp, Human
gataattaaaatgcttctcatgatttgtcaggggagtataattattttcttttccttttccaaaacttttatgatgaacattttcaagcatataaaaaagctgaataagtacaattaacttgtaaaaaatcactatctagattcaattattattaacattttactacatctgtcttatacatactaggttttaagttaaacttcaatataaaattcaaagtatttgaggactcaccttttcaaccttgtcataatttttagctttaatctgaagagaaacagaaaaatatagaattaataytatttttttagagcatcagtctgaatttttgaccaatttttaaccaactttgcaaattcatccctatagtttcttattaatttttctgttactttcaaaaataacagaagtgtgaagcaaacatggataaaatgcattgtaaatatacctgtgtaaattgaatctatatggattttcatacatttacatataaattttgtgaatttaataaaattctgtaaaagtcatgagatgaatacagaaatatacacatacccgataggtctacctgaataggatgtatccactgaagaaaaactt

SEQ ID NO: 125009 - DNA, 601 bp, Human
aatattttaaaattaagtatagtttcttaaaaattagtacaatacagttaatttattcatttactaaataactttaaatttttattttaaaagatttcttgtttaataaaggttcatacagctcatgaaaagcagggaaaaaaggttcaatcacattatacatttccaagatcaaggaggatgtgcttatgtcttatgagctggcagtaagtttccatttatcaggaacttttaaagatagaatcatttgaaaaggctcaataatttcatataagattctactgaaaaaaaaatgacatgrctcatgcctgtaatcttagcactttgggaggccgagttgggtggatcacttgaggtcaggagttcatgaccagcctggccaacatggtgaaaccccgtttctactaaaaatacaaaaaaattagctgggtgtggtggtgtgcgcctgtaatcccagctacttgggagcctgaggcaggagaattgcttgaaatggcgaggcagaggttgcagtgagctgagatcatgctattgcactccagcctgggcgacagagcgagactctgtctcaaagaaaaaaaaaatatgtacagattcatct

SEQ ID NO: 125010 - DNA, 601 bp, Human
accagcagaaaacaaagctggaaggcagaaagagttaaatagatacctcagcaactaagggagatgaagtttagaatttgagtcccatccaattagatggttggggtaaacaccttagacttttcattgtcttaggagtaaagactatgtcccaagaataaggtatttaatctgagattaatggtaaaactaaaacagacctgtcttcatagtataaaactaagcctccacaaagtccaagtaatctgacagtaatatttaacttcctgctaaaataaaacattcttcagaggaagatgamagaatctacagtctttacaatgtttcatttgtacatttgtacaatatctaaaagaaaaaatttaaacaggaaatagggaaatgtaaaccacagtcaagagaaaaagcaatcaaagaaaataaactccatggtggttgaaggcccagatgttggaattggcagatgaggactttataactactattataaatatgttctaagaaacaaagaaaaagatggtaatgaacacacaaggaatctcaactaagaaatggacaccataaaaaagaaatataaaaaataaaaaatttctaaaatgga

SEQ ID NO: 125011 - DNA, 601 bp, Human
tcagctgatccctaaaatgtacatacacagggaagaatacaaacagaccagcagaaaacaaagctggaaggcagaaagagttaaatagatacctcagcaactaagggagatgaagtttagaatttgagtcccatccaattagatggttggggtaaacaccttagacttttcattgtcttaggagtaaagactatgtcccaagaataaggtatttaatctgagattaatggtaaaactaaaacagacctgtcttcatagtataaaactaagcctccacaaagtccaagtaatctgacagtartatttaacttcctgctaaaataaaacattcttcagaggaagatgaaagaatctacagtctttacaatgtttcatttgtacatttgtacaatatctaaaagaaaaaatttaaacaggaaatagggaaatgtaaaccacagtcaagagaaaaagcaatcaaagaaaataaactccatggtggttgaaggcccagatgttggaattggcagatgaggactttataactactattataaatatgttctaagaaacaaagaaaaagatggtaatgaacacacaaggaatctcaactaagaaatgg

SEQ ID NO: 125012 - DNA, 601 bp, Human
cccatgttgtgcacttctgggatagctagaactcaagtcaaatgctgcagtcttactgtcttgaagtaacatggagttctggcctatgagagcagctggaaattgaggagacatccccaaaaggagaaagccagatcccgaaaatctgggcataaatgttctcaaatcctcagctgatccctaaaatgtacatacacagggaagaatacaaacagaccagcagaaaacaaagctggaaggcagaaagagttaaatagatacctcagcaactaagggagatgaagtttagaatttgagtccsatccaattagatggttggggtaaacaccttagacttttcattgtcttaggagtaaagactatgtcccaagaataaggtatttaatctgagattaatggtaaaactaaaacagacctgtcttcatagtataaaactaagcctccacaaagtccaagtaatctgacagtaatatttaacttcctgctaaaataaaacattcttcagaggaagatgaaagaatctacagtctttacaatgtttcatttgtacatttgtacaatatctaaaagaaaaaatttaaacaggaaatagggaaatgta

SEQ ID NO: 125013 - DNA, 601 bp, Human
caagcagtcctccagctcccacctccgcctcccagtatctgggactacaggcatgcaccaccacacccagctaatttttaacattttttgtatagattgggtctcactatgttgcccaggctggtctcaaactcctgggctaaagtcatctttccaccttggcctcccaaaatgctgggattacagacatgagccacaatttctggttagggatatatagtatacaagaaagatgataataaattgctatggcatctcttaaaaacaattctaatcactgtgcagaaatttaaaaataatyttaaacaggtataaaagtactgctgataggtaaaataaaacttgagaaggaaaggaaatttctcttgaaactcatactcaagcaaacattcaccccatagaccacaattcaggtaagaaagctgtctttagaacctgatcaacaacttttcacaatggcttacccagacttctcaggaggaaggcttccagatgttaaaactcgttcaaacaaaactcgggtattattgtcctctaggatattgaaaaagattttaattttttttaattcacttttacgatgcaacaatattttcatatg

SEQ ID NO: 125014 - DNA, 601 bp, Human
gagggcagtgaggaaaaggagaatgatggtcaggaacatcctaatggtggttggcttaaagagatcaaccaaggacttctctgtgaatttccatcttagtctttgttcacatgtcacagaaagattaagagatgatataacagtggttttatcagcaagggctgttactggggctttgtaaatattaatctctccctgtggcctgaacaggttcaggtgccagatttgttttcttatgactcagtagtctgtatagaagagttctattcatagatgagctaattcccccaaaggccactgraggagcactgttttaagaatacaaatccctcaaggaactttatggatttaacaagctgtaatatttcttcattatatcttacaaaatatgcaacaggaactacatttggtttaagatctgtcaaaacatatttatcaatttgataagaactattaggaaaaaaaagtaatacctaagatgacattcagattttcttttgtttttcttccctccacactccctccatcttgcccaccagatataagatataaggcactgacaatttcagggacagaatgaaactattaaatcccatttcaa

SEQ ID NO: 125015 - DNA, 601 bp, Human
gcttccattaacaaaaatgtctgaatatcaattatgggtagttttttctcaaaatattttatctggatcagacagagcaagacccaggctaaaagagggcagtgaggaaaaggagaatgatggtcaggaacatcctaatggtggttggcttaaagagatcaaccaaggacttctctgtgaatttccatcttagtctttgttcacatgtcacagaaagattaagagatgatataacagtggttttatcagcaagggctgttactggggctttgtaaatattaatctctccctgtggcctgarcaggttcaggtgccagatttgttttcttatgactcagtagtctgtatagaagagttctattcatagatgagctaattcccccaaaggccactggaggagcactgttttaagaatacaaatccctcaaggaactttatggatttaacaagctgtaatatttcttcattatatcttacaaaatatgcaacaggaactacatttggtttaagatctgtcaaaacatatttatcaatttgataagaactattaggaaaaaaaagtaatacctaagatgacattcagattttcttttgtttttct

SEQ ID NO: 125016 - DNA, 601 bp, Human
acagagcagtctcaatgccgtggccactgggaggcagagaagtagacaagtgactttgtgtaagacaaccagggactgaactaaagtcagtttttgtcaaagagtgtttctgagttacacaagtcatttgtttagcaatcctgtttcaagtcaattattcaacagtgtatttaatcagaagggccttgttcaaaaagaatctagagaggctactaacccattcctaagtaaagaaaccaaatctatcagtgaagaaagtttccaccagctgttcaggtaatctgcacatagcagcattcctttttttttttttgatacagagtgtcgctcttgttgcccaggctggagtgcaatggcaccatcttggctcactgcaacctccgcctcccgggttcaagtgattctcctgcctcagcctcccaagtagctgggattacatgtatatgccaccaggcccagaaaatttttgtatttttaataaagacaaagtttcaccatgttagtcaggctggtctcaaactcctgacctcaggtgatccacctgccttggcctcccaaagtgccaggattataagtgtaaaccactgcacctggccatagc

SEQ ID NO: 125017 - DNA, 601 bp, Human
atatggtattacttgtcttttttttggagagcgtcttgctctgtcacccaggctggagtgcagtggcgctacctcggctcactgaaacctctgcctcacaggttcaagcaattcttctgccttcgcctcccaagtagctgggattataggcttgggctaccacgcccagctaatttttttggtatttttagtagagacggggtttcactttgttggccaggctggtcttgaacccctggcctcaaataatctgcccgcctcggccttccaaagtgttgggatttacaggagtgagccaccrcacctggcctacttgtgtcttaagttttgatggtaactgatatttttaaaaaactcacaacttgaaagtgatgcttgaaaggataagaaagtctgaattagaggcagctgactttgttttgagaggcgatttttagctttaatgggaaaatactggaaactaaacacacttttgaccaatttatataaccttgctacatataaatttatatgagtaaatgattcagcataacctttttttacaagtaagacttttatgggacatttgaagctgattttaaatgtcagattatttaatcac

SEQ ID NO: 125018 - DNA, 601 bp, Human; identical to SEQ ID NO: 58271

SEQ ID NO: 125019 - DNA, 601 bp, Human; identical to SEQ ID NO: 117854

SEQ ID NO: 125020 - DNA, 601 bp, Human; identical to SEQ ID NO: 117855

SEQ ID NO: 125021 - DNA, 601 bp, Human; identical to SEQ ID NO: 117856

SEQ ID NO: 125022 - DNA, 601 bp, Human; identical to SEQ ID NO: 117857

SEQ ID NO: 125023 - DNA, 601 bp, Human; identical to SEQ ID NO: 117858

SEQ ID NO: 125024 - DNA, 601 bp, Human; identical to SEQ ID NO: 117859

SEQ ID NO: 125025 - DNA, 601 bp, Human; identical to SEQ ID NO: 117860

SEQ ID NO: 125026 - DNA, 601 bp, Human; identical to SEQ ID NO: 117861

SEQ ID NO: 125027 - DNA, 601 bp, Human; identical to SEQ ID NO: 117862

SEQ ID NO: 125028 - DNA, 601 bp, Human; identical to SEQ ID NO: 117863

SEQ ID NO: 125029 - DNA, 601 bp, Human; identical to SEQ ID NO: 117864

SEQ ID NO: 125030 - DNA, 601 bp, Human; identical to SEQ ID NO: 117865

SEQ ID NO: 125031 - DNA, 601 bp, Human; identical to SEQ ID NO: 117866

SEQ ID NO: 125032 - DNA, 601 bp, Human; identical to SEQ ID NO: 117867

SEQ ID NO: 125033 - DNA, 601 bp, Human; identical to SEQ ID NO: 117868

SEQ ID NO: 125034 - DNA, 601 bp, Human; identical to SEQ ID NO: 117869

SEQ ID NO: 125035 - DNA, 601 bp, Human; identical to SEQ ID NO: 117870

SEQ ID NO: 125036 - DNA, 601 bp, Human; identical to SEQ ID NO: 117871

SEQ ID NO: 125037 - DNA, 601 bp, Human; identical to SEQ ID NO: 117872

SEQ ID NO: 125038 - DNA, 601 bp, Human; identical to SEQ ID NO: 117873

SEQ ID NO: 125039 - DNA, 601 bp, Human; identical to SEQ ID NO: 117874

SEQ ID NO: 125040 - DNA, 601 bp, Human; identical to SEQ ID NO: 117875

SEQ ID NO: 125041 - DNA, 601 bp, Human; identical to SEQ ID NO: 117876

SEQ ID NO: 125042 - DNA, 601 bp, Human; identical to SEQ ID NO: 117877

SEQ ID NO: 125043 - DNA, 601 bp, Human; identical to SEQ ID NO: 117878

SEQ ID NO: 125044 - DNA, 601 bp, Human; identical to SEQ ID NO: 117879

SEQ ID NO: 125045 - DNA, 601 bp, Human; identical to SEQ ID NO: 117880

SEQ ID NO: 125046 - DNA, 601 bp, Human; identical to SEQ ID NO: 117881

SEQ ID NO: 125047 - DNA, 601 bp, Human; identical to SEQ ID NO: 117882

SEQ ID NO: 125048 - DNA, 601 bp, Human; identical to SEQ ID NO: 117883

SEQ ID NO: 125049 - DNA, 601 bp, Human; identical to SEQ ID NO: 117884

SEQ ID NO: 125050 - DNA, 601 bp, Human; identical to SEQ ID NO: 117885

SEQ ID NO: 125051 - DNA, 601 bp, Human; identical to SEQ ID NO: 117886

SEQ ID NO: 125052 - DNA, 601 bp, Human; identical to SEQ ID NO: 117887

SEQ ID NO: 125053 - DNA, 601 bp, Human; identical to SEQ ID NO: 117888

SEQ ID NO: 125054 - DNA, 601 bp, Human; identical to SEQ ID NO: 117889

SEQ ID NO: 125055 - DNA, 601 bp, Human; identical to SEQ ID NO: 117890

SEQ ID NO: 125056 - DNA, 601 bp, Human; identical to SEQ ID NO: 117891

SEQ ID NO: 125057 - DNA, 601 bp, Human; identical to SEQ ID NO: 117892

SEQ ID NO: 125058 - DNA, 601 bp, Human; identical to SEQ ID NO: 117893

SEQ ID NO: 125059 - DNA, 601 bp, Human; identical to SEQ ID NO: 117894

SEQ ID NO: 125060 - DNA, 601 bp, Human; identical to SEQ ID NO: 117895

SEQ ID NO: 125061 - DNA, 601 bp, Human; identical to SEQ ID NO: 117896

SEQ ID NO: 125062 - DNA, 601 bp, Human; identical to SEQ ID NO: 117897

SEQ ID NO: 125063 - DNA, 601 bp, Human; identical to SEQ ID NO: 117898

SEQ ID NO: 125064 - DNA, 601 bp, Human; identical to SEQ ID NO: 117899

SEQ ID NO: 125065 - DNA, 601 bp, Human; identical to SEQ ID NO: 117900

SEQ ID NO: 125066 - DNA, 601 bp, Human; identical to SEQ ID NO: 117901

SEQ ID NO: 125067 - DNA, 601 bp, Human; identical to SEQ ID NO: 117902

SEQ ID NO: 125068 - DNA, 601 bp, Human; identical to SEQ ID NO: 117903

SEQ ID NO: 125069 - DNA, 601 bp, Human; identical to SEQ ID NO: 117904

SEQ ID NO: 125070 - DNA, 601 bp, Human; identical to SEQ ID NO: 117905

SEQ ID NO: 125071 - DNA, 601 bp, Human; identical to SEQ ID NO: 117854

SEQ ID NO: 125072 - DNA, 601 bp, Human; identical to SEQ ID NO: 117855

SEQ ID NO: 125073 - DNA, 601 bp, Human; identical to SEQ ID NO: 117856

SEQ ID NO: 125074 - DNA, 601 bp, Human; identical to SEQ ID NO: 117857

SEQ ID NO: 125075 - DNA, 601 bp, Human; identical to SEQ ID NO: 117858

SEQ ID NO: 125076 - DNA, 601 bp, Human; identical to SEQ ID NO: 117859

SEQ ID NO: 125077 - DNA, 601 bp, Human; identical to SEQ ID NO: 117860

SEQ ID NO: 125078 - DNA, 601 bp, Human; identical to SEQ ID NO: 117861

SEQ ID NO: 125079 - DNA, 601 bp, Human; identical to SEQ ID NO: 117862

SEQ ID NO: 125080 - DNA, 601 bp, Human; identical to SEQ ID NO: 117863

SEQ ID NO: 125081 - DNA, 601 bp, Human; identical to SEQ ID NO: 117864

SEQ ID NO: 125082 - DNA, 601 bp, Human; identical to SEQ ID NO: 117865

SEQ ID NO: 125083 - DNA, 601 bp, Human; identical to SEQ ID NO: 117866

SEQ ID NO: 125084 - DNA, 601 bp, Human; identical to SEQ ID NO: 117867

SEQ ID NO: 125085 - DNA, 601 bp, Human; identical to SEQ ID NO: 117868

SEQ ID NO: 125086 - DNA, 601 bp, Human; identical to SEQ ID NO: 117869

SEQ ID NO: 125087 - DNA, 601 bp, Human; identical to SEQ ID NO: 117870

SEQ ID NO: 125088 - DNA, 601 bp, Human; identical to SEQ ID NO: 117871

SEQ ID NO: 125089 - DNA, 601 bp, Human; identical to SEQ ID NO: 117872

SEQ ID NO: 125090 - DNA, 601 bp, Human; identical to SEQ ID NO: 117873

SEQ ID NO: 125091 - DNA, 601 bp, Human; identical to SEQ ID NO: 117874

SEQ ID NO: 125092 - DNA, 601 bp, Human; identical to SEQ ID NO: 117875

SEQ ID NO: 125093 - DNA, 601 bp, Human; identical to SEQ ID NO: 117876

SEQ ID NO: 125094 - DNA, 601 bp, Human; identical to SEQ ID NO: 117877

SEQ ID NO: 125095 - DNA, 601 bp, Human; identical to SEQ ID NO: 117878

SEQ ID NO: 125096 - DNA, 601 bp, Human; identical to SEQ ID NO: 117879

SEQ ID NO: 125097 - DNA, 601 bp, Human; identical to SEQ ID NO: 117880

SEQ ID NO: 125098 - DNA, 601 bp, Human; identical to SEQ ID NO: 117881

SEQ ID NO: 125099 - DNA, 601 bp, Human; identical to SEQ ID NO: 117882

SEQ ID NO: 125100 - DNA, 601 bp, Human; identical to SEQ ID NO: 117883

SEQ ID NO: 125101 - DNA, 601 bp, Human; identical to SEQ ID NO: 117884

SEQ ID NO: 125102 - DNA, 601 bp, Human; identical to SEQ ID NO: 117885

SEQ ID NO: 125103 - DNA, 601 bp, Human; identical to SEQ ID NO: 117886

SEQ ID NO: 125104 - DNA, 601 bp, Human; identical to SEQ ID NO: 117887

SEQ ID NO: 125105 - DNA, 601 bp, Human; identical to SEQ ID NO: 117888

SEQ ID NO: 125106 - DNA, 601 bp, Human; identical to SEQ ID NO: 117889

SEQ ID NO: 125107 - DNA, 601 bp, Human; identical to SEQ ID NO: 117890

SEQ ID NO: 125108 - DNA, 601 bp, Human; identical to SEQ ID NO: 117891

SEQ ID NO: 125109 - DNA, 601 bp, Human; identical to SEQ ID NO: 117892

SEQ ID NO: 125110 - DNA, 601 bp, Human; identical to SEQ ID NO: 117893

SEQ ID NO: 125111 - DNA, 601 bp, Human; identical to SEQ ID NO: 117894

SEQ ID NO: 125112 - DNA, 601 bp, Human; identical to SEQ ID NO: 117895

SEQ ID NO: 125113 - DNA, 601 bp, Human; identical to SEQ ID NO: 117896

SEQ ID NO: 125114 - DNA, 601 bp, Human; identical to SEQ ID NO: 117897

SEQ ID NO: 125115 - DNA, 601 bp, Human; identical to SEQ ID NO: 117898

SEQ ID NO: 125116 - DNA, 601 bp, Human; identical to SEQ ID NO: 117899

SEQ ID NO: 125117 - DNA, 601 bp, Human; identical to SEQ ID NO: 117900

SEQ ID NO: 125118 - DNA, 601 bp, Human; identical to SEQ ID NO: 117901

SEQ ID NO: 125119 - DNA, 601 bp, Human; identical to SEQ ID NO: 117902

SEQ ID NO: 125120 - DNA, 601 bp, Human; identical to SEQ ID NO: 117903

SEQ ID NO: 125121 - DNA, 601 bp, Human; identical to SEQ ID NO: 117904

SEQ ID NO: 125122 - DNA, 601 bp, Human; identical to SEQ ID NO: 117905

SEQ ID NO: 125123 - DNA, 601 bp, Human; identical to SEQ ID NO: 117854

SEQ ID NO: 125124 - DNA, 601 bp, Human; identical to SEQ ID NO: 117855

SEQ ID NO: 125125 - DNA, 601 bp, Human; identical to SEQ ID NO: 117856

SEQ ID NO: 125126 - DNA, 601 bp, Human; identical to SEQ ID NO: 117857

SEQ ID NO: 125127 - DNA, 601 bp, Human; identical to SEQ ID NO: 117858

SEQ ID NO: 125128 - DNA, 601 bp, Human; identical to SEQ ID NO: 117859

SEQ ID NO: 125129 - DNA, 601 bp, Human; identical to SEQ ID NO: 117860

SEQ ID NO: 125130 - DNA, 601 bp, Human; identical to SEQ ID NO: 117861

SEQ ID NO: 125131 - DNA, 601 bp, Human; identical to SEQ ID NO: 117862

SEQ ID NO: 125132 - DNA, 601 bp, Human; identical to SEQ ID NO: 117863

SEQ ID NO: 125133 - DNA, 601 bp, Human; identical to SEQ ID NO: 117864

SEQ ID NO: 125134 - DNA, 601 bp, Human; identical to SEQ ID NO: 117865

SEQ ID NO: 125135 - DNA, 601 bp, Human; identical to SEQ ID NO: 117866

SEQ ID NO: 125136 - DNA, 601 bp, Human; identical to SEQ ID NO: 117867

SEQ ID NO: 125137 - DNA, 601 bp, Human; identical to SEQ ID NO: 117868

SEQ ID NO: 125138 - DNA, 601 bp, Human; identical to SEQ ID NO: 117869

SEQ ID NO: 125139 - DNA, 601 bp, Human; identical to SEQ ID NO: 117870

SEQ ID NO: 125140 - DNA, 601 bp, Human; identical to SEQ ID NO: 117871

SEQ ID NO: 125141 - DNA, 601 bp, Human; identical to SEQ ID NO: 117872

SEQ ID NO: 125142 - DNA, 601 bp, Human; identical to SEQ ID NO: 117873

SEQ ID NO: 125143 - DNA, 601 bp, Human; identical to SEQ ID NO: 117874

SEQ ID NO: 125144 - DNA, 601 bp, Human; identical to SEQ ID NO: 117875

SEQ ID NO: 125145 - DNA, 601 bp, Human; identical to SEQ ID NO: 117876

SEQ ID NO: 125146 - DNA, 601 bp, Human; identical to SEQ ID NO: 117877

SEQ ID NO: 125147 - DNA, 601 bp, Human; identical to SEQ ID NO: 117878

SEQ ID NO: 125148 - DNA, 601 bp, Human; identical to SEQ ID NO: 117879

SEQ ID NO: 125149 - DNA, 601 bp, Human; identical to SEQ ID NO: 117880

SEQ ID NO: 125150 - DNA, 601 bp, Human; identical to SEQ ID NO: 117881

SEQ ID NO: 125151 - DNA, 601 bp, Human; identical to SEQ ID NO: 117882

SEQ ID NO: 125152 - DNA, 601 bp, Human; identical to SEQ ID NO: 117883

SEQ ID NO: 125153 - DNA, 601 bp, Human; identical to SEQ ID NO: 117884

SEQ ID NO: 125154 - DNA, 601 bp, Human; identical to SEQ ID NO: 117885

SEQ ID NO: 125155 - DNA, 601 bp, Human; identical to SEQ ID NO: 117886

SEQ ID NO: 125156 - DNA, 601 bp, Human; identical to SEQ ID NO: 117887

SEQ ID NO: 125157 - DNA, 601 bp, Human; identical to SEQ ID NO: 117888

SEQ ID NO: 125158 - DNA, 601 bp, Human; identical to SEQ ID NO: 117889

SEQ ID NO: 125159 - DNA, 601 bp, Human; identical to SEQ ID NO: 117890

SEQ ID NO: 125160 - DNA, 601 bp, Human; identical to SEQ ID NO: 117891

SEQ ID NO: 125161 - DNA, 601 bp, Human; identical to SEQ ID NO: 117892

SEQ ID NO: 125162 - DNA, 601 bp, Human; identical to SEQ ID NO: 117893

SEQ ID NO: 125163 - DNA, 601 bp, Human; identical to SEQ ID NO: 117894

SEQ ID NO: 125164 - DNA, 601 bp, Human; identical to SEQ ID NO: 117895

SEQ ID NO: 125165 - DNA, 601 bp, Human; identical to SEQ ID NO: 117896

SEQ ID NO: 125166 - DNA, 601 bp, Human; identical to SEQ ID NO: 117897

SEQ ID NO: 125167 - DNA, 601 bp, Human; identical to SEQ ID NO: 117898

SEQ ID NO: 125168 - DNA, 601 bp, Human; identical to SEQ ID NO: 117899

SEQ ID NO: 125169 - DNA, 601 bp, Human; identical to SEQ ID NO: 117900

SEQ ID NO: 125170 - DNA, 601 bp, Human; identical to SEQ ID NO: 117901

SEQ ID NO: 125171 - DNA, 601 bp, Human; identical to SEQ ID NO: 117902

SEQ ID NO: 125172 - DNA, 601 bp, Human; identical to SEQ ID NO: 117903

SEQ ID NO: 125173 - DNA, 601 bp, Human; identical to SEQ ID NO: 117904

SEQ ID NO: 125174 - DNA, 601 bp, Human; identical to SEQ ID NO: 117905

SEQ ID NO: 125175 - DNA, 601 bp, Human; identical to SEQ ID NO: 117854

SEQ ID NO: 125176 - DNA, 601 bp, Human; identical to SEQ ID NO: 117855

SEQ ID NO: 125177 - DNA, 601 bp, Human; identical to SEQ ID NO: 117856

SEQ ID NO: 125178 - DNA, 601 bp, Human; identical to SEQ ID NO: 117857

SEQ ID NO: 125179 - DNA, 601 bp, Human; identical to SEQ ID NO: 117858

SEQ ID NO: 125180 - DNA, 601 bp, Human; identical to SEQ ID NO: 117859

SEQ ID NO: 125181 - DNA, 601 bp, Human; identical to SEQ ID NO: 117860

SEQ ID NO: 125182 - DNA, 601 bp, Human; identical to SEQ ID NO: 117861

SEQ ID NO: 125183 - DNA, 601 bp, Human; identical to SEQ ID NO: 117862

SEQ ID NO: 125184 - DNA, 601 bp, Human; identical to SEQ ID NO: 117863

SEQ ID NO: 125185 - DNA, 601 bp, Human; identical to SEQ ID NO: 117864

SEQ ID NO: 125186 - DNA, 601 bp, Human; identical to SEQ ID NO: 117865

SEQ ID NO: 125187 - DNA, 601 bp, Human; identical to SEQ ID NO: 117866

SEQ ID NO: 125188 - DNA, 601 bp, Human; identical to SEQ ID NO: 117867

SEQ ID NO: 125189 - DNA, 601 bp, Human; identical to SEQ ID NO: 117868

SEQ ID NO: 125190 - DNA, 601 bp, Human; identical to SEQ ID NO: 117869

SEQ ID NO: 125191 - DNA, 601 bp, Human; identical to SEQ ID NO: 117870

SEQ ID NO: 125192 - DNA, 601 bp, Human; identical to SEQ ID NO: 117871

SEQ ID NO: 125193 - DNA, 601 bp, Human; identical to SEQ ID NO: 117872

SEQ ID NO: 125194 - DNA, 601 bp, Human; identical to SEQ ID NO: 117873

SEQ ID NO: 125195 - DNA, 601 bp, Human; identical to SEQ ID NO: 117874

SEQ ID NO: 125196 - DNA, 601 bp, Human; identical to SEQ ID NO: 117875

SEQ ID NO: 125197 - DNA, 601 bp, Human; identical to SEQ ID NO: 117876

SEQ ID NO: 125198 - DNA, 601 bp, Human; identical to SEQ ID NO: 117877

SEQ ID NO: 125199 - DNA, 601 bp, Human; identical to SEQ ID NO: 117878

SEQ ID NO: 125200 - DNA, 601 bp, Human; identical to SEQ ID NO: 117879

SEQ ID NO: 125201 - DNA, 601 bp, Human; identical to SEQ ID NO: 117880

SEQ ID NO: 125202 - DNA, 601 bp, Human; identical to SEQ ID NO: 117881

SEQ ID NO: 125203 - DNA, 601 bp, Human; identical to SEQ ID NO: 117882

SEQ ID NO: 125204 - DNA, 601 bp, Human; identical to SEQ ID NO: 117883

SEQ ID NO: 125205 - DNA, 601 bp, Human; identical to SEQ ID NO: 117884

SEQ ID NO: 125206 - DNA, 601 bp, Human; identical to SEQ ID NO: 117885

SEQ ID NO: 125207 - DNA, 601 bp, Human; identical to SEQ ID NO: 117886

SEQ ID NO: 125208 - DNA, 601 bp, Human; identical to SEQ ID NO: 117887

SEQ ID NO: 125209 - DNA, 601 bp, Human; identical to SEQ ID NO: 117888

SEQ ID NO: 125210 - DNA, 601 bp, Human; identical to SEQ ID NO: 117889

SEQ ID NO: 125211 - DNA, 601 bp, Human; identical to SEQ ID NO: 117890

SEQ ID NO: 125212 - DNA, 601 bp, Human; identical to SEQ ID NO: 117891

SEQ ID NO: 125213 - DNA, 601 bp, Human; identical to SEQ ID NO: 117892

SEQ ID NO: 125214 - DNA, 601 bp, Human; identical to SEQ ID NO: 117893

SEQ ID NO: 125215 - DNA, 601 bp, Human; identical to SEQ ID NO: 117894

SEQ ID NO: 125216 - DNA, 601 bp, Human; identical to SEQ ID NO: 117895

SEQ ID NO: 125217 - DNA, 601 bp, Human; identical to SEQ ID NO: 117896

SEQ ID NO: 125218 - DNA, 601 bp, Human; identical to SEQ ID NO: 117897

SEQ ID NO: 125219 - DNA, 601 bp, Human; identical to SEQ ID NO: 117898

SEQ ID NO: 125220 - DNA, 601 bp, Human; identical to SEQ ID NO: 117899

SEQ ID NO: 125221 - DNA, 601 bp, Human; identical to SEQ ID NO: 117900

SEQ ID NO: 125222 - DNA, 601 bp, Human; identical to SEQ ID NO: 117901

SEQ ID NO: 125223 - DNA, 601 bp, Human; identical to SEQ ID NO: 117902

SEQ ID NO: 125224 - DNA, 601 bp, Human; identical to SEQ ID NO: 117903

SEQ ID NO: 125225 - DNA, 601 bp, Human; identical to SEQ ID NO: 117904

SEQ ID NO: 125226 - DNA, 601 bp, Human; identical to SEQ ID NO: 117905

SEQ ID NO: 125227 - DNA, 601 bp, Human
acctcagatttgatttgagtctctcattgaaaacgacaggcttagaacacagcaagagcaggcgggtgtcggcaggaagagaggtctgcgatccacagagtgaccgagggctttaggaggtggtgagagatggcactaagaggtcaggagggatatgggaaagcaaaggcaagtagcgctgccactgtgcaccgcatttcagcagcgttcagcgagaaacttctttgaagtgtggccgagcttgcctgaaagcaccgcgggcggccagggtgggctctgtactcactatttggcagagtcygacagctggtactccctcctcctgtcgtaacactcctggatgcctggatcttgccagagctgcttgatggcctccacctgctccctggagagcatggagaccttgtccacttccacttctctgattatctgggcattttcctactcaaaggaaagagaaccttgcatcaggcaaaggaaaggaagccaacccattggcaatgtcggtacaagtcttgccctggtctgtggatttggagagctctcactaggcatggggcgtggtgggcaccctcccaggggccgctcacagccaagacac

SEQ ID NO: 125228 - DNA, 601 bp, Human
cgggacaggtgtgaaagagctgagctgcagaagcaggagttattgccactttaagaaggacccatatcaaactatttacccggtgaccagactgaggaggcattgccccgggatattattatttatttatttatttacattttctttttttttgagacagagtctcactctgtcactcaggctgtactgcaggagtgtaatcatggctcattgcaacctcaacctcctaggctcaagacatcctcccgcctcagcctcccgagcagctgcccagctaatttttgtaatttttgcagagacraggtcttgctctgctgcccaggctagtctcgaattcctggtttcaagcgatcctcccacctctgcctcccaagtccctgggattacagatgtgaacaggaaatgcccaagaaagtgaaaatctgtcatctctatgggacagtttgcatgctgggacatctaaatagaaatctttttaccttcaaggattaatgaattaaaaattgagctgtatggatccaaaatacagtgtgtaggccttcgcaggcagccaataaacaaaggattgagcttcctgtgtgtgctgcgagcgcagcctcct

SEQ ID NO: 125229 - DNA, 601 bp, Human
tgcctgctcagagggtgacagtggcacccaaagggaaggaggtacgtctggggaagggatttctgagccctcagaggatggaagatgatacgggacaggtgtgaaagagctgagctgcagaagcaggagttattgccactttaagaaggacccatatcaaactatttacccggtgaccagactgaggaggcattgccccgggatattattatttatttatttatttacattttctttttttttgagacagagtctcactctgtcactcaggctgtactgcaggagtgtaatcatggctcaytgcaacctcaacctcctaggctcaagacatcctcccgcctcagcctcccgagcagctgcccagctaatttttgtaatttttgcagagacgaggtcttgctctgctgcccaggctagtctcgaattcctggtttcaagcgatcctcccacctctgcctcccaagtccctgggattacagatgtgaacaggaaatgcccaagaaagtgaaaatctgtcatctctatgggacagtttgcatgctgggacatctaaatagaaatctttttaccttcaaggattaatgaattaaaaattgagctg

SEQ ID NO: 125230 - DNA, 601 bp, Human
agagcactccgtctcttcctcctgggttctaagctctatcgcttctatttgaccagcgagggagacagtggggctggaaggaccaggatgttggaaatggctctctccaacaccccatctgtcatcctccctccagagccccttctccctcccactcacccttgtccaagagcattatataatggagatgctgttctctaaagctttgctcaatgaattaaatagtttctaagaaaatacacaggcgtaaaacaggccgaggagaaattcaaaacaacagcaacaagaacaagttttcctsttgaagacactgggaaactacatctcctaaaataacccaaaacttgccttaacttatttttggccatatattgaagccctgagcttaaaacatattttttttttctgtagtaaaataagagaatcctttaaaaaaaaaaaaaactttaaggcctttctaaaagacacttttaggtaaaataactgtaactcaggccctcgctaacaaaagagttgtagatgcagagcccgctgcatgctgaggtcggccctgccctgtcccagcaccgcatcaggggctgagcaggtccgcatgcaggct

SEQ ID NO: 125231 - DNA, 601 bp, Human
ggaagtcaccccccactcacagtgagccccacacagacacacgaattccatcaatgactttcctgagagccagtgccaggccaggcttctccatccttcctacgactgttttgaagacaatatgggtcagaaggacttccatgcgccttctgggacatctgcagagcactccgtctcttcctcctgggttctaagctctatcgcttctatttgaccagcgagggagacagtggggctggaaggaccaggatgttggaaatggctctctccaacaccccatctgtcatcctccctccagagscccttctccctcccactcacccttgtccaagagcattatataatggagatgctgttctctaaagctttgctcaatgaattaaatagtttctaagaaaatacacaggcgtaaaacaggccgaggagaaattcaaaacaacagcaacaagaacaagttttcctgttgaagacactgggaaactacatctcctaaaataacccaaaacttgccttaacttatttttggccatatattgaagccctgagcttaaaacatattttttttttctgtagtaaaataagagaatcctttaaaaaaaaa

SEQ ID NO: 125232 - DNA, 601 bp, Human
tgttagtttgtacatattattcttcacagttttcatacacattttttgtatccttaattttctaaggataaatcttggagaaggaaatagaggagaaaggaaatatgattcatctttaaggaaaagacatcgataatcactacattcaatttgtgggatacagaagtatacatttgtgtgtgtgtgtgtgtgtgtgtgtgtgtgtgtgtgtgtgtgtatgagtgtgtgttacacataagaatcattccagtttccagtaaggaaaccctttttctccaagggtaacaggaaggtgacttcctctccattccagggttgagacctacctaccacaattctaaatacccttggcagagagggtcactctgtcctaagagatataatccctgcttaggaataacacgtttaagaatccacctggggacttccaagcctgggcagattcttcatggtacatcagggagacagacttaccgaaagatgatgttttccaagtcaaatggatactcaatgatgccggtggtgggcactcggacgcgaagcacatcttgttgggtaggcacgaatgatggtgtggcgatgcggtcaatgtcagtcaggt

SEQ ID NO: 125233 - DNA, 601 bp, Human
ctgtgacaaccactgtagagtccctggataccagactcaagagggacgcagcggccagctgtcttccgggtctcccaggctggcttcaggacccgagcctattctgtttttgtggctcctctaacttacctgtaaatcctttctgcattccctggatgccacctcttgttccctataaaaacctacaagtgtcctctgtccagtacagaaatccaaagcctctatatctgtgtctttgggaaaaatttcagcaactcctagcccagggatcatgagctcaaatgctacaagaatcaggcartttatgggaatgagccaagtgggctccccaaagtacaaaacatacatggcacaacagccgggggccctgtctacagggaagcctgccgcgtacctgcagccaagctctgcagaacaagacgcaggcttgccatgaccacagtctctgccttttcaggagaaacaaggtatccaatgtgttagctcaaacgtttttttagtaacaccaagtgagccaaagaaaatacataatggaccagatacagctgccaagtaacccccacccacccctacatcaccaccccaccacacacacacacca

SEQ ID NO: 125234 - DNA, 601 bp, Human
tgccttcttagaaaccacagaataggctctggcttccacagctacccaaacttcccgcccagcatacctcgttgtcacactcagccaggacctggtcatattcactcagagcaaccaagaaaataatggaggtgacactctcaaagcagtgaatccacttccgtctttccgatcgttggccaccaacatccaccatcctgttgtgtagaaacacagatccttcaaaggttggaatacatgacacttcggggaaaaaggacatgaattatagcatggaaaccagtgctcttggagtcctcartaatttctaagagagaaaagaggttctaagttttaaaatgtttgatgctgctgctttaagcaatgagggaccactggatgtttcctagcaaagaagggagagaatgtaaatgacatttctgaagacatgcagaggtgactcagggagcctgccggttaggaagctaaccagtgtccagacagaaaacgcaaacgttcacttgggttctgtgacaaccactgtagagtccctggataccagactcaagagggacgcagcggccagctgtcttccgggtctcccaggctggcttcaggaccc

SEQ ID NO: 125235 - DNA, 601 bp, Human
tcattcagaatctctggggttggactcaggcaccaggtttttgttaagtccctcagcaaactccagtgtgcattcaagtttagaacccaggttccaggcccgtgattctcagcctttcatatgtatttgaattacctgggttcttgttaaaatgcagatgctgatgtagttggtcggggttgattcagtaagactgcatttctaacaagccatgcaggtgatgcctgtgctgctggtccacaggtcacactttgagtagcaagactgtttgacctaatgacgagggtctatttcctgaccyggctgccttcttagaaaccacagaataggctctggcttccacagctacccaaacttcccgcccagcatacctcgttgtcacactcagccaggacctggtcatattcactcagagcaaccaagaaaataatggaggtgacactctcaaagcagtgaatccacttccgtctttccgatcgttggccaccaacatccaccatcctgttgtgtagaaacacagatccttcaaaggttggaatacatgacacttcggggaaaaaggacatgaattatagcatggaaaccagtgctcttggagtcc

SEQ ID NO: 125236 - DNA, 601 bp, Human
tttttagaagagaaaatatttaatttctaagcactttgggctgagatactggtcccttgtgcaccttactaatcgtttgagtttcctgaggaacgtcacaaataattcctgaaacaaatttgcagctattttttttatattgataactgaatgtcttgcctttaaaaaaaaaaaaaaaatctccaactgagagggctgggcgacagccagcatttccgttctttgcacaatgacacaattaaatgggttaatcctccactaattaggtaatataagctatgctcctcagagaaaagtgtgytctcaagaaatacaagatacaatttgttcagttattgcctaatcctggactgagtcctttattgatttactttcacgccttggaaacaaaagacattttttaaaaggtcaagaggtcttaatgcaagttcaggggaaaagatgacgaggaggacatgagtgttccaccgatactgtccccaacctgacagagaagtggctgtgagggtcctcttcactctcagggcagctcccactgatggaattggaagcagccagtgctatggccactctgaggggacaacgcatgcctgaccaggct

SEQ ID NO: 125237 - DNA, 601 bp, Human
tgatttttagaagagaaaatatttaatttctaagcactttgggctgagatactggtcccttgtgcaccttactaatcgtttgagtttcctgaggaacgtcacaaataattcctgaaacaaatttgcagctattttttttatattgataactgaatgtcttgcctttaaaaaaaaaaaaaaaatctccaactgagagggctgggcgacagccagcatttccgttctttgcacaatgacacaattaaatgggttaatcctccactaattaggtaatataagctatgctcctcagagaaaagtstgctctcaagaaatacaagatacaatttgttcagttattgcctaatcctggactgagtcctttattgatttactttcacgccttggaaacaaaagacattttttaaaaggtcaagaggtcttaatgcaagttcaggggaaaagatgacgaggaggacatgagtgttccaccgatactgtccccaacctgacagagaagtggctgtgagggtcctcttcactctcagggcagctcccactgatggaattggaagcagccagtgctatggccactctgaggggacaacgcatgcctgaccag

SEQ ID NO: 125238 - DNA, 601 bp, Human
gctcagcacacacactcaagagggacacgccataaatcactctttccccacaacttccagacacccaggtttgttctgccactcagtacacattgggggaattacgatctggaatgtattaaagctttaaaattattatgatctgaatgataatgatctccaaggaaataaaatatatgaaaacttcccagacagtatacagagtggatataatacatatctacaaccaggaggggaaagtctggagtggcaaccacttaatttttctccaaatattttgtgatttttagaagagaaaatrtttaatttctaagcactttgggctgagatactggtcccttgtgcaccttactaatcgtttgagtttcctgaggaacgtcacaaataattcctgaaacaaatttgcagctattttttttatattgataactgaatgtcttgcctttaaaaaaaaaaaaaaaatctccaactgagagggctgggcgacagccagcatttccgttctttgcacaatgacacaattaaatgggttaatcctccactaattaggtaatataagctatgctcctcagagaaaagtgtgctctcaagaaatacaaga

SEQ ID NO: 125239 - DNA, 601 bp, Human
tagaaagacagtgataatttctaaatgttagacattggcaagaagatattaaatgctcctaatttactgagaacagacagggcacaaacaaatcttatctgtgacaataattgttctagatagcattctgctctttctcaagtatttctaagaggaaagaaacaagaacttccctgtagggagggaagggatcacagtgaaaaacatccaagctcagcacacacactcaagagggacacgccataaatcactctttccccacaacttccagacacccaggtttgttctgccactcagtacrcattgggggaattacgatctggaatgtattaaagctttaaaattattatgatctgaatgataatgatctccaaggaaataaaatatatgaaaacttcccagacagtatacagagtggatataatacatatctacaaccaggaggggaaagtctggagtggcaaccacttaatttttctccaaatattttgtgatttttagaagagaaaatatttaatttctaagcactttgggctgagatactggtcccttgtgcaccttactaatcgtttgagtttcctgaggaacgtcacaaataatt

SEQ ID NO: 125240 - DNA, 601 bp, Human
gatgcccttgcacacaatgtgctccaaattgtggcttagaagatgaagagaaaagatcatccttaggttgctgtgactcattcctgttgaatttgttcagggatatatttacacagatggtaactggaacatattctataatactgagaagctaaaaccaccctcagtgtccagtgacagggattggttaacgaaatcatggcacagctacacaatagagtagtataaaaatgtaaaagcaaacagaaaaccactgaagatatgtagtgaccttcataaactgatgtggaaattttaaaaraatgtattttttaaatgactaacatatatacctgcatataagttatggcattagtggtagggtaaaagaatgctatatgtctatgcacacataaatatttcaaagaaaagatcccataaggttaacagtgggagctttttgaaggaaggaaggtgggtaggatgtgttatgcctttaaaattagcttcatatttttccattccattagatattttttgttagcttaatcatgtacgtattgaaaagttaagtatctaaaaagtgacacgccatttagctgctgaaagatcagggaccatt

SEQ ID NO: 125241 - DNA, 601 bp, Human
ttcttggtcctcacattccacattcacaaacactgagaaagaacaccacaatcagaaattgcaagctgattattttattggtatattaaagttagagctatgatgaacttgttccaatgtcacggcatttgtagcaattgaattatttgaattcactgatatcttcttattcacttcctgaaataaacaaacaagcaagttcatagattcactcttttgatgcccttgcacacaatgtgctccaaattgtggcttagaagatgaagagaaaagatcatccttaggttgctgtgactcattsctgttgaatttgttcagggatatatttacacagatggtaactggaacatattctataatactgagaagctaaaaccaccctcagtgtccagtgacagggattggttaacgaaatcatggcacagctacacaatagagtagtataaaaatgtaaaagcaaacagaaaaccactgaagatatgtagtgaccttcataaactgatgtggaaattttaaaaaaatgtattttttaaatgactaacatatatacctgcatataagttatggcattagtggtagggtaaaagaatgctatatgtct

SEQ ID NO: 125242 - DNA, 601 bp, Human; identical to SEQ ID NO: 105817

SEQ ID NO: 125243 - DNA, 601 bp, Human; identical to SEQ ID NO: 32913

SEQ ID NO: 125244 - DNA, 601 bp, Human
cagatgttccgggcccgggtaggggctggcaggagagaaggggccggctgcggggagggctggctgagaagaagcgaaaatgggcggttagcagcagggacccggagccggaggagccgagagcagcgcgtgcgccgagctctactgcctcgcgggaaggcggaagggtggggagggcggcgctcggggcgggaggcccggccgggtccgctaggacagcggggccgctgggaagttgtgagagcggcgctcgggggcgcgcttgcgtgcacgagggcccgggccgcgagcagccgcggcygtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtc

SEQ ID NO: 125245 - DNA, 601 bp, Human; identical to SEQ ID NO: 73289

SEQ ID NO: 125246 - DNA, 601 bp, Human; identical to SEQ ID NO: 73288

SEQ ID NO: 125247 - DNA, 601 bp, Human; identical to SEQ ID NO: 29753

SEQ ID NO: 125248 - DNA, 601 bp, Human
agctcgccccgctccctcgccatccgccccgcccctcgccaacgggctcgcctcccggcgcggctgaggttcagtgcgcctgcgcgatagaggaaaggagcctggtagcgaggagagcggctgaggctcagtgcgcctgcgcggcgcggatgggcgaggcgtgaccgaggggcgaggcgtgaccgaggggcgaggcgtgaccgaggggcgaggcgtgaccgaggggcgaggcgtgaccgaggggcgaggcgtgaccgaggggctcgccgcggctcctgcgcctgcgcggcggggaacggcsaccggctgaggggactaggggagcgcggtgcttcggtggcggaggtcacggtggcctccatcctaaagggctgcgggcgtcccggacggcggtcccaagcgctgctcacgctgctcttaagtgagccctggacgaggcgcggtgggccctcatagtccgcgccggcgccctcgctccacaccgcggcgtccggccctgggctcccgccgatgtccgcgtgggacttttaggggatttgtttatttttgtacgttaaccacactagaaacggccccagaatgggctgaaacgtgtgctgct

SEQ ID NO: 125249 - DNA, 601 bp, Human
tgaagctgccacctaaactcccgagagaagcgccgtttctcctccatggcttctcgccgacgccctcgctgcggccttccgggcccctcggttgataaaaggactaaatagtgacggacatttttaaggctacttaagaaatggcaaaaatacatttagaggtgtgaacccgaacacactgcgcgctttaagccccgcgagagccggggccgcccgcttccgtgcgcccgtagctcctttctcgggtccgggattcgccggtgccggggacagaaacctcctgccttcttagttcatgacscttgtagatgaacttccctgttttctgcactgcttagaccagaagacgggaaaccgtgactgccgcacccttccctgaagcaggcactgcccgtcgtccatcaaacgcgaggactgcgcccacctcgtaggaaggacgccgcggtcctgctaaaagcctccgcctctgcctgcccgagggcacccttcccctccccgcttccgagggcggactccattcctctggagccggtgtttccgggtgggccagcctccaactgcctttgaataacccccccttacattagattctgaccctgtg

SEQ ID NO: 125250 - DNA, 601 bp, Human
agtgacggacatttttaaggctacttaagaaatggcaaaaatacatttagaggtgtgaacccgaacacactgcgcgctttaagccccgcgagagccggggccgcccgcttccgtgcgcccgtagctcctttctcgggtccgggattcgccggtgccggggacagaaacctcctgccttcttagttcatgacccttgtagatgaacttccctgttttctgcactgcttagaccagaagacgggaaaccgtgactgccgcacccttccctgaagcaggcactgcccgtcgtccatcaaacgckaggactgcgcccacctcgtaggaaggacgccgcggtcctgctaaaagcctccgcctctgcctgcccgagggcacccttcccctccccgcttccgagggcggactccattcctctggagccggtgtttccgggtgggccagcctccaactgcctttgaataacccccccttacattagattctgaccctgtggtgattttaggttgggatttgggcgcctgcagatggctccgaagccagcctcttgtgatccgagccacttctctggcactcggagcgctggcacccgcggagcggcctt

SEQ ID NO: 125251 - DNA, 601 bp, Human
gtgacggacatttttaaggctacttaagaaatggcaaaaatacatttagaggtgtgaacccgaacacactgcgcgctttaagccccgcgagagccggggccgcccgcttccgtgcgcccgtagctcctttctcgggtccgggattcgccggtgccggggacagaaacctcctgccttcttagttcatgacccttgtagatgaacttccctgttttctgcactgcttagaccagaagacgggaaaccgtgactgccgcacccttccctgaagcaggcactgcccgtcgtccatcaaacgcgrggactgcgcccacctcgtaggaaggacgccgcggtcctgctaaaagcctccgcctctgcctgcccgagggcacccttcccctccccgcttccgagggcggactccattcctctggagccggtgtttccgggtgggccagcctccaactgcctttgaataacccccccttacattagattctgaccctgtggtgattttaggttgggatttgggcgcctgcagatggctccgaagccagcctcttgtgatccgagccacttctctggcactcggagcgctggcacccgcggagcggccttg

SEQ ID NO: 125252 - DNA, 601 bp, Human
tgacggacatttttaaggctacttaagaaatggcaaaaatacatttagaggtgtgaacccgaacacactgcgcgctttaagccccgcgagagccggggccgcccgcttccgtgcgcccgtagctcctttctcgggtccgggattcgccggtgccggggacagaaacctcctgccttcttagttcatgacccttgtagatgaacttccctgttttctgcactgcttagaccagaagacgggaaaccgtgactgccgcacccttccctgaagcaggcactgcccgtcgtccatcaaacgcgakgactgcgcccacctcgtaggaaggacgccgcggtcctgctaaaagcctccgcctctgcctgcccgagggcacccttcccctccccgcttccgagggcggactccattcctctggagccggtgtttccgggtgggccagcctccaactgcctttgaataacccccccttacattagattctgaccctgtggtgattttaggttgggatttgggcgcctgcagatggctccgaagccagcctcttgtgatccgagccacttctctggcactcggagcgctggcacccgcggagcggccttgg

SEQ ID NO: 125253 - DNA, 601 bp, Human
ggacatttttaaggctacttaagaaatggcaaaaatacatttagaggtgtgaacccgaacacactgcgcgctttaagccccgcgagagccggggccgcccgcttccgtgcgcccgtagctcctttctcgggtccgggattcgccggtgccggggacagaaacctcctgccttcttagttcatgacccttgtagatgaacttccctgttttctgcactgcttagaccagaagacgggaaaccgtgactgccgcacccttccctgaagcaggcactgcccgtcgtccatcaaacgcgaggacwgcgcccacctcgtaggaaggacgccgcggtcctgctaaaagcctccgcctctgcctgcccgagggcacccttcccctccccgcttccgagggcggactccattcctctggagccggtgtttccgggtgggccagcctccaactgcctttgaataacccccccttacattagattctgaccctgtggtgattttaggttgggatttgggcgcctgcagatggctccgaagccagcctcttgtgatccgagccacttctctggcactcggagcgctggcacccgcggagcggccttggttca

SEQ ID NO: 125254 - DNA, 601 bp, Human; identical to SEQ ID NO: 59673

SEQ ID NO: 125255 - DNA, 601 bp, Human; identical to SEQ ID NO: 59672

SEQ ID NO: 125256 - DNA, 601 bp, Human; identical to SEQ ID NO: 59671

SEQ ID NO: 125257 - DNA, 601 bp, Human; identical to SEQ ID NO: 59670

SEQ ID NO: 125258 - DNA, 601 bp, Human
cagattttcttgtccttttagcctctggaaaagagtctttctctcagcttgacagaaagtgcgattctagctctcacttcaaggagaggaaacttccttctctctagggaacgagacccaacctcttggcgggcggattggtccattttccaggcatggccaggcttttggcacatttatgtaacaggctggcatcccgcccatcttgagcatgggtgggcaagctgggtgctgctaagagaagagaaaggagccgttgggagtgggggtggggaaggaaggcaaaacgcagtcctgggayccttatcactcgcctcctcctgacagtcctgggggagaggttcagccccaggagaaggatgctggcgattgggtaaaagctgtatccgtaagctacatgaaggtttctcaatctcggcgctattgacattttggactagctagttcgttattgtaggagatcgtcctgtgcatcgtaggatgtttagcagcatccctggcctccccccactacatatccgtagcactccttgtaaattcctgttttagtaagaacctcccatccttgacatctgatcaccctcaatatctcatcctccac

SEQ ID NO: 125259 - DNA, 601 bp, Human
ctctctctctcttttttgtagtgtaggggtctcattatgttgcccaggctggtctcaaactcctggactcaagcaatcctcctgcctcagcctcccaaagtgctaggattacaagtatgagccactgtgcccagcaagtttctatctgcaatctggaagctagaagagagtagactagcgtctattgactagaagaaaagcactgtaactcaatataccccattaagatataattcacttgttagggcaaaaaacatgtctgaggatgtataaggattcagagacacatcatccggatacrcatctgtccaaaatcgaggaaaggtttgaaccaaataaatatcctagaacagagacagatggaaaggaaatagttgtaaataacaaactttgcaaaaatcgacactaaaactgattggattaagaaaatggaatggattaagatagatgaggaatgtgtaatgtaagtgctaaataagaacttttaagatgcaaggagtaactttaaaaaaaatctaataataccaaccactaagtatactaaagtatcccagtaaaactagtagttgaaagtgcctaagattttatcttagtgagccct

SEQ ID NO: 125260 - DNA, 601 bp, Human
ctggagattacacgctataagaattcttttttgttgttgttgttgaaactgagtctcactctgttgcccaggctggagtgcagtggcctgacctcagttcactgcaacctccacctcctaggttcaagcgattctcctgcctcagcctcccgagtagctgggactacaggtgtgagccaccacaccagggtaattttttttttttttttttttttgagacagagtctcactctgtcacccaggcgatctcggctccctgcaatcctctcaagtagctgggactatagatgcacgctgccaygcccagctaattttttgtattttagtagagacagggtttcaccagcccagggttttgcaacagtccaggctggtcgcaaactcctgagcttaggcaatccacctgcctcggccttccaaagtgctgggattacaggcgtgagccactgggtccggcccatttttgtggttttagtagaaatgggatttctccatgttggccaggctggtcttgaactccttacctcaggttatccatttgcctaggcctccaaaagtgctgggattagaggtgtgagccactgcgcctggccctaaaaac

SEQ ID NO: 125261 - DNA, 601 bp, Human
tagaaatgggatttctccatgttggccaggctggtcttgaactccttacctcaggttatccatttgcctaggcctccaaaagtgctgggattagaggtgtgagccactgcgcctggccctaaaaactcttgaacaaagaaatgtggtgagcttcccagctggtgaacacatccaccatgggaagatggtgtggtgtaccccaactccatggggacagagactcctgcacttgggatccttctggacctcattctacatacctcttcacctggctgttcatccctttattatatatatatatctttttttgaggcagagtctggctctgtcgcctaggctggaatgcagtggggtgatctcggctcactgcaatctctgtctcctgggtttacgtgattctcctgcctcagcctcccaagtagctgggattacaggcatgcaccaccaagcccggctaatttttgcatatttagtagagacagggtttcgccatgttggccaggctggtcttgaacttttgggctcaagagatccacctgcttcggcctcccaaagtgttgcgattacaggcgtgagccaccgcgcccggcctataatattc

SEQ ID NO: 125262 - DNA, 601 bp, Human
cttcccagctggtgaacacatccaccatgggaagatggtgtggtgtaccccaactccatggggacagagactcctgcacttgggatccttctggacctcattctacatacctcttcacctggctgttcatccctttattatatatatatatctttttttgaggcagagtctggctctgtcgcctaggctggaatgcagtggggtgatctcggctcactgcaatctctgtctcctgggtttacgtgattctcctgcctcagcctcccaagtagctgggattacaggcatgcaccaccaagcmcggctaatttttgcatatttagtagagacagggtttcgccatgttggccaggctggtcttgaacttttgggctcaagagatccacctgcttcggcctcccaaagtgttgcgattacaggcgtgagccaccgcgcccggcctataatattctttatcataaactagtaaacgtaagtgtttccctgagttttatgaaggattctagcaaattatcaaatccaaggagggagtcatgagaatccctgatttatacagccagttggtcagaagtgtaggaggcttggatttgcagttggcatc

SEQ ID NO: 125263 - DNA, 601 bp, Human
tagtagagacagggtttcgccatgttggccaggctggtcttgaacttttgggctcaagagatccacctgcttcggcctcccaaagtgttgcgattacaggcgtgagccaccgcgcccggcctataatattctttatcataaactagtaaacgtaagtgtttccctgagttttatgaaggattctagcaaattatcaaatccaaggagggagtcatgagaatccctgatttatacagccagttggtcagaagtgtaggaggcttggatttgcagttggcatctttaatgggggcaaccttgygggactgagcccttaatctgtgggatctgacactaactccaggtagagagtgtcagaattgaattgtggaacacccagcctatgtcagagaattgattgatgtgggaataaaacctgcatatctagtgtcagaaacgaagtgttctgtgtgagtgtagaaacagtgtggtttcccagatatggggaaatagattatatttagtagaaatgtatccaattatgaaagttgagaaatgggctgggtgctgtggctcatacctataatcccagcactttgggaggctgagaggggtggatcac

SEQ ID NO: 125264 - DNA, 601 bp, Human
gcaccactgcactccagccttggtgacagagagagcctcccatctcaaaaaaaaaaaaaaaaaaaaaaaggaaatggagttcagcaacttatattccctatgattatacaaaatcaatattgggaagtctatcaatacaaccccaaaacatcaacaaattaaaggagaaaacaccatatgagccaatcaatagaggccaaaaaggcattgattaaacgtagaagccattcattataaaacctccaagcaaaataaggataaaaggaaagtatttatagtagactttttttaaaagacaagktctcattctgttgcccatgctggagtgcagtgttgtgatcacagctcactgcagccttgatatggctcaattgaacctcccacctcagcctcctcagtagctaggactacaggcttgagccaccacacccagatagtttttgtttgtttgtttatcgtttgttttgtagatacgaggttatgccatgttgcccaagctgacattattatttaacattaattcggaagttttagtcaatacaataagataaaaaacgaggtaattgataataaatactggaaaagtgataaaacagcctcc

SEQ ID NO: 125265 - DNA, 601 bp, Human
aaatggagttcagcaacttatattccctatgattatacaaaatcaatattgggaagtctatcaatacaaccccaaaacatcaacaaattaaaggagaaaacaccatatgagccaatcaatagaggccaaaaaggcattgattaaacgtagaagccattcattataaaacctccaagcaaaataaggataaaaggaaagtatttatagtagactttttttaaaagacaaggtctcattctgttgcccatgctggagtgcagtgttgtgatcacagctcactgcagccttgatatggctcaawtgaacctcccacctcagcctcctcagtagctaggactacaggcttgagccaccacacccagatagtttttgtttgtttgtttatcgtttgttttgtagatacgaggttatgccatgttgcccaagctgacattattatttaacattaattcggaagttttagtcaatacaataagataaaaaacgaggtaattgataataaatactggaaaagtgataaaacagcctccttttgttgttgatatgattgtagacttagaaaacgcaagagatgcgctgggtgccatggctcacgcctgta

SEQ ID NO: 125266 - DNA, 601 bp, Human
tatgattatacaaaatcaatattgggaagtctatcaatacaaccccaaaacatcaacaaattaaaggagaaaacaccatatgagccaatcaatagaggccaaaaaggcattgattaaacgtagaagccattcattataaaacctccaagcaaaataaggataaaaggaaagtatttatagtagactttttttaaaagacaaggtctcattctgttgcccatgctggagtgcagtgttgtgatcacagctcactgcagccttgatatggctcaattgaacctcccacctcagcctcctcagyagctaggactacaggcttgagccaccacacccagatagtttttgtttgtttgtttatcgtttgttttgtagatacgaggttatgccatgttgcccaagctgacattattatttaacattaattcggaagttttagtcaatacaataagataaaaaacgaggtaattgataataaatactggaaaagtgataaaacagcctccttttgttgttgatatgattgtagacttagaaaacgcaagagatgcgctgggtgccatggctcacgcctgtaatcccagcactttgggaggcggatgac

SEQ ID NO: 125267 - DNA, 601 bp, Human
caacaaattaaaggagaaaacaccatatgagccaatcaatagaggccaaaaaggcattgattaaacgtagaagccattcattataaaacctccaagcaaaataaggataaaaggaaagtatttatagtagactttttttaaaagacaaggtctcattctgttgcccatgctggagtgcagtgttgtgatcacagctcactgcagccttgatatggctcaattgaacctcccacctcagcctcctcagtagctaggactacaggcttgagccaccacacccagatagtttttgtttgtttgyttatcgtttgttttgtagatacgaggttatgccatgttgcccaagctgacattattatttaacattaattcggaagttttagtcaatacaataagataaaaaacgaggtaattgataataaatactggaaaagtgataaaacagcctccttttgttgttgatatgattgtagacttagaaaacgcaagagatgcgctgggtgccatggctcacgcctgtaatcccagcactttgggaggcggatgacgaggtcaggagatcgagaccatcctggctaacacggtgaaaccccgcctctac

SEQ ID NO: 125268 - DNA, 601 bp, Human
aattaaaggagaaaacaccatatgagccaatcaatagaggccaaaaaggcattgattaaacgtagaagccattcattataaaacctccaagcaaaataaggataaaaggaaagtatttatagtagactttttttaaaagacaaggtctcattctgttgcccatgctggagtgcagtgttgtgatcacagctcactgcagccttgatatggctcaattgaacctcccacctcagcctcctcagtagctaggactacaggcttgagccaccacacccagatagtttttgtttgtttgtttatygtttgttttgtagatacgaggttatgccatgttgcccaagctgacattattatttaacattaattcggaagttttagtcaatacaataagataaaaaacgaggtaattgataataaatactggaaaagtgataaaacagcctccttttgttgttgatatgattgtagacttagaaaacgcaagagatgcgctgggtgccatggctcacgcctgtaatcccagcactttgggaggcggatgacgaggtcaggagatcgagaccatcctggctaacacggtgaaaccccgcctctactaaaa

SEQ ID NO: 125269 - DNA, 601 bp, Human
acttgaactcaggagttcaagaccagcctgggcaacatagcaaaaccccatccctacaaaaaattagccaggcatggtggcatgtgcctgtagttctagctacttgggaggctgggagatggaaagatcacatgggcctggcaggcagaggttgcattgatcataccactgcactccagcctgggtgacagagtaagactctgtctcaaaaaaaaaaaaaaaaaaaaaaaaaggaatagtagtaggaaagacttatattaccagatgtcagaaaataaatcagccaagcatagtggctcakgcctgtaatctcaccactttgggaggccaaggtgtgtggattatttgaggtcagaagttctagaccagcctggccaacatggtgaaaccccatctctactaaaaatacaaaaattagctgggtagtggtggcatgtgcctgtaatcccagctattcgggaggcggggcaggagactcgcttgagcctgggaggcagaggttgcagtgagccgagatcgcgccctgcactccagcctgggtgacagagtgagaccctgtctccataaaaaaaagaaagaaagaaaataaatcatagcgata

SEQ ID NO: 125270 - DNA, 601 bp, Human
ttctccttactccaggtggtagtctgcacacatttttattctgaaataggcaaaaagcatgtcccaaaactatgtgtcccctctcactttttatttttatttttattttattttactttaagttctgggatacatgtgttgaaggtgcaggtttgttacgtaggcatacatgtgccatggtggtttactacacctatcagcctgtcatctaggctttaagcccctcatgcatcaggtgtttgtcctaatgctctccctccccttgcccctagccccccaacaggccccggtgtgtgatgtycccctccgtgtgtccacgtgttctcattgttcatctcccacttatgagtgagaacatgcgctatttggttttctcttcctgtgttagtttgctgaggatgatggtttccagcttcatccatgtccctgcaaaggacatgaactcactcttttttatggctgcatagtattccatggtgtatatgtatcatattttctttatccactctatcattgatgggcatttgggttggttcggtgtctttgctattgtaaacagtgctgcaataaacatatgtgtgcatttttttttttttgagac

SEQ ID NO: 125271 - DNA, 601 bp, Human
ctgtttttcgtagagacagtctcactatgttgcctcagctggtcttgaactcttggcctcaagggatcctccttccttggcctctctaagtgctgagtttacaggcatgagccactttgcccagcctacatcaggcttttaaatatatcaattgggccgggtgcggtgactcacacctgtaatcctggcattttaggaggccgaggtgcgcagatcacttgagttcaggagttggagaccagcctggccaacatggtgaaaccccatctctactaaaaataccaaaaaaattagcctggcrtggtggcacacactcatagtcctagctactcccaagggtgaggcaggagaatcacttgaacctgggatgcagaggttgcagtcagccaagattgcgccactgcactccagccttatattagagcaatttgatatttattaatataatcatccactaagaaagacccaaactcttctttaacagttaaaagtttaacaaccggaacagctccagtctgcagctcccagcgtgatcgacgcagaagacaggtgatttctgcatttccgactgaggtaactgattcatctcactgggactggt

SEQ ID NO: 125272 - DNA, 601 bp, Human
actatgttgcctcagctggtcttgaactcttggcctcaagggatcctccttccttggcctctctaagtgctgagtttacaggcatgagccactttgcccagcctacatcaggcttttaaatatatcaattgggccgggtgcggtgactcacacctgtaatcctggcattttaggaggccgaggtgcgcagatcacttgagttcaggagttggagaccagcctggccaacatggtgaaaccccatctctactaaaaataccaaaaaaattagcctggcgtggtggcacacactcatagtccyagctactcccaagggtgaggcaggagaatcacttgaacctgggatgcagaggttgcagtcagccaagattgcgccactgcactccagccttatattagagcaatttgatatttattaatataatcatccactaagaaagacccaaactcttctttaacagttaaaagtttaacaaccggaacagctccagtctgcagctcccagcgtgatcgacgcagaagacaggtgatttctgcatttccgactgaggtaactgattcatctcactgggactggtttgacagtgggtgcagcccacgg

SEQ ID NO: 125273 - DNA, 601 bp, Human
ttgagttcaggagttggagaccagcctggccaacatggtgaaaccccatctctactaaaaataccaaaaaaattagcctggcgtggtggcacacactcatagtcctagctactcccaagggtgaggcaggagaatcacttgaacctgggatgcagaggttgcagtcagccaagattgcgccactgcactccagccttatattagagcaatttgatatttattaatataatcatccactaagaaagacccaaactcttctttaacagttaaaagtttaacaaccggaacagctccagtctgyagctcccagcgtgatcgacgcagaagacaggtgatttctgcatttccgactgaggtaactgattcatctcactgggactggtttgacagtgggtgcagcccacggatggggagctgaagcagggcagggcgtcacctcaccctggaagtgcaaggggtcaggggatttccctttcctagccaagggaagccgtgacagactacctggaaaaatgggacactcctgcccaaatactgcacttttcccaagatcttagccaccggcagacaaggagattctctcccatgcctggctcggcgg

SEQ ID NO: 125274 - DNA, 601 bp, Human
agccttatattagagcaatttgatatttattaatataatcatccactaagaaagacccaaactcttctttaacagttaaaagtttaacaaccggaacagctccagtctgcagctcccagcgtgatcgacgcagaagacaggtgatttctgcatttccgactgaggtaactgattcatctcactgggactggtttgacagtgggtgcagcccacggatggggagctgaagcagggcagggcgtcacctcaccctggaagtgcaaggggtcaggggatttccctttcctagccaagggaagcmgtgacagactacctggaaaaatgggacactcctgcccaaatactgcacttttcccaagatcttagccaccggcagacaaggagattctctcccatgcctggctcggcgggttccacacccacggagccttgctcactgctagtgcagcagtctgagatcgaactgtgaggcggcagcctggctgggggaggggcgtccgctgttgctgaggcttgagtaggtaaacaaagcagccgggaagttcgaactgggcagagcccactgcagctcagtaaggcctactgcctctagactccatct

SEQ ID NO: 125275 - DNA, 601 bp, Human
tgcagctcccagcgtgatcgacgcagaagacaggtgatttctgcatttccgactgaggtaactgattcatctcactgggactggtttgacagtgggtgcagcccacggatggggagctgaagcagggcagggcgtcacctcaccctggaagtgcaaggggtcaggggatttccctttcctagccaagggaagccgtgacagactacctggaaaaatgggacactcctgcccaaatactgcacttttcccaagatcttagccaccggcagacaaggagattctctcccatgcctggctcggygggttccacacccacggagccttgctcactgctagtgcagcagtctgagatcgaactgtgaggcggcagcctggctgggggaggggcgtccgctgttgctgaggcttgagtaggtaaacaaagcagccgggaagttcgaactgggcagagcccactgcagctcagtaaggcctactgcctctagactccatctctgtggccagggcatagctgaacaaaaggcagcagacaacttttgcagacttaaaggtccctgtctgacagctctgaagagagcattggttctctcagcacggtgtt

SEQ ID NO: 125276 - DNA, 601 bp, Human
caccttgtttcaattgatatgctcaggaaagattcgggaagtaaaaatgttaattttaatacatttttgctaaattttttggatcaaatccttttaccctatctcatgttttaaatgtattttcaggctgggagtggtggctcacgcctgtaattccagcactttggaagcccaaggcaggcggatcagctgaggtcaggaatttaagaccagtctggctaacatggcaaaaccctgtctctattagaagtacaaaaattagctgggtatggtggcaggtgcctgtagtcccagctactcrggaggctgaggcaggagaatcgcttgaaccctggaggtggaggttgcagtgagctgagatcatgccattgcactccagcctgggcaacagagtgagactctgtctcaaaaaagaaaccaaaaaacaaaataaatgtattttcattaacatatcggagctgcagacttaactcatttatggaaaacatctgtgacattcttattggcaaaagcagtcctcactgttaaactaatcagccaaatcaaattactttgtatcagaaaaagtttctcattttttaattcaataatcatgttaata

SEQ ID NO: 125277 - DNA, 601 bp, Human
ggctgaggcaggagaatcgcttgaaccctggaggtggaggttgcagtgagctgagatcatgccattgcactccagcctgggcaacagagtgagactctgtctcaaaaaagaaaccaaaaaacaaaataaatgtattttcattaacatatcggagctgcagacttaactcatttatggaaaacatctgtgacattcttattggcaaaagcagtcctcactgttaaactaatcagccaaatcaaattactttgtatcagaaaaagtttctcattttttaattcaataatcatgttaatatgtrccttgtaacaatcattttgcttctgaaccttaagaaatatagatggacaaggcatgcagccctcctttcctggatgaattatgatacaaaagtgttcactgtttctcactgatactttttttgctttactctcatgggactctccttcacatatgatgcatttttgaacaatggaggatgaaagaaatcatgcaatttaaaatatttagaattttctcttcctttggcaccttacagttcttttgctccaagccaggctcaaaggctcaaagggctgtgtgagcgtgagcccttttgtat

SEQ ID NO: 125278 - DNA, 601 bp, Human
gaacctgggaaaaaggaaccccttaaatccattcatgcctgtgtgccccttctaatggctttgtgaaccatcaggacataaagttctctcatttggagacctctgttacaaaagattgcctgctccctgggcacctccacaggtgctgtatagctaccaccaaagggtcacttgtgtgggtctctctgcgtagctggacccagttggaagtttgtaatgagaattataggaggcaactggaatgctctacagaggaggctccagacagttattgccttgaggaagtttatgaaaaaggctyccactaggcacccagcaatgcagcgggtgtgtttaggaaaggctggccggccaggaggtgagctgccaagaggcttcaccaggcctgcagaacttcagagaatcgctatagtccaggtcagactccctgcctgtcggtatgtggagcgcgggtctacagctcacagaactgagttcttaaatccaggtatcagtgtgctaatttgtaagaagaaattattggcatgggggctgaaccccaaaatctacaggcaaatctatgtggaatgtcaaatggtaagccaggactcaggacaagatg

SEQ ID NO: 125279 - DNA, 601 bp, Human
ctgtcggtatgtggagcgcgggtctacagctcacagaactgagttcttaaatccaggtatcagtgtgctaatttgtaagaagaaattattggcatgggggctgaaccccaaaatctacaggcaaatctatgtggaatgtcaaatggtaagccaggactcaggacaagatgggacgattgagatgaattgggggtggggccgagatagtggactagaggcagctcatgtgtgctgctgttttggagaagaaacaaaaggactagcaaacactgagctgcaggccgatcatctgaaaaaccaygttgggacccatcagggcagtagaggaacacagagtgcagaaaggagtgaagccaggcaccagctgtttgggctcagcatggagccaggagaacctctccagcacaggacagggtgagtgagtgagagcccccagggtgattcatgctctccacagggacctgtgcaagactgggaataggagaatcccactgggccccacacccacccatcgtgtttctagactgaggcagagagccactcagacgttttacagggccaactctcgagtccaaggggacctctataagccttgggccct

SEQ ID NO: 125280 - DNA, 601 bp, Human
gttttacagggccaactctcgagtccaaggggacctctataagccttgggccctggggcagaccagccagcgccgaagccccagcaaaggctgcagttgccatgcatgggagcagtaaggttgctccacccacccatgctgggtaggactcaacaccagcctctagcccagtagtctcacttcagcctgaactcggccagccactccacccacccccaccactggtagccaggcgggcaacacctgctagagcttccagcctaatagccctgcttctgtgtgaactcagctagagggtgcrgctttctgttgtcctgggaaacacccgaacagcagagtaagtgactctacctaccctgccactggtagccagttgggtaacaactgctagagctcctggcccagcagctctgcttctgtgtggattcaactggtgggtgcagcctcctgttgtcataggaagcacccaaatggcaaggcacatgaccatacccacccttgccactgacagccaggtggataacacctgctagagcttctggcccagcagtcctgcttctgtgtgaactcagccaacaaatgcagccttctgttgtcccag

SEQ ID NO: 125281 - DNA, 601 bp, Human
catgaccatacccacccttgccactgacagccaggtggataacacctgctagagcttctggcccagcagtcctgcttctgtgtgaactcagccaacaaatgcagccttctgttgtcccaggaagcacagacaccagagaaggcattcccaccaaccccagccactggtagccaggcaagccacacctgccagagctggcccagtggctctacttctacctgaatttgtcaagggacgcagcctcctgttgcactggaaacacccagacagcagggcagccaactgcatccacccacccccrcgtcctgtagccagatgggccacacccagtagtttccaatccagtggtcctgattctgcctgaactctgcaggcagggacaacctcgtgtttccccaggaagcacacagacagcagattggagctgacctggcaaggttacagcttgtctgccacctgtggcccttgcctaagggagctccatggaccagaacaccccaaaaaagaaatgcaaatagggagacagtaattggaaggggctcctccaagacctaggagtggactagaattgaaagcagttaaccaaacccaccttggtttg

SEQ ID NO: 125282 - DNA, 601 bp, Human
gagattgcgccactgcactccagcctgggcgacagagtgagacttccatctcaaaaaacttgtcaaaatatgacaagattctcttaaattccacagcaggtataacttcctctctaggaacgtttctcactctgcgggcaagtgctccagtagaaactcctagtactcccaccaaagtcacgctcctttcttcttgggcatgggagtagaatgcacttgctgcctctcctggaaaatagcttatgctttaagtagttaatgtggattgtcattataaaatatttaaatttatgttaatgtmttttttttttttttttggagcgcaatggcacaatcttggctcactgcaacctctgcctcccaggttcaagtgattctcctgcgtcagcctcctgagtagctaggattacaggcacgcgtcaccacatccagctagtttttgtatttttagtagagacggagtttcaccatgttggtcaggctggtctcgaactcctgaccttaggcgattcacccacctcggcctcccaaagtgctgggattacaggtgtgagccaccacgcctggcaattacaagatttttttaaagccatatcacaaa

SEQ ID NO: 125283 - DNA, 601 bp, Human
agattgcgccactgcactccagcctgggcgacagagtgagacttccatctcaaaaaacttgtcaaaatatgacaagattctcttaaattccacagcaggtataacttcctctctaggaacgtttctcactctgcgggcaagtgctccagtagaaactcctagtactcccaccaaagtcacgctcctttcttcttgggcatgggagtagaatgcacttgctgcctctcctggaaaatagcttatgctttaagtagttaatgtggattgtcattataaaatatttaaatttatgttaatgtattttttttttttttttggagcgcaatggcacaatcttggctcactgcaacctctgcctcccaggttcaagtgattctcctgcgtcagcctcctgagtagctaggattacaggcacgcgtcaccacatccagctagtttttgtatttttagtagagacggagtttcaccatgttggtcaggctggtctcgaactcctgaccttaggcgattcacccacctcggcctcccaaagtgctgggattacaggtgtgagccaccacgcctggcaattacaagatttttttaaagccatatcacaaag

SEQ ID NO: 125284 - DNA, 601 bp, Human
cagctagtttttgtatttttagtagagacggagtttcaccatgttggtcaggctggtctcgaactcctgaccttaggcgattcacccacctcggcctcccaaagtgctgggattacaggtgtgagccaccacgcctggcaattacaagatttttttaaagccatatcacaaagcccccacaatttttctggtaaataagaggcccaactcttggttctgagatggaccatggttaaacaagtcattgaactggcttttctggttcaccttacggatgaacgctctgtcgtcgtttgctgaygctgaggtttccagttgatgctgcatggcacgatgcagggatgtgagaagaagttgggggtgcaaaagcagacccattttgtcacggattgcccaggatctcatactgaagctgtagcaaagcttttgcccttaatgagtttacaggtgaaatggaaagacacttgagtgtcccttcctccaggaggccttttccagtcctttctactccatcataacacctgccgtgctgcattgcaattcactgtttatatctctttctttcttctagttgctgttaatcttttttggattaaaaact

SEQ ID NO: 125285 - DNA, 601 bp, Human
tcgtcgtttgctgatgctgaggtttccagttgatgctgcatggcacgatgcagggatgtgagaagaagttgggggtgcaaaagcagacccattttgtcacggattgcccaggatctcatactgaagctgtagcaaagcttttgcccttaatgagtttacaggtgaaatggaaagacacttgagtgtcccttcctccaggaggccttttccagtcctttctactccatcataacacctgccgtgctgcattgcaattcactgtttatatctctttctttcttctagttgctgttaatctttyttggattaaaaactcttttttgtttttaatttaagttccaggatacatgtgtagaacgtgcaggttggttacataggtataagtgcgccatggtggtctgctgcacctactcacctgtcttctaagttccctcccctcacaccccaccccccaccctgcagcaggccctggcgtgtgatgttcccctccctatgtctatgtgctgtcattgttcaactcccacttatgagtgagaacatgcggcatttggttttctgttcctgtgttagtttgctgaggataatggcttccagcttcatc

SEQ ID NO: 125286 - DNA, 601 bp, Human
acccattttgtcacggattgcccaggatctcatactgaagctgtagcaaagcttttgcccttaatgagtttacaggtgaaatggaaagacacttgagtgtcccttcctccaggaggccttttccagtcctttctactccatcataacacctgccgtgctgcattgcaattcactgtttatatctctttctttcttctagttgctgttaatcttttttggattaaaaactcttttttgtttttaatttaagttccaggatacatgtgtagaacgtgcaggttggttacataggtataagtgygccatggtggtctgctgcacctactcacctgtcttctaagttccctcccctcacaccccaccccccaccctgcagcaggccctggcgtgtgatgttcccctccctatgtctatgtgctgtcattgttcaactcccacttatgagtgagaacatgcggcatttggttttctgttcctgtgttagtttgctgaggataatggcttccagcttcatccatgtccctgccaaggacatgatctcattccttttcatggctgcatagtattccatggtgtatatgtatcacattttctttatcta

SEQ ID NO: 125287 - DNA, 601 bp, Human
cctgcagcaggccctggcgtgtgatgttcccctccctatgtctatgtgctgtcattgttcaactcccacttatgagtgagaacatgcggcatttggttttctgttcctgtgttagtttgctgaggataatggcttccagcttcatccatgtccctgccaaggacatgatctcattccttttcatggctgcatagtattccatggtgtatatgtatcacattttctttatctagtctcattgatgggcatttcagttggttccattttgctattgtaaatagtgctgcaataaacatacggktgcatgtgactttatagtagaatgatttctattcctttgggtatatacccagtaataggattgctgggtcaaatggtatttctgattttagatgcttgaggaatcgccatactgtcttccacaatggtaaaaactcttttcttaatttgatagaacctttggtttccctccttggaaaaaatgcacatcagcacatactctggataaatccgtaggaagtttcaggagcattatgggcagtttgttttgttttgctctgttttgtttgagatggggtttctggagtgcagtgttgccatc

SEQ ID NO: 125288 - DNA, 601 bp, Human
ttggtacttcctagaagaaactgctcagaacagcggacaacaaatttctgacctagactgccttcccttaggtttaagaccactttctttctagacgtacagtggggtgaatactaatgattatggtaagaagagcaattgaaatgtaggagggaaaagttgttgagctgatgtgatcaggaaaggcccacgtattgtccttgaaggatggatacggccttggtaggtggttcctgaggaagcagagtgtggtccatagttaaccagaagtagagaggggtagaagctaagggcagaaatrtcagctggattcagagtcaggtggacctcgaaaaacagaataagatctatggacttcagccactgaagctgtctaacccaggcgggacatagccaagtgatgtgatgatgaggccgagctggtgtggtgtgcagggaagattgaggcatagagatgctgaaatactcttcaggaaggaaatcataaggactggaggaaggtgaaataaattggaatggcaaggaggcttgatgccagaatatcaggcaaagggaaaatgcagttggtaatgcctggatgtggggcaagaagcggggaaca

SEQ ID NO: 125289 - DNA, 601 bp, Human
cagtggggtgaatactaatgattatggtaagaagagcaattgaaatgtaggagggaaaagttgttgagctgatgtgatcaggaaaggcccacgtattgtccttgaaggatggatacggccttggtaggtggttcctgaggaagcagagtgtggtccatagttaaccagaagtagagaggggtagaagctaagggcagaaatatcagctggattcagagtcaggtggacctcgaaaaacagaataagatctatggacttcagccactgaagctgtctaacccaggcgggacatagccaagtratgtgatgatgaggccgagctggtgtggtgtgcagggaagattgaggcatagagatgctgaaatactcttcaggaaggaaatcataaggactggaggaaggtgaaataaattggaatggcaaggaggcttgatgccagaatatcaggcaaagggaaaatgcagttggtaatgcctggatgtggggcaagaagcggggaacagaatttgtgagctttggcgaggagaaaattcactgatttgagctcatcaaatggattggcgaaattcaagtgtgtgaggctgaggttaggggatggcag

SEQ ID NO: 125290 - DNA, 601 bp, Human
tccccaacagcccacaaaaatcttgagtaaaattcccattttgtcttcatgcattttggagttgaacgagctttgaggacatttgaaacatggagcatgacttcctctgtgagccaggactagtgggaagcctgtttagtccacgaataatggggtttctcccattttcctcctgttgctgtcctcttgactggttcattgtttaccagcatatctgccaggggagcacaaggaaaggaaaaggtgaagctgagcgtggtggcgcatgcctatagtcccagctactcaggaggccaagackttgaggttcgcttgaccccaggaggtcaaggctgcaatgagctatgattgcaccactgcactccagccagggccacagagcaagacctcgcctctaaaaaaaaaaaaaaaaaaaaagaaaaaggagggagtgggggaaaggaaaagctgaaacccagatcaaagaatttcacctctgtcacataatccatcaataaacgttgactgcaattaatcaaagaattatgctagaacctgtgaggagagccaagaagctaaaacatagccctgcactgaggacgctcacagtctcctcaaagag

SEQ ID NO: 125291 - DNA, 601 bp, Human
atgacttcctctgtgagccaggactagtgggaagcctgtttagtccacgaataatggggtttctcccattttcctcctgttgctgtcctcttgactggttcattgtttaccagcatatctgccaggggagcacaaggaaaggaaaaggtgaagctgagcgtggtggcgcatgcctatagtcccagctactcaggaggccaagacgttgaggttcgcttgaccccaggaggtcaaggctgcaatgagctatgattgcaccactgcactccagccagggccacagagcaagacctcgcctctaaaaaaaaaaaaaaaaaaaaagaaaaaggagggagtgggggaaaggaaaagctgaaacccagatcaaagaatttcacctctgtcacataatccatcaataaacgttgactgcaattaatcaaagaattatgctagaacctgtgaggagagccaagaagctaaaacatagccctgcactgaggacgctcacagtctcctcaaagaggaaaagaaatgggccctcaaaaggggaagtgaccgctcacgtctgcagggatccgttcagcaatcaggcctgccctgcactatacgctggcaccac

SEQ ID NO: 125292 - DNA, 601 bp, Human
tcagaccgtgactcccgaaaagccttgcgggcggggcgcgcccgcgccgtctcttgccggaaggtgcgagttagtgcgctcgattgtgggcgggggcggaaagaggcgcgttttaaagtggtaacagatggttttcttatccaataggattaaaaaatttgtccttacccggccgaccgcggaagtagagtaggcgggcggccaatggggacatgatggggggcggagccgaggcctccgaagcggaagtgggttgctgttgaggcggcggcatctttctcgaggagctctcctgggcggstgaagaaggagcttcttctccggagtgcgccggcggtggcgcctgcggacctaactagctccaggttaggccgagctttgcgggaaagcagcggtaagtcagggccttgcagatgcgaggtttaggcagcttcgcggcctacagaggcctcggcccgcgcctcttgggggagccgcgctgcgcggcttgacccagccgaggctttgcagcccgggacctcgagccagctctggtcgctcgcactaccgtccgcgcgggcgcaccgagcccggcttggcgcgggcaacagaagttaggagg

SEQ ID NO: 125293 - DNA, 601 bp, Human
cgagactccgtctcaaaacaaacaaacaaacaaacaaaaaacacaaatacttagatattttacatgagaattacatttatctatcagatactctaccatgccagatttccttacaattacgaaaaatagcaaacacatattgtttgtaaatgcaacacaaaaacgttaatgctctggtttctatctgccttgtcattccgttatttgactccattttcgaggttagaaactcactgtaaggtggccgggcgaggtggctcacaccagtaatcccagcacttttggaggccaaggagggtgsatcacctgaggtcaggagctcgagaccagcctggccaacatgatggaactccatctctactaaaaatacaaagaaaattagccgggcgtggtggcaggcgcctgtaatcccagctattcgggaggctgaggcaggagaatcacgtgaacccaggaggttagagcttgcagtgagccgagatcgcgccactaaaacaaacaaactcactgtaaggaaacaatgtaacccaaggcatttggggtgaccttcacgttgcctgagggtgccgagggaccagagatgctggccatggactaaggt

SEQ ID NO: 125294 - DNA, 601 bp, Human
ggaggctgaggcaggagaatggcgtgaacccgggatgcggagcttgcagtgagccgagatcgcgccactgcactccagcctgggagacagagcgagactccgtctcaaaacaaacaaacaaacaaacaaaaaacacaaatacttagatattttacatgagaattacatttatctatcagatactctaccatgccagatttccttacaattacgaaaaatagcaaacacatattgtttgtaaatgcaacacaaaaacgttaatgctctggtttctatctgccttgtcattccgttatttgastccattttcgaggttagaaactcactgtaaggtggccgggcgaggtggctcacaccagtaatcccagcacttttggaggccaaggagggtggatcacctgaggtcaggagctcgagaccagcctggccaacatgatggaactccatctctactaaaaatacaaagaaaattagccgggcgtggtggcaggcgcctgtaatcccagctattcgggaggctgaggcaggagaatcacgtgaacccaggaggttagagcttgcagtgagccgagatcgcgccactaaaacaaacaaactcact

SEQ ID NO: 125295 - DNA, 601 bp, Human
atttcagttgtctgccttatcaagtattaatatttaaataattctcatagatatattaaatgtcttcatttcttttaaacttttaagttctctttgctccaattataatcacaaacttcggaaaatgttatacctttcaacttacagtcgctatcaaaaatcaaatacttagggcagggtgtgatggctcatgcctgtaatctcaacactttgggaggtcgaggtgagcagataacttgagcccggggcttcaagacaagactgggcaacatggcgaaagccagtgtctacaaaaaaaaaatacaaaaaaattagccaggcatggtggcacacacctgtggtcccagctactcaggaggccaaggtgggttgatcatctaaacctggggaggtcgaggctgcagtgagtgagtcatgattgtgccactgcactccagcctggctgacagagtgacacctcgtctcaaaaaaaaaaaaaaaaaaaaagactgggtgcggtggcccacgcctgtaatcccagcactttgggaggccgaggcgggtggatcacgaggtcaggagatcgagaccatcctggctaacacggtgaaaccccgtctct

SEQ ID NO: 125296 - DNA, 601 bp, Human
tgcataggctctttacagagaatcaagctactcccccaaagggggccagccagagtgagatatggcccagctagtgctgacaatccctctctgaacctttcctggctggactgcctggggagtggacattttgcctgagtacaggctagtcagaagatccttgttgatagcatctgagacccacttgggcaggggctttctttggaaatagtgaagaaacagatttagtagctggtgtgaggcccaggaacctgcattcagctggtttcgacttgtgggactatgggagcaccaaggtgcyggtcttttctctaagctgcaggcgttcagggcccaagggaagcgctatttgtgaaggaacaagttcagtgcaagtgaggcttggagaagacttgaaagcagcttttgtttttgtttttgaggcagggtctcgctttgtcacccaggctggagtgcagtgacgtgatgatagctcatacagccttaaactcccgggctcaagtgatcctcttgcctcatcctccctactagctgggactgcatgcacttaccaccatacccagctaattttttatttttagtagagatgaggtctcactat

SEQ ID NO: 125297 - DNA, 601 bp, Human
aggactcaaaaacatgtttcagctgtcctttcttaagtaatacaggaaaatcaggagataaaccaagaaggaagaaaatacaagaaccaacaaaaagtggcttcaacccatattaaagaaaaaacaaatattccaggttgacagttatgcaggaggtcaaggagcaaccagtctggatttatctagggggaagctgtccttcagtagggaagagtccaggaaaaatgagtcaatcaaaatatttaatatcattttaaatacatttttaacaattcagagcaatttaaggaagaaatataarataaggcaagagaaaaggagaaagaaagtgatagagaaaaggaaatatagtcactaactggcctgtcagtgaataatatttagaagccataataattaaaaaactgtattgatcctcaactttacaatgaacctatagactaagcatgataatagaatacaatatttgtattttaagctagactactatagctgaacaatactgaaataccaaaaagaaaaaacttctcagtggcttacagtaacaaagactgatttctcattcacgtatgtcttttgtgaattcattgcaattctttta

SEQ ID NO: 125298 - DNA, 601 bp, Human
ttaagctagactactatagctgaacaatactgaaataccaaaaagaaaaaacttctcagtggcttacagtaacaaagactgatttctcattcacgtatgtcttttgtgaattcattgcaattcttttacagattgtctctattcagaatctaatcaaaggagctgggtctatctgatacatgctattctcacggcagaggagacagagagcactttcccaaccccttgaatcagagctggcctgtgactttctgtggccaagagaaggtggtggatatgatgtgtgccagtagaagcccargcccttgcaaacttctgccctctctccaaatctcaccaccatggaaacatgtggagactaaagtgtggaattaggagaagccacatggagaagagctttaacacctggaggccatccaggaccagctgatcacaagtgcatgagggggttgggctgagatcagctactgaggccagactggtacagcagaccttccagctaacactaagacctgtgagcaaaaataaatgcttattgataaatgctgctgtgatttgttggttatttgtaatgcggtattaatatggtgatagatatctg

SEQ ID NO: 125299 - DNA, 601 bp, Human
atcacacttcaaatagatcatctaagacagaacattggaattcaaatagagaagtgacaagaaacctttaaagcaggaaagagagagaagtgcggtaacctgctcagtcaggatggctgggagcctgaagagaattctcaacccaaaaaaagggtaatggagagatccccagggattcacatcccttctgcagactcctgcaatcctagccatgggagaacctctcaatgccctcaggccctgagactaacgtagggagctgcctggagaccatgaaacagcaccactccagagatgaatstcacactgtatcccacacacccccaagtcataagcagctaagcaaggcaccatagtgagagtctagtcccccctagactacctcctaccctcaggcccaaccacccctgcatctccacctccctggagtcccattgacatgcttcatctagagccatgactgcagttgcctgcagccaccatagctgaaacacaagccattggcaatgacacactgccccagcagcagcactgccatgcatttttacatgccccaaagtcagactcccctgcctgcagtgaccaccactgctggctgcct

SEQ ID NO: 125300 - DNA, 601 bp, Human
cctccccagtagcagggctatagcacattccaccagggacctgagaatcacctcgcccctgtgcaccacagctagcatgtacatggactaccagggagcctgaggacatgtccttctcacctagctccaccctgtcccccgtgtggctaagcatgccttccaggaacctggaggtcacccagccctatgtaccactgttgcctcctgaatactcctcccaggggcctgagaatggggcagccaaacctgccattaccaccacagctgacacatacctgcacacaccaactacaggcattgraactgggccaccagggccatcacagccaccaccaagagtagaccagttgggaaccagagggtggttctgccactgctactggcattgcccatgccacactggttacctagagccccaacgatctgcccaacctcctggcctactgctgccactattagcaccggagaaagttgcctggagacccaaaaattggcccccctgtacctactaccatgggtgccatcatatgctaccctggggcccaaggacaggtatgctcagccccccactgccaccactagaaaccaagaactggctcac

SEQ ID NO: 125301 - DNA, 601 bp, Human
cagaaacctataaacataaatcaccacatcaataccataaaggaaaaaacatacaattattttgatagatgaagaaaaagcatttgataaaattcaacatctcttcatgatacaaacactcaacaaactaagcacagaagaaacatacttcaatgtgataaagtccatgtatgggaaacacacagtcaacatcattctaaatgaggaaaacctgaaaacctttcctctaagaactgaaacaagacaaggatgcccacgttcatcactcctgttcaataaggtactagaagttctagtcagracattcagacaagagaaaaccatccaaattggaaaagaagaggtcagatttttactctttgcagatgacatgatcttgtatctagaaaagcagaaagacaccaccaaaaaactcttagattttataaataaattcagtagttacaagatacaacatcaaaataaacatcaatagcatttctatacaccaataatgcattagctaaggaagaaattataaaggcaatcccatttacaacacctacaaaaaagaagaatacccaagaataaatttaactaaggagatgaaaagttttagaag

SEQ ID NO: 125302 - DNA, 601 bp, Human
catccaaattggaaaagaagaggtcagatttttactctttgcagatgacatgatcttgtatctagaaaagcagaaagacaccaccaaaaaactcttagattttataaataaattcagtagttacaagatacaacatcaaaataaacatcaatagcatttctatacaccaataatgcattagctaaggaagaaattataaaggcaatcccatttacaacacctacaaaaaagaagaatacccaagaataaatttaactaaggagatgaaaagttttagaaggaaaactacaaaacactgatraaaaaaattaaagaacactaaaacaaattgaaagatattccatactcatgaagcagaagaactactattgttaaaatgaccatactgcccaaagcaatctacagattaaatgaatccatatcaaaataccagtgtcattcttcacagaaatagaaaaaaaaaattctaaaattcatttggaaccaaaaaacaccctgaatagccagagcaatcctgagcaaaaagagcaaagctggaggcatcacactacctgacttcaaaatatgttacaaggctatggtcaacaaaataacatgctat

SEQ ID NO: 125303 - DNA, 601 bp, Human; identical to SEQ ID NO: 34696

SEQ ID NO: 125304 - DNA, 601 bp, Human; identical to SEQ ID NO: 34697

SEQ ID NO: 125305 - DNA, 601 bp, Human; identical to SEQ ID NO: 34698

SEQ ID NO: 125306 - DNA, 601 bp, Human
ggttccatccactaagtagtgtcaaaactgtcatcagaggtttggatcaaccatactttctgtcttcagattaaattcaacttttgagggcccaaagaacagagaaattcaagtaagcagactcaccaggttctccgaagcagatcggtgctcaagtaccaggagtttaggagtcatgaggctgagaacctcttcacagggcctgctgccccacccagggggaaacggaactgcctaaaatgggctggtccagtaatgtcccatccaaaatgcaaatttatccataactggtatgacaggkaatctcaaaaaaggaaatatcctgttctgaggtctcccgctggattaagtgctcatgactcacagaggccctgccttagctctcagtttcagtgacttatggcagagagaaaattgggggattctctaactggtggtccaaggctgtctttcttgattgggggaaaggatccctttctatcttaacctttccctgaattgtaaaacttcctgctctgatccactttagctgatttctatattgttgtacatgaactcaactctacctctactcccttagtataatttgccaatttgctag

SEQ ID NO: 125307 - DNA, 601 bp, Human
acttttgagggcccaaagaacagagaaattcaagtaagcagactcaccaggttctccgaagcagatcggtgctcaagtaccaggagtttaggagtcatgaggctgagaacctcttcacagggcctgctgccccacccagggggaaacggaactgcctaaaatgggctggtccagtaatgtcccatccaaaatgcaaatttatccataactggtatgacagggaatctcaaaaaaggaaatatcctgttctgaggtctcccgctggattaagtgctcatgactcacagaggccctgccttakctctcagtttcagtgacttatggcagagagaaaattgggggattctctaactggtggtccaaggctgtctttcttgattgggggaaaggatccctttctatcttaacctttccctgaattgtaaaacttcctgctctgatccactttagctgatttctatattgttgtacatgaactcaactctacctctactcccttagtataatttgccaatttgctagaagtaatgagaaactgaacatagttctatcattggcaagtcctgtgatcacaggtaggtcacttctcctccctgggttt

SEQ ID NO: 125308 - DNA, 601 bp, Human
agcctggggtggtgacccgcccaccagttctttctttagcccagcatttaccgataataaccaaaggccctttctggatcttagtttacaaaagttatgttgattcttctgatctctaggaaaatcaggccagaggctggtggacagaaggcactgccagataaatcactacatagatcagaaagctttctcctttttaaagggatgtgttcaagtgcccacgtacctcactgggagcaaatctgaaatgtgatgaggaaatggtgtttcccgtaatgttaccggtaggaggcccttgagkgtaggttgtcgaggttcttggcattttgaacaaataattggacaaaacgcacaaaataacaaaggaatgaaacacaaacgaagcagcgaaagcaggaatttattaaagcgagaaagcaccccacagggtgtgagtgggccggagcaaggggctcaagagcccacttacaaagttttctggattttaagtgctccttttatggttcctatgggttaccccttatctggatgaaggatttggtctgtggctaattaaaggccgaggtgaattggcgtcctgtgcagatgaacggatggtccc

SEQ ID NO: 125309 - DNA, 601 bp, Human
cctacagcaaccctccctcaaaaaaagaccgaacacgcaattctcatctatctaactctgttaacaatcatatgaggaggaaataatcacatgataatgagtggcatgaaaccctgtgtctctaaattaagcaactcactgtacttgatgagtacatcagtcttcctgccccaagcttttgtgtgtcagactggaattaaatggaagcttacactgcagctgaattcctagaagccctggacttgtcaggggaaaagcccatggggggaaagcccatctctaggctgggcaatgaacttgragactgctcgatcacacacactcataagtaacaaaaccattaatttcttttcttttttttggtggagggacagagtctcactcttgcccaggctggagtgcagtggcatgatctcagcccactgcaatctccacctcccgggttcaagtgattctcctgcctcagcctcccgagtatgtgggactacaggcacccaccaccacacccagctaattttgtgtatttttagtagagtcggggtttcacaatgttggccaggctggtcttggactcctgacctcaacaaaaccagtgaatttc

SEQ ID NO: 125310 - DNA, 601 bp, Human
tcgagaccagcctggccaacatggtgaaaccccgtctctactaaaaatacaaaattagccaggcgtgttggcgcatgcctgtaatcccagctacttgggaagctgaggcaggagaattgcctgaacccgggaggcggaggttgcagtgagccaagatcacaccattgcactccagcttaggcaacaagagcgaaacatcgtctcaaaaaaaaaaaaagagaaaatgctcaaatgtaataaagacagtattcatcgagcgttttctctgtgccatcagtgtgctgagtgctttacctgcacyatctcatttatttcccgcaaaccctcctgtggtttaggtgctaccatccccatttggcagaagtggaaatggagtcccctagaaggtacgtagcttgtagaaagtcatgtaattagtcaacatcgtacttccagccactggccagcagaagcttccccatcaattcaaatccattgaatcctaatggcaatttaagaggcctgttttattttataggtgggtgtttgtgtgggaaaagggctaccaggaaactgactccgtggtcagctccgttacgaccaaggtcaagggcgtggctgt

SEQ ID NO: 125311 - DNA, 601 bp, Human
cccatcttgattggatgggtggtggatggatggatggatggatggatggatggatggatggatggatagatagatagatagatagatagatagatagatggaaagaaagaaagaatagataaatgataggataggagaaagaaagggaaagaaagaaaagagaagagaaaagaaagaaaagggataggatagatgacagatgataggatagattagataggtgatagataatcgataaatagaaaacagatgatagatataggatagattagatagatagatagatagatagatagatagtcagataatagatagattagattagatggatggacaccagcccccaatgagaggaggatccaactagaatcttttggggtctttgccttttattccttatatgaggaggtcattatcagcaattcttcagtctcatccctagcaaattgctttccagaaactctaaatcaattatttggcacctttatacatataaggaggaaacagaaccttttcaaagagaaatgtcacttgctgaccctgaccgagtcttctctagaatgtttgatttataatttcagttaggaaagaaaaccagcca

SEQ ID NO: 125312 - DNA, 601 bp, Human
cattccaaagatcccacctggatcaggggaacatcccccacagaagggttagccatacagtgccagattctccaggagaaattcaccaaagaaatggagtccccttggggacagattcaacttgtattgtcagccaggagctgacgtggcacttctgagaagaggccggcgcacctgctggcgggtgctttgtgcacttttcagacaggtcaggatccagcctgtaggcaaatttacttttgctttgacctgtaaaaccggatctgcccagccttcattctctccctggagaacgcctgcrgccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggc

SEQ ID NO: 125313 - DNA, 601 bp, Human
tctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccayctctactaaaaaaaatacaaaaattagctgggcatggtggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgta

SEQ ID NO: 125314 - DNA, 601 bp, Human
tgtgtgcacagaatcaatgtttctttgaaaaaataaataaatttaaaaagccctaggtcaagagattgagaccatcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaaagtccctgcackgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgcca

SEQ ID NO: 125315 - DNA, 601 bp, Human
gggaggtggaggttgcagtgagccaagattggtgcccctacactccagcctggcaacagagggagactccatctcaaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctygtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcc

SEQ ID NO: 125316 - DNA, 601 bp, Human
tgcccctacactccagcctggcaacagagggagactccatctcaaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagccygcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcct

SEQ ID NO: 125317 - DNA, 601 bp, Human
gacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaasgggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacc

SEQ ID NO: 125318 - DNA, 601 bp, Human
taggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgstaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactcttt

SEQ ID NO: 125319 - DNA, 601 bp, Human
tgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgagcgacatctcaggttggtgawgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcacc

SEQ ID NO: 125320 - DNA, 601 bp, Human
ctggggaggcccttctgcagaggctggcaccagtgtggcgtggtgtccccgttaacccgggcagtcctgccactctcagcagctgctccatccctaggcccctgtactagattgactctttaaacccagcctcgtttcaatgagcgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctccygcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtca

SEQ ID NO: 125321 - DNA, 601 bp, Human; identical to SEQ ID NO: 22326

SEQ ID NO: 125322 - DNA, 601 bp, Human; identical to SEQ ID NO: 22326

SEQ ID NO: 125323 - DNA, 601 bp, Human; identical to SEQ ID NO: 28485

SEQ ID NO: 125324 - DNA, 601 bp, Human; identical to SEQ ID NO: 28486

SEQ ID NO: 125325 - DNA, 601 bp, Human; identical to SEQ ID NO: 28487

SEQ ID NO: 125326 - DNA, 601 bp, Human; identical to SEQ ID NO: 28488

SEQ ID NO: 125327 - DNA, 601 bp, Human; identical to SEQ ID NO: 28489

SEQ ID NO: 125328 - DNA, 601 bp, Human; identical to SEQ ID NO: 28490

SEQ ID NO: 125329 - DNA, 601 bp, Human; identical to SEQ ID NO: 28491

SEQ ID NO: 125330 - DNA, 601 bp, Human; identical to SEQ ID NO: 28492

SEQ ID NO: 125331 - DNA, 601 bp, Human; identical to SEQ ID NO: 28493

SEQ ID NO: 125332 - DNA, 601 bp, Human; identical to SEQ ID NO: 28494

SEQ ID NO: 125333 - DNA, 601 bp, Human; identical to SEQ ID NO: 28495

SEQ ID NO: 125334 - DNA, 601 bp, Human; identical to SEQ ID NO: 28496

SEQ ID NO: 125335 - DNA, 601 bp, Human
ctgaagccgcggccggcgcgcaccttcgtgtggtaccgaaccgtggggcagcgcacgatgggccggatgggacccgacgcggggcgcggggcgatgcggcgcgccttggcttgccgggccttacgtctggtggagagaagcgcagcggcggtcacccttgcctaaggccgccaggccagcgctccgcgacggttgcagacagcgccccccgccctggcatcggccacccgcaagccaaggcgcagccgcgggcacgagccccaggggcagccccgagcgcagggctcacctgcggatcttmcgggccggctggttgaaccacgtggccacgcgccgctgccagtccttgtggaagtggggcttcaagaccatgccattccggctgggcgccatggctgcctacggccctgcggctgcggacgagaggggagcgagtgagaggccggaccccgggcgcgcgcacccccccgggcctccgccccgaaccctccagactgggccgtccggccgcgcctagagcccgggcagcggccgaacgctgtctgcgaagaagaaggggcccatccactcccgcgttggctgaagcgccaggccgatggcg

SEQ ID NO: 125336 - DNA, 601 bp, Human
cacacccacaactgccactattaacgttcttaagcctgacccccatcacccgcatctcagatacccacgtgttcacccactgatctcgtctgaagcctggatttgagtaagtgttcacttacgttccggacgggcatgaccggtccggtcagctgggtggccagtttcagttcttcagcctgttggtgaatgagaagagttaagtggggttggccgcactgctgcaaggactccaccctcacctggccccaaactttcccctggggattccgtgttcaggaccagtgtctgagccttttcyacaacacactttgtggccccaatgttaagaacagtccttattagttaggtgactatatcttactgagttgacgcaacacgcacgagacagttatctacctgtgaaccacgggcggggcagagaaaactgttccctaatttaactacccggaaacgtatacaatggactctttatcaaccttatcctacaaggtctttctagaaatattttggaatacgaagcattttagggagagcaacgtcaatggaaaaagctgcctccaagtcacacagccttgccatgtccattaaggttatctct

SEQ ID NO: 125337 - DNA, 601 bp, Human
gctgaaaagcaaccctgagtcaatcaccttccctgggatttaaaaaaaaaaagaaaaaccctccctgagctggacatggcggctcaagcctgtaaacccagcaattcaaaaccaatgtaagcagcatagagaaactctctttccaacaacaacaaaaaaacacaaaacaaacaaaaatacttcccaatgtatggcttcatggttgcaagaagtaaaaactaagaagaaatgttcctttccgcaaacctccacacccacaactgccactattaacgttcttaagcctgacccccatcacccscatctcagatacccacgtgttcacccactgatctcgtctgaagcctggatttgagtaagtgttcacttacgttccggacgggcatgaccggtccggtcagctgggtggccagtttcagttcttcagcctgttggtgaatgagaagagttaagtggggttggccgcactgctgcaaggactccaccctcacctggccccaaactttcccctggggattccgtgttcaggaccagtgtctgagccttttctacaacacactttgtggccccaatgttaagaacagtccttattagttaggtg

SEQ ID NO: 125338 - DNA, 601 bp, Human
gggccatacggagactagcgaaggctttgaaattcttctcttcctcagtgatgactcgagctttctccttcttatagacctagaagagaaagacaggttgttaaacccacatgcaccaaagggcaagggaacaaccaagcgtcaggagaacccggaggacctcccggggattgggggtcaggttcgctgccataagtactgctgaaaagcaaccctgagtcaatcaccttccctgggatttaaaaaaaaaaagaaaaaccctccctgagctggacatggcggctcaagcctgtaaacccascaattcaaaaccaatgtaagcagcatagagaaactctctttccaacaacaacaaaaaaacacaaaacaaacaaaaatacttcccaatgtatggcttcatggttgcaagaagtaaaaactaagaagaaatgttcctttccgcaaacctccacacccacaactgccactattaacgttcttaagcctgacccccatcacccgcatctcagatacccacgtgttcacccactgatctcgtctgaagcctggatttgagtaagtgttcacttacgttccggacgggcatgaccggtccggtcag

SEQ ID NO: 125339 - DNA, 601 bp, Human
tgtggcactgtactccagcctgggtgccgaagaccctgtctctttttttttttttgagacagtctcactgttgcccaggctagagtgcagtggcgtgatcctggctcagtgcagcctctgcctcctgggttaagtgatccctcacctctgcctcccaggagctgcaactacaagtgtgcagcaccaagcatggctgatttctttatttttagtagttctgacatgttggccaggctggtcttgaactcccagccaacctcaaagtgctgggattacagctgtgagcaccagcccaaccttrcctctttaaaaagaaaaaacacaagtccactctgaagtcagcctctgtaacctccccacaagaaaaccgttttacatcagtcactaaccaaacaaccaacagtgcttcaacacagaaagtaaagcattatccagggcttggactgtctttcaagaaagccccaaatcccctggcaggaggaagtcacagcagtgaagccccatcccaggcccagttgttcccacgaaacacaccacgtggagacccagcatgactgccgactgattccaagtccccaggagggctttattttttcttttc

SEQ ID NO: 125340 - DNA, 601 bp, Human
ggactgcttgaggccatgagttcaagactgcagtgagccatgattgtggcactgtactccagcctgggtgccgaagaccctgtctctttttttttttttgagacagtctcactgttgcccaggctagagtgcagtggcgtgatcctggctcagtgcagcctctgcctcctgggttaagtgatccctcacctctgcctcccaggagctgcaactacaagtgtgcagcaccaagcatggctgatttctttatttttagtagttctgacatgttggccaggctggtcttgaactcccagccaayctcaaagtgctgggattacagctgtgagcaccagcccaaccttgcctctttaaaaagaaaaaacacaagtccactctgaagtcagcctctgtaacctccccacaagaaaaccgttttacatcagtcactaaccaaacaaccaacagtgcttcaacacagaaagtaaagcattatccagggcttggactgtctttcaagaaagccccaaatcccctggcaggaggaagtcacagcagtgaagccccatcccaggcccagttgttcccacgaaacacaccacgtggagacccagcatgactg

SEQ ID NO: 125341 - DNA, 601 bp, Human
ctcgtgcctataaacccctctacttgggaggctgagggaggactgcttgaggccatgagttcaagactgcagtgagccatgattgtggcactgtactccagcctgggtgccgaagaccctgtctctttttttttttttgagacagtctcactgttgcccaggctagagtgcagtggcgtgatcctggctcagtgcagcctctgcctcctgggttaagtgatccctcacctctgcctcccaggagctgcaactacaagtgtgcagcaccaagcatggctgatttctttatttttagtagttytgacatgttggccaggctggtcttgaactcccagccaacctcaaagtgctgggattacagctgtgagcaccagcccaaccttgcctctttaaaaagaaaaaacacaagtccactctgaagtcagcctctgtaacctccccacaagaaaaccgttttacatcagtcactaaccaaacaaccaacagtgcttcaacacagaaagtaaagcattatccagggcttggactgtctttcaagaaagccccaaatcccctggcaggaggaagtcacagcagtgaagccccatcccaggcccagttg

SEQ ID NO: 125342 - DNA, 601 bp, Human
gtccccagcaaaaccagctttgcacatgccggagccattgtcaatgaccagcgcggcgatctcttcttccattgcgacctgcccggaaaaggatggactcaggcgggcgcgtctgtaacacggtcccctccccacagccacctaatgccctcccgcggggcagcctcggccctgccccaaccccagcggccgtggcctccaagatcgcaaccgcctggaaccgaaggccgggccttttacgtaacgtccacggctcggaagtctgcactgcggccgggccccgccctggacccccggcgcscccccagccccgtccgcctgacccggcccaccccgccttttgttcccggggaaggcgcgacgaggcctcggcagctggaagcggggccagccggggtcggggggcgcaggcctgcgacgtccagctcaggccccggggcggggcgctcaccggcagagaaacgcgacggcggagcggcggaagaacagagtgcgagagttggcagcggcgactgagaccgaccgcggcctcccccgccgttatttaagcggaagcggcgcgcccgcgcggcccggcggcgcgcgcggccccagaacatgt

SEQ ID NO: 125343 - DNA, 601 bp, Human
tgagtccgtttagaagcatttgcggtggacgatggaggggcccgactcgtcgtactcctgcttgctaatccacatctgctggaaggtggacagtgaggccaggatggagccaccgatccacaccgagtacttgcgctctgggggtgcgatgatctgcaaagacagccaggcacggcttcagctcacagagcgccccccagtcagctctcccgagccaggcagagggccaccaacccctcgactcaccttgatcttcatggtgctgggcgccagggcggtgatctccttctgcatcctgtcrgcaatgcccggatacatggtggtgccgcccgacagcaccgtgttggcgtacaggtctttgcggatgtccacgtcacacttcatgatggagttgaaggtggtctcgtggatgccgcaagattccatacctaggggacagagccctcccttagtgatgctgtgtcaccgaggatgtaagagtagaaacctttagctcacaacacctacccaggaaggaaggctggaacagcgcctccggacaccggaaccgctcattgccaatggtgatgacctggccatcgggcagctcgtagctcttctc

SEQ ID NO: 125344 - DNA, 601 bp, Human; identical to SEQ ID NO: 34288

SEQ ID NO: 125345 - DNA, 601 bp, Human; identical to SEQ ID NO: 17939

SEQ ID NO: 125346 - DNA, 601 bp, Human; identical to SEQ ID NO: 17940

SEQ ID NO: 125347 - DNA, 601 bp, Human; identical to SEQ ID NO: 17941

SEQ ID NO: 125348 - DNA, 601 bp, Human; identical to SEQ ID NO: 17942

SEQ ID NO: 125349 - DNA, 601 bp, Human; identical to SEQ ID NO: 17943

SEQ ID NO: 125350 - DNA, 601 bp, Human; identical to SEQ ID NO: 17944

SEQ ID NO: 125351 - DNA, 601 bp, Human; identical to SEQ ID NO: 17945

SEQ ID NO: 125352 - DNA, 601 bp, Human; identical to SEQ ID NO: 17946

SEQ ID NO: 125353 - DNA, 601 bp, Human; identical to SEQ ID NO: 17947

SEQ ID NO: 125354 - DNA, 601 bp, Human; identical to SEQ ID NO: 17948

SEQ ID NO: 125355 - DNA, 601 bp, Human; identical to SEQ ID NO: 17949

SEQ ID NO: 125356 - DNA, 601 bp, Human; identical to SEQ ID NO: 17939

SEQ ID NO: 125357 - DNA, 601 bp, Human; identical to SEQ ID NO: 17940

SEQ ID NO: 125358 - DNA, 601 bp, Human; identical to SEQ ID NO: 17941

SEQ ID NO: 125359 - DNA, 601 bp, Human; identical to SEQ ID NO: 17942

SEQ ID NO: 125360 - DNA, 601 bp, Human; identical to SEQ ID NO: 17943

SEQ ID NO: 125361 - DNA, 601 bp, Human; identical to SEQ ID NO: 17944

SEQ ID NO: 125362 - DNA, 601 bp, Human; identical to SEQ ID NO: 17945

SEQ ID NO: 125363 - DNA, 601 bp, Human; identical to SEQ ID NO: 17946

SEQ ID NO: 125364 - DNA, 601 bp, Human; identical to SEQ ID NO: 17947

SEQ ID NO: 125365 - DNA, 601 bp, Human; identical to SEQ ID NO: 17948

SEQ ID NO: 125366 - DNA, 601 bp, Human; identical to SEQ ID NO: 17949

SEQ ID NO: 125367 - DNA, 601 bp, Human; identical to SEQ ID NO: 25053

SEQ ID NO: 125368 - DNA, 601 bp, Human; identical to SEQ ID NO: 25054

SEQ ID NO: 125369 - DNA, 601 bp, Human
tgagcgctctcacgcacacactcacccacaccccctcgtgccaataatttaaacttctcttaggaaagccagcagcttgttccaccaccaccaccccttccgccctccccggcccacgaacatcctccccctttcccacatctaccctggatcctctctttggcagtagaaagccaaatgatttctcctaaaccctgagaaatcacaaaagttaaaatgaagcgtgtgcctatctgcccagcttgtcatccccaaccatctttctcctggcgtcaatttaacaatagctattcgaggaagkgggggcggtaaggagggggtgagggctacgtggccgagttggctcctggggtggctgcgaagcctcgcggctgcagaggggttccccctctccccgaaggcgaagtcagccgcgtaggaccaaggacagggcttggaatccacttcccagcgcccagcacagcgaggctcccaagcagccggcacttcatagacacagctccaaggatcttatttacgcttttctgaacaaagggaatctcatatccggtacaggcttaagaattcagccccaaattggctatcttcttttaaaactgaa

SEQ ID NO: 125370 - DNA, 601 bp, Human
gccgcatccttctatcgccccccaactcaagacccgaaatggccaactcttcaccgagggggcgtcccatcgctgccttgccttggcccgccccttcgccaagctcaatcccttttccccagaaaaacctgtgcctgtcctcagacccggccccacggctggaagtcaaaacccaccccggagccacgcggctggagcacgtttttacacctgctcggccgcttaattacgagagcacctgtagttgggatttttttcattgcaaaggcatcgattttagcccttctcctaaaatactacrtttaaaaaatcacctgtcatacctacctgaaattgtaggaggtaagagaaaggaaccgagcagtgggcgacccagtcgccgcaagaacgtgaccgaggttacagcttcaagggcatgatgcaggtttgatgcagcaaggtccgctaagggcgtccagcgctccccgcccccatgcgacgggcggagcggggttggggggaagggaggggactcgtctaacccagggcgggtgtgggagaggcaaatttgccctcttgggcgaagtctaatcagcatagtgaagtagggggctcaaccaag

SEQ ID NO: 125371 - DNA, 601 bp, Human
tacacacatatgtgtgtctcttttaaaaattctctttttccccctacttcgcagccaaggggtcctgtccctggacagaaaataaaggcttagccccctgctgcccctccctgcctctctagagagaacctgacgtttaaataagcccagagtacctgtgcggggtgctgtactctgcttcaaacgcaaagtaggaaatcctgcactcgactatgcaaacgcttgccgctagccgcatccttctatcgccccccaactcaagacccgaaatggccaactcttcaccgagggggcgtcccaycgctgccttgccttggcccgccccttcgccaagctcaatcccttttccccagaaaaacctgtgcctgtcctcagacccggccccacggctggaagtcaaaacccaccccggagccacgcggctggagcacgtttttacacctgctcggccgcttaattacgagagcacctgtagttgggatttttttcattgcaaaggcatcgattttagcccttctcctaaaatactacatttaaaaaatcacctgtcatacctacctgaaattgtaggaggtaagagaaaggaaccgagcagtgggcg

SEQ ID NO: 125372 - DNA, 601 bp, Human
ggaagaaaaaaacaactaactccctgaaaggtggcagcacaaagttacccaaataacaggcaacaaggggctggttttaaccacacaaaaataaaaatactctctcaaaaaggaaaattacaaaggaggaatcacagaaaatttaatgtaacatgtttcttcatattctaatttttcctaccccattctggcctttatcttccagatgttttcttcctcttctttctctccccatagtttgcaagcgaacttcccgtaagtatatcctccccacaaccttaagtgttgttaccttagcatycctacaaacctcctataaagaaggcccctaccacaaatgcagtaacattcgggtccactcagcaatacagtcaccatttatatatacccaaaggttactaagacaaggtagatgcaggacagcttttccacccgctcaccaaaatggaaactccaggtcagcttccacaagaaatgggaaattcaagcgactctggcgaaacgattcttgagaaaactcttcaagggcaacaaaacaatatttcaaacaaacagattttacttgagggaatggggacattacacagcaattgatattcga

SEQ ID NO: 125373 - DNA, 601 bp, Human
aaaacaaaatcactaaaaatggttcataacacattgaaagccaaaaatataaaactaatcaagcagtaaccacctactaccacctttccaattcagtcaatgtcatttcattgtcaaaaaatcttgtacttcaatatgctcatctttacgtggtccttgagatggggagggtaagattttatacacaatcaaaggttaagaaaccaaggatataagtaattaaaccaaaccagatgctgaaaacttcagacttctagcctactattttccacctggctgtgctaaattaagaatttcaacytaagtgacaaaacctactgagacaactcagcaaattggccgcacgggcacggtgatcacaagaccttatgtgtgtgattatttgtttacaaaaacagaatggattttaaaacaaactatgagacaggaaagcttagagtcagtcatccttcaaagaatgctaaaggcccacatcactaactcaacagcagacaagaacctctgaatgacttcacccagttctcactagtataagaagacaactctaattgccaaagtcctatttcccaaatggaacctcattttaacacgctttcttcca

SEQ ID NO: 125374 - DNA, 601 bp, Human
ttaagggagaaaagcagtggccaggcctcagaacaccaagcactggcatgagaaagccatagtcagcagcccagacaacacatgctcctggaagacatggccttagccatgaagatgacgcaaggagaaggcatagatcaatgctctgaaaagcaccccagcttctgtcctgttacttgcttcttgctcctgcaactatattcccaaaagggaggaagtcaaaaaagttgtaattattttgactttttcctaggtgttttgaaaaataaatgttatacccagaggaggctgctggcacatratgttgtcaacagaataaaactctgggggaaacacccagcttcatgtagtttgaaacacaacgtgcctcagatctactcttctgggacaacagtggaattaagacagtcacagcttgtctctctctagccacaccctcaaacttgagtaggttttgcagaaatacttttcacctgtgactgagctcctggcaaactaggaaatagttactcataccataaaagaaaatcaaaggtaacaaaaacaatatgggaggaacgggggagggaaataagacataaaaagcaaaaaatagacaaaa

SEQ ID NO: 125375 - DNA, 601 bp, Human
tctgatttcagccaccttaaactacagccagcagaactaccaaaagtagaaagaacatcattctgggatccatggaaagaggtacagaactaggagtctgacctgatcctacttccccacttggttgtatccttgggcaaaccacctgacctctgagcttcattttcctcacctataaaacatcattcccagggagctgtggcaagtttctataaggacagaaaaacttggtgttaatcaccattactagaggaaatgctccgtgtctcctggttccatcaccttgtggtagttcaccatmttcaattgccaactccacgtatttttctatcttcctaatggtaagtcaacaactaaaaagtggcagatccctgctgccccatcccaatccactgctaacttgactgtccaacacaaaatttcttactgttgcattctcaagggagagtcatttggaagttaccatagaagttgtacaaaaggaaaaccaaaacagatgtcttcactcttcctgtctaggtcacaaactattattcactctaaaaccaaagatttcaccctaccatccacaaaacaatgtttataagtcagccaaactgtt

SEQ ID NO: 125376 - DNA, 601 bp, Human
agggaatgagagagagaaagaaatgttagccataatgaaaaattccttatgggtaaagttccagaaaattccttaaggagtctgaactataacacccaaaacttaacaaagtccctggatctcttaatgcttctgaattccatagggaactggggagctacaaagcattttacccaacaaaatctctggtagtcttcgccaaatttaaggaaacacaacaaaaattaaagagaaatgatacgtattaaggtcaaagtttaaggttactatgtcctataaaatgtgatgatgagtaaaatgytattgagctttcaccctcaacaattaacttctgcttcatcctgtgatattctaaattacagctaaccagtacggagcagccttgtcaggatcccacctgactgctttgtgcatagcctgttggccaattttataccagaggcacctgcttgaaatatgtagagacaatctgatgaccttattttctcacgtttacaccagctttccatagcacaaggacaatatttatactctaggaagagtaaaatatttgcagagataagaaatcagagaacatgttggcatgaagctatttcagctt

SEQ ID NO: 125377 - DNA, 601 bp, Human
gcaccctcatggctactaataaataaaacggtacaaacatccctttcaagtctaccatttgagagagtggatactaacaagagatatgatttgctaagctaaataaaagccttcattaacaagaagtgacaggatcacaaccctgctgctgataaactgccaacatacccaaggtcttcaatgaagggttgcccatttaacatactgcagctttaaaatgagttgctttagaacgaacagttctatgtcaaggcaggcctacaacatacaaaacagatggagctgctactgtaccttgggyttgtgtgtgtacccatgcacgagcatgagcttggcatataccacaggagaacctggcccaataacgcttcttaaagttagccatccatgattagagcatctaccttagacctcaacttctctatctgcttccaaagatactcagtgtagagcagaaaacattcttctgatagccgaagagggttccacatggctattaaatgactggcccagtggtcatccatggagacccctccttattcctggcaaacacagtcatttcagtccaaccttgaagcagccaatatcttttcaatacagc

SEQ ID NO: 125378 - DNA, 601 bp, Human
tggttctcaaagcatagcctgggaacctaagagtcctctgagacttcctcatacatccgggaagtcaagagaatgccttttcctctcataaatgtacagtagagctttctaaaggttatatgtgacacttgcttctgcattcagtctgttgcaatgagaatacagttgactagatctattaagccagacgttaaagaaatgtaaaatgtaaaactatgccagccttactttttaaaaatatacatattcctcactttaaaaatattttttaatatgtaatgggtttgctatttaaacaggyttttaaactttctcatcttaatttcttatacagtaaatatttatacacataacaaacaaaaggtcctggggtcctcaataatttaagtgtacaaagggatcctctgatcaagaactttgagaattactggtctaattcactgctacataagcatgcctttatggtgaatccctttagcccatatagataaaccttagaacagcttccaactactctccttaccttcaaagggatgttcctccagctctgggactatgtaaactacttctcatgcccagtactaccctgatttataagaaa

SEQ ID NO: 125379 - DNA, 601 bp, Human
atagtaactcttgctactcccagcagccaacaccctagtttgaaagacatgcaggtcaccagtgcatcttctattgagagcccctaattgccttaccacacccaaggtgcttcctgctagactaagcttctttacagacctaacacaccaaataagagaccacagttgggcaagaaatctattaagaattagaaaaccctgaaagggctctatttaccactgaaaagaaaaatcttaagccctttgtagtttcccattctctttcctttcccaaaagctttaagaggtctcccagcaaacytaaaccaagccctcacttttaaacacagctgtccaaggactctgtgggtgggtgcaggggacagacctaatctttccctatgcaagatttgaagagtattagagaaacaaagcattaaagaaacaaaagccttaaagtccaatatttctcctaaaataacctcattaaggcaagttttctttggtcttccaaagaatcccaattcaaaaatgagaaaagaaagtagctaataatgagggcttcaccataaagcatcacaatcaacctttcattattcccattctgtaggtcagacatcga

SEQ ID NO: 125380 - DNA, 601 bp, Human
ctaaggcactcagggtgaaacctggactagaacctagatgtccctccataaaaaacaagattttgtactcttactccaccccaccacgtgagtggggaaaagcagagttttgagggcctacaatcctcaagtctgatcactgggtctctcacatctaattacaatatccagccccatttccaacttaataagattaattctttgtcactgatgctcaatagtaactcttgctactcccagcagccaacaccctagtttgaaagacatgcaggtcaccagtgcatcttctattgagagcccytaattgccttaccacacccaaggtgcttcctgctagactaagcttctttacagacctaacacaccaaataagagaccacagttgggcaagaaatctattaagaattagaaaaccctgaaagggctctatttaccactgaaaagaaaaatcttaagccctttgtagtttcccattctctttcctttcccaaaagctttaagaggtctcccagcaaacctaaaccaagccctcacttttaaacacagctgtccaaggactctgtgggtgggtgcaggggacagacctaatctttccctatgc

SEQ ID NO: 125381 - DNA, 601 bp, Human
agatgggtttatcaggacataagccccatcataagtcagagcaccttcttgtagccactgaaccatgccccctcgcttttgaatcaacactgtcatctatccataactgctaatttaccttcactaaaatgagtgtctaccaatatctacccctcatcctccaattcccatgagaccagggcaagcctttatcatcatatacactgcttcaaatctgtctcctcctccaacatgctcatctttatataatggctagcttcaacttcccaaaaacatctcatgctatcacttgctcaaataycatcaattgtatacatacagaccttcatttaagggcctttttaactttctaatccatccctaatgttttctcccaacttctcaagccaaaaccctgcataaggtcaaaatgacccataaccatcctctgaatctgttgcattattttatttacttccttttttcatatttttcttttattttttagacacaagttcttactctgtcgcccaggatggagtacagcggtgtggtcacagctcacggtggcctccaactcctagaatcatgctatcctcccccgtcggccttccaagtatct

SEQ ID NO: 125382 - DNA, 601 bp, Human
catttcccttctggaatgaaaaactaaaactgtagatcagaaattcaggggaaaagaatcatttctgttcatgcctcgagaaattaaatacccttacccctgttagagaactgaagtgtatctcccaaaattaacatgttgaaaccataatctccaacgtgactatatttgaaaacagggttgtgtagttcagtagtttcagtagaaacggtacttcaagtaactacacaaccactctgtttttcactctatttccttaattatttcaggaaataaggctaaatgaggtcataagtgtaartaattaagaataaatgaggtcacaagtatggggccctaatccaataggattggtgtccatataagaaaaggaagagacaccaatgatttctccttctttacatacccagagtaaaagctaagtgaggacacagtgagaaggtggccttctgcaagcctgaaacagtggtcttgccagaaaccaacactaccaaaaccttgatcttggtcttccagcctccagaaccatgagaaaataaatttctattgtttttgctacccaggctatggtattctgttatggcagcctaagcaaactaat

SEQ ID NO: 125383 - DNA, 601 bp, Human
ctttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgtatgtcccctaaccctactgaagtgaccgtcatttcacaaatagtgaatttatatattaagtgatttattaaatttatgctacatacaaaattaygtattaaaatgcatatgtgtcctcaactgaattcttgaggcatagtattgaggaaacagttcaaaatagtaatacaattcggtaaaacttttaattatttctcaaaagaatccacacaacttaaaatctgacacctgctgaatgataaagcttggtcatctgcacaacttcctattcaactttcattttcacaaaccttattttgtcttaagatgatttccacgcactcagcagggtaatcttttagctaaatgatccgaaacccacaatctgaatggcaagaaattgcttcctaaataa

SEQ ID NO: 125384 - DNA, 601 bp, Human
gactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggaactactgccatccaagcaaaagaaaagagaccaacggcttctgtattcttatagagggcagtgtaagaatatagtcccccaattttttccttcttaccattacaactttagatggccttgttaaagactcagtaaatggggaayagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgtatgtcccctaaccctactgaagtgaccgtcatttcacaaatagtgaatttatatattaagtgatttattaaatttatgctacatacaaaattacgtattaaaatgcatatgtgtcctcaactgaattcttga

SEQ ID NO: 125385 - DNA, 601 bp, Human
cgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggaactactgccatcaaagcaaaagaaaagagaccaacggcttctgtattcttatagagggcagtgtaagaatatagtcccccaattttttccttcttaccattacaactttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgta

SEQ ID NO: 125386 - DNA, 601 bp, Human
tgtgctttggggccgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggractactgccatccaagcaaaagaaaagagaccaacggcttctgtattcttatagagggcagtgtaagaatatagtcccccaattttttccttcttaccattacaactttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggt

SEQ ID NO: 125387 - DNA, 601 bp, Human
gagatatggcagtcccctttttaccaggcactcaaaagccccaatagatgcctgaaacttcagatagaactgacccctaccatgttttttcctacacatacctatgataaaatttaatttctaaactgggcccagtaagacattaacaataactaagaactgctgtaacagtacactgtaataaaagttatgtatatgtgatctctcagcgtatttagttttctttaagtcgagaactttcacctttttacttaaagggaacatggagcactttaacatcctctctttggcatgtcagaaytgccagcatcactactcttgtgctttggggccgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcg

SEQ ID NO: 125388 - DNA, 601 bp, Human
atcggatatagcctagtagttacaactgttaactctacggtgatcccttctagcatttgccatcctaagtcttgatttcctcatttaggaaatggagaaaataatcctatcatctcattcagttattggaataaatatatgagatatggcagtcccctttttaccaggcactcaaaagccccaatagatgcctgaaacttcagatagaactgacccctaccatgttttttcctacacatacctatgataaaatttaatttctaaactgggcccagtaagacattaacaataactaagaacygctgtaacagtacactgtaataaaagttatgtatatgtgatctctcagcgtatttagttttctttaagtcgagaactttcacctttttacttaaagggaacatggagcactttaacatcctctctttggcatgtcagaactgccagcatcactactcttgtgctttggggccgctgaaagtaaaagaagggctacttgaacacgagcagtgcaatacctcgaaagtcaatcttataactgagatggctatactaagggactaacagcatggatacactagacaaagggaggattcacatc

SEQ ID NO: 125389 - DNA, 601 bp, Human
gcatttttatcagcacccgatttgattctaatctgcaagcaaggatgagaaccactgtaaaagacttttgtaagacaagtggactatcagctaggtagtgccaaacaaacaagagtcaaataatcagagactggggaattcatccagcttttagagggcaaacagaagttcaaaaacagtggaggtgctgaggcagagctgatccagactaacttcagggaaagtctgaacacaggctttagtccaagcagtgattaaaaaggcgcaaaaaaccaggttggaatcattttgctgagagaaygaactacaggttagaaaatttttacttttaagactgtaggtaagaagggagcacaaaatgacttttacagctaatgtaaccaatgggtatgaattttaggaaaataaggaaaaaataacagttgactaacctaaagccaatggaccaggatataaaatataacaagtgagtgacaataaacagagcttgctgagcaatcggatatagcctagtagttacaactgttaactctacggtgatcccttctagcatttgccatcctaagtcttgatttcctcatttaggaaatggagaaaataa

SEQ ID NO: 125390 - DNA, 601 bp, Human
actcacaaaacctgccaatgtgggtctaacaaactccagagcccatgctctttgcaccacacatcaatgaagcagctaaaataaccaatatcttgcttcaccccagaccaattaaataagaatctctcctaagggcccagatactggcatttttatcagcacccgatttgattctaatctgcaagcaaggatgagaaccactgtaaaagacttttgtaagacaagtggactatcagctaggtagtgccaaacaaacaagagtcaaataatcagagactggggaattcatccagcttttagrgggcaaacagaagttcaaaaacagtggaggtgctgaggcagagctgatccagactaacttcagggaaagtctgaacacaggctttagtccaagcagtgattaaaaaggcgcaaaaaaccaggttggaatcattttgctgagagaatgaactacaggttagaaaatttttacttttaagactgtaggtaagaagggagcacaaaatgacttttacagctaatgtaaccaatgggtatgaattttaggaaaataaggaaaaaataacagttgactaacctaaagccaatggaccaggatata

SEQ ID NO: 125391 - DNA, 601 bp, Human
tttttgagacggagtttcgctcttgtctcccaggctggagtgcaatggcatgatcttagctcactgcaaactgcctcagcctccagagtagctaggattacaggcacccgccaccatgcccagctaatttttctatttttaatagagatgggtttccaccatgttggccaggctggtctcgaactcctaacctcaggtgatccaaccgcctcagcctcctaaagtgctgggattacaggcatgagccaccacgcctggcctcatccctatttttcaaatgaggaaataggcttaaaaaaamaaaaaaaaaagattaacttttccagaactcacaaaacctgccaatgtgggtctaacaaactccagagcccatgctctttgcaccacacatcaatgaagcagctaaaataaccaatatcttgcttcaccccagaccaattaaataagaatctctcctaagggcccagatactggcatttttatcagcacccgatttgattctaatctgcaagcaaggatgagaaccactgtaaaagacttttgtaagacaagtggactatcagctaggtagtgccaaacaaacaagagtcaaataatcaga

SEQ ID NO: 125392 - DNA, 601 bp, Human
tcacactttaaaaaaaaaatgcagctcaataaaaatgtacctattaaaaatagaaagacagttatccctttcaactggtgttgatctgccctttattactggagatagactgtatcactcagaaagttaccctgaagctataagaagcttggaggaaaatattaaacttcaaggtacagataggaccaggagcctgttaagacagaaaacgaagacattaatgttcaaaaagtatataagcaggaaacctgcagtagtctcagtaacagattttagtggcaaaaaaaaaaaaaaaaaaaaragagagagagagaaaggaaagccttttaaaaatctaagccactggaattttaaagtgacacccacatgacccagtttacttttctattcaaagaagttctgatgctgtttctctatttctctttggaagtttttcatgtccaatatattgcaaaagataaaaggtacacttttatttaagcacacaatggaataaaacatcactgaggaacttggacctgtaaataaattttaatgggaaagacaagaattcaaacatgaggaaagggcaacagatatatatacggcaaatgtgagaaag

SEQ ID NO: 125393 - DNA, 601 bp, Human
taaaaagtaacatagaaaagctgtttaacataccaggaaagtcaaggagaactttaaaaaaattataaccataatacctaatttcatcaaaatgatgtaagcaacaaagatctaatttatattgagataaactatataggctcagactattcaggcaaggaaccagtaaatgcttatttcatactgaaatttacaggacatgaatgacttagcaatatatattgaccctgagctactgaaatgacaacaacccaaaggtgattactgacatatcagaagaataacaatgaaacttgagggygagagtctctttcacactttaaaaaaaaaatgcagctcaataaaaatgtacctattaaaaatagaaagacagttatccctttcaactggtgttgatctgccctttattactggagatagactgtatcactcagaaagttaccctgaagctataagaagcttggaggaaaatattaaacttcaaggtacagataggaccaggagcctgttaagacagaaaacgaagacattaatgttcaaaaagtatataagcaggaaacctgcagtagtctcagtaacagattttagtggcaaaaaaaaa

SEQ ID NO: 125394 - DNA, 601 bp, Human
ccttggcaaaacagagttgacaaacctattattcccctcccacaatgtacagttttacttcttattgtacttccctgagaagtacatatatcaaggaacaactgtcacaatgagggttgaggcagtagagggagccactcccagagttcacagcagcactgttcatcaaagcacaagaaatgaaaacaaagtgtttatcaaggaagatgaacaagaaagatatgaagataaagtcatacaagttcacacaattcaatgttcttcagcagccaagtaagagcccacacatagaccaaagcayattataaaatgagaattttgatgaatttaacttagtgtcctggaggacaaaaaaggacttaggatcttttagttatcacagctgcacctacaagtcaaatataggcaaaatgaaacatttttaatcagatatctcccaaattttgcattactttaaggatagtgtgaaaacaaaaataacaagggaggaaacaatccccttcaaattgaagccactatagctcaatcctcactgtctcacgtctgttaacccaaaactcccagtatgagtacgaatcagtcacgacatagaaatctagac

SEQ ID NO: 125395 - DNA, 601 bp, Human
aagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgyggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctgggaggcagagcttgctgtgagccgagattgcgccacgacactccagcctggggccacagagcaagactccgtctcaaaaaacaaaaacaaaaatgctgggcacagagactatagcataaacaagacaggtactaagggaacttagt

SEQ ID NO: 125396 - DNA, 601 bp, Human
ctggataaccaagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggytgaggcgcgtggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctgggaggcagagcttgctgtgagccgagattgcgccacgacactccagcctggggccacagagcaagactccgtctcaaaaaacaaaaacaaaaatgctgggcacagagactatagcataaacaagacaggtactaag

SEQ ID NO: 125397 - DNA, 601 bp, Human
agctttcaaataaggctttagtcaccactaaaaggacacagaagaaaacagatatgcctcaaatatcaacacatttgaaggacagacatctgcattcattctaacatgcaaatcctatgtgcagggcactgtgctggataaccaagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagscatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgtggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctggga

SEQ ID NO: 125398 - DNA, 601 bp, Human
caactacaaagtggccatgcactaacctgaaaacaacgaggttcattattgaataaaggcatcaggaattcttggagatggagctttcaaataaggctttagtcaccactaaaaggacacagaagaaaacagatatgcctcaaatatcaacacatttgaaggacagacatctgcattcattctaacatgcaaatcctatgtgcagggcactgtgctggataaccaagatgactcagataaggagttcccacttactgtctaagcaaagaagggaacacatgcagaaccacaacacaggacrcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgtggatcacgaggtcaggagatcgagaccatcctggctaacacggtgaaaccccgtctctactaaaaaaaatacaaaa

SEQ ID NO: 125399 - DNA, 601 bp, Human
aaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcataygttccatcccataccaagaaaaccactttatatgctcaaatacttcttggtatattctgccaatgaggcgattctacctgaatttattaataaactatttaccagcctgcttgaccaccaaggtttggtaaacagacttgggcccgatgtggaagcatagctaaggatggagaccccggggcacaagaagtgagctgaagtgaaaccaggaaggaagacaaatttctttgatagcctcttctctttccaatcccagcttcccatctcagttgctcattgtgccttcatcccctctcccat

SEQ ID NO: 125400 - DNA, 601 bp, Human
taaaaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcrtacgttccatcccataccaagaaaaccactttatatgctcaaatacttcttggtatattctgccaatgaggcgattctacctgaatttattaataaactatttaccagcctgcttgaccaccaaggtttggtaaacagacttgggcccgatgtggaagcatagctaaggatggagaccccggggcacaagaagtgagctgaagtgaaaccaggaaggaagacaaatttctttgatagcctcttctctttccaatcccagcttcccatctcagttgctcattgtgccttcatcccctctcc

SEQ ID NO: 125401 - DNA, 601 bp, Human
agaagtttctttaacataaaaatgtccaagcagataaccaagtcaaaacacttttattactgaacagcagacggtgatgttttagttggcaatttaagaatcacacgctatagctattcctgaaaaattcaaaatcaaagtacatcgtaagcatttgctcagaggctagcatagtgcttaacgcagagtcttagcattctcaaaaacatgcaagaccagcctggccaacatggtgaaaccccagctctactaaaaatacaaaaattaaaaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcatacgttccatcccataccaagaaaaccactttata

SEQ ID NO: 125402 - DNA, 601 bp, Human
agcgtgttagtcaggatggtctcgatctcctgacctcgtgagccgcccgcctcggcctcccaaagtgctgggattacaggcgtgagccaccgcgcctggctaattttttaaaatcttttgtggagacgaggttttgccatgttgctcaggctggtctcaaactcctaggttcaaaggatcctcccacctcagcctctcaaagtgctagaattacaggcgtgagccaccatgcccgaccaagaagtttctttaacataaaaatgtccaagcagataaccaagtcaaaacacttttattactsaacagcagacggtgatgttttagttggcaatttaagaatcacacgctatagctattcctgaaaaattcaaaatcaaagtacatcgtaagcatttgctcagaggctagcatagtgcttaacgcagagtcttagcattctcaaaaacatgcaagaccagcctggccaacatggtgaaaccccagctctactaaaaatacaaaaattaaaaatacaaaaaattaaaaatacaaaaaaaaaaattacaggcgtgtggtagtgcacacctgtaatcccagctactcaggaggctgaggcaggaga

SEQ ID NO: 125403 - DNA, 601 bp, Human
tggcaagagtccatattcccagagctactagccagcaggttgccctataaatggggtgccttctttccagctctcccaatacagccttaatgttccggcccctgcaagggctggattttaagtaaaagagtatcatagcctaaatgtcaaatgtgctaaagagtatatgcttttctaccatgatggagaggttcagaatgtcagagtactgggggagggagggggttttccaaggtcatctaaactgaggatctttaattgtagacctaatcatctgtgaaaatattctaatgaatatgcrtaacaaaaaatgaggcaaaaaagcatcaagtctgtgtcactaaacatcctaatatgactgccacagacattcaaagcactctaaataactcattttggcctgtttatactactatggatttggattagaaagtcatcctgtccacaaagaattaggtatatcctgtcccttctgggggctgagtttgagacagttaattcaaacctaatcaaatattttgctatgagaaagaagaggaggggccaatgaagtgctttatccccaggatgaggcagtgagtagggcagcacacaaaaaaga

SEQ ID NO: 125404 - DNA, 601 bp, Human
tcatatacctaagggcatggtgaacaaaaccccccagagtggctatgaccagcaggaagaaaacattgaggggatgggagtcaaaagtctacttaaagtattaagcattcaaataaatggcagaatccgagggccagcttgcaaaaacaaaaaataaaaagccaacaatggactctgcttaaataaatcacgtgcgaggttgaaaagaaggacaaaggaaaagtggcaagggatagacaaaaacaagcagattctgtaactctcctcaacctccaggccaaagttcggactggcagctagygggtagatttagcctgaaaacatgttacgtggtttctccaacgtccttaaaaacaaaacaaaacacaaacaaaaacagtagtgttcaacatttaaaatttcaccaatgtaacaatttcacattcataaaactatatttctgatttcgcttaataaataaagtttggcaagagtccatattcccagagctactagccagcaggttgccctataaatggggtgccttctttccagctctcccaatacagccttaatgttccggcccctgcaagggctggattttaagtaaaagagtatcata

SEQ ID NO: 125405 - DNA, 601 bp, Human
aaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaarctaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaacatg

SEQ ID NO: 125406 - DNA, 601 bp, Human
taaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaractaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaacat

SEQ ID NO: 125407 - DNA, 601 bp, Human
gtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaaca

SEQ ID NO: 125408 - DNA, 601 bp, Human
ctggtgtgtagaataccaaaaagaggagtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaa

SEQ ID NO: 125409 - DNA, 601 bp, Human
atcaagaggaaacctgaagtttatactctctccccaacacagccaaggtctggtgtgtagaataccaaaaagaggagtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctasctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtac

SEQ ID NO: 125410 - DNA, 601 bp, Human
ctacctcttcatccacatgcccagcacccccgcatcatatacacaagctctaacaagctcccagtagttcttcccactcccagtgttttccagtgtcacccaacctgttttctccacctgcaacagcctacctttcttctcctgcctcatggaaacatcctcagcaccggaagagagcagacaaacctcgaggaagccttctgtgaaccactcagttggaccagataactctgtgtgctcctatatgcctgactcacctttatctccccagtaaaaaatatcaagacagatccataaagaraatgaatgccatgaattgtgattcaaggtggcaagtaaaaaacaacccccttacttatccatgtggttttatgttccctgccaagtgggaaaaatttccattgcaaccctgtatagctggaggagcagccaaagtcatctcaggttgtttataaagaggaaggtagactgtcaaggggaaaaaggggaaagtaggctgtcaagtcctaccactaacacacacatctctttccgcatatagctactaattccatattgtaagctcaaacttcaagtggaatcagcattttttaattcctag

SEQ ID NO: 125411 - DNA, 601 bp, Human
gaccccatctagagcttcctagctgatctctctatttccaggcttgcccctttctccaatccttcctccattccacggctgtggggatctaactaaaataatgggcagcactccactactatctcttttaaagctctgctcactccacgttgcctatgaagtaacatctcagctccctagtgaggcagctgacttgaccgagctcctacctcttcatccacatgcccagcacccccgcatcatatacacaagctctaacaagctcccagtagttcttcccactcccagtgttttccagtgycacccaacctgttttctccacctgcaacagcctacctttcttctcctgcctcatggaaacatcctcagcaccggaagagagcagacaaacctcgaggaagccttctgtgaaccactcagttggaccagataactctgtgtgctcctatatgcctgactcacctttatctccccagtaaaaaatatcaagacagatccataaagagaatgaatgccatgaattgtgattcaaggtggcaagtaaaaaacaacccccttacttatccatgtggttttatgttccctgccaagtgggaaaaat

SEQ ID NO: 125412 - DNA, 601 bp, Human
tacaactaaaagtaaaaataaatggcaagggaaagaaactagcaattattgattcctctttccatgccagtctcaagctagatatttacaaacaaaatcttatttaatcctcttgtggagcgggcaaggtgactcacgcttgtaattccaacactttggaaggctggaggacaccactgcactccagcttgggtggcagagcaagaccatgtctccaaaacaaatcttatgcactataagctatattacattctcttcaatttacaaatgagaatttcaaaacttcaagagttcacacaastattaagtgagaaactgggatttgaaatcagtgctgagaccccatctagagcttcctagctgatctctctatttccaggcttgcccctttctccaatccttcctccattccacggctgtggggatctaactaaaataatgggcagcactccactactatctcttttaaagctctgctcactccacgttgcctatgaagtaacatctcagctccctagtgaggcagctgacttgaccgagctcctacctcttcatccacatgcccagcacccccgcatcatatacacaagctctaacaagc

SEQ ID NO: 125413 - DNA, 601 bp, Human
tccatgtatctacattcatacaaaatcatacactctcctatcatctttctcctatcatgatcttcaaaaatgacctgaatttaaactgtggctttaaaatcacatttaattacaagaaaaatagaaaaggaactttccgtgggatttgagtatcttttgctacagtaaagaagttcagatgatctccctgccttctggagaatccaacgaatcctacaactaaaagtaaaaataaatggcaagggaaagaaactagcaattattgattcctctttccatgccagtctcaagctagatatttacaaacaaaatcttatttaatcctcttgtggagcgggcaaggtgactcacgcttgtaattccaacactttggaaggctggaggacaccactgcactccagcttgggtggcagagcaagaccatgtctccaaaacaaatcttatgcactataagctatattacattctcttcaatttacaaatgagaatttcaaaacttcaagagttcacacaagtattaagtgagaaactgggatttgaaatcagtgctgagaccccatctagagcttcctagctgatctctctatttccaggcttgccc

SEQ ID NO: 125414 - DNA, 601 bp, Human
aaatcagtagcttaaaacatgcaactactactaaacatagtatatcagaaaattgatttgtaatctatgtgagcccccttaaaactttcagaattcaaagtaaaatagctcaaagctctccccaaaagtttaaaaacaaagtggatgaagattagattaagtcacattttgtaaaatgggagtaaactttaaaatctgtatttttcaacagggtcatttatatacctctacaatagtaaaggttaagccatgagataactctgtcttggttataggctggaatacactaaatcattacctkctggtgatgaatcattccaaccccattctttcattccaacctaagtggacccaattaatttccatgccattatttggcaatagaatctaaaaagggatatgagtacaacaagaataaaatcaactactccctcagttttgtggcagaggttttgtttggtataggcagattaatctgaattgctaaattaagacagttaacatagtaatcaacacagaaattggattaacttcacattcttctacaaaagtcacagctatcaggaaccccctcagggtagtacaaattgtgaaaggctga

SEQ ID NO: 125415 - DNA, 601 bp, Human
aggtctaacaggaagtaaagacagcccccatggagatatctagaagaaaagattctaggcagagacctgccagtgcaaagcttgtctgctgtgcagaatgacaaggagataacagggagagtaggaggagatgagtctaagaggtaatgaggccggaacacatagggccttgaaggccaccataacaaaaaaggaaactataaaaggttttcagcaaaagagtagcatgtggctactgtgaaaataaattgtgtgtgggtgtgcaggaagactcagtgagtttggaaacagaccagtcaaraagcaactgcagcaattcaggtgcaggatgacagtgactcccaccagggtgaagttggggagaagtcatcagattctggatatacccagaagaaaacacattattaaggtgctacattttaattacatcagtacactgttgaaatccattgtcaaaaaactggtttagatactaactgctcacattcctacaaaccaccaaaacatttactatgctctggacactaagaacacaagatgaataagcaaaggaagagattttatggacagttgtgccttaaaagaaaataaggatatatat

SEQ ID NO: 125416 - DNA, 601 bp, Human
gtgtatttttatttcaacaatctatcacactaactacaaaaccctggaagacaagacaaatccaagcctctggccagcagggttatggatatgggcatgtggaatttgggtccaacttcaggaaaatggcaaaatcaaaggtaaatgcaggaaaattaaacagatcttgaagaaggcatttagaagcacatcatgattaagtcgtggatcaccagtgatcttcatactaactagaaaagtttaggcaaacagaaacgataacatctcttaaaagaatcatggctagaggcaaagacaagcwtatctctcaggctggaaaggtccagcctaaacagagtgaacttggtctctacacttatttgcaactagaagctttgaataccctgagtattcaaacacagcacaccaggacagaatcagcccagtacaaaggccttccttctgaccacatcaaacctctccctaaatgccaagttacagatgaacagaagacatttgtctctaaagttttagagccaaacatacaaaacacaaacaaacaaacaaaaaacaaaaccaggcatcacaacctttaccacaccatcctttggggaacttgcag

SEQ ID NO: 125417 - DNA, 601 bp, Human
tacaaatacatttaaactataaattggaaacacaaataatcatgagtggctctaacttgtttttctatcccaccaagtatttcaaaccagaagtaattatgaaagcatattttcaagttttgacgcactccatcagccaccctcacccactgaaatctaaattcctattatatggtaaaaggaaaccatctacctttgtgaaaagttgtgtatttttatttcaacaatctatcacactaactacaaaaccctggaagacaagacaaatccaagcctctggccagcagggttatggatatgsgcatgtggaatttgggtccaacttcaggaaaatggcaaaatcaaaggtaaatgcaggaaaattaaacagatcttgaagaaggcatttagaagcacatcatgattaagtcgtggatcaccagtgatcttcatactaactagaaaagtttaggcaaacagaaacgataacatctcttaaaagaatcatggctagaggcaaagacaagcttatctctcaggctggaaaggtccagcctaaacagagtgaacttggtctctacacttatttgcaactagaagctttgaataccctgagtattca

SEQ ID NO: 125418 - DNA, 601 bp, Human
tcaggacgctgaggcaggagaatggcttgaacccaggagggggaggttgcagtcagcagagatcacaccacttcactccatcctgggtgacagtgagagactctgtctccaaaataagtaaataaatatatcctaactatattctgagagttgttattaagttcactcagtataatgttgcgaggagggaaaaaggttccatagcctagaaaccacctgatttagggaccagacttctgcgggttaaagtcatagcagggctgctgaaagggccaatacaatgacccctggtgaggctgckcctgttgctccagccactccattgccatggtcaacatcctgacctgggctctcatcttcttcaggaccagcaaattaaagcctccaaaaggtccctctctcctcatcctaatctaccttaacaatgttcccaggtagactttctaaaccctcccacagctccctgctgcctatcaaatgaagtgtaaactactaggtatcaacagaaatcctgtacaactacttttatcagcccacttattcaagcaccttaagatctgaactactccttgtccctcaaacagtccagtaccttcactct

SEQ ID NO: 125419 - DNA, 601 bp, Human
acagacaactgggctgtgtactatttatagattccactggctctgaaactcttcggaaagaaaaaaaaggccatattccagtgaaacagagccattaattttaaggcttaaaaaaataatgtttcaatatatattctcctcttaatttagacatcacttgtgccaattcagactgcttttcctcctgttattatccaagtaataatttatgaaaaggcactttagcatagatgaatctagaatattctaaactttcactgggctccaaggtaaaatggctgttactatggtgaaagcgtargttttattgggaaatagaagattgtctctacttttatacacacaggtacttccaaaaagccataaagacttctaaactttttatttaaataatcctttatgaattttaacatctactgttttcacaatagtggaatttagaaaataaatgctttatatctcatatctgggaagagttaagaatttgagaagtcaaactgatccaatagtttcctggtcacatgagagaaaagcagtctatattttctaatcttacaattaaaaaattctgcaaactaaggtaatcagcttcttcactatt

SEQ ID NO: 125420 - DNA, 601 bp, Human
cctttatgctggccaacaattcagttactaaaaatgtaaagctacttccccttcacttaaggacaggcaattctgctctactcaatctaccacagacaactgggctgtgtactatttatagattccactggctctgaaactcttcggaaagaaaaaaaaggccatattccagtgaaacagagccattaattttaaggcttaaaaaaataatgtttcaatatatattctcctcttaatttagacatcacttgtgccaattcagactgcttttcctcctgttattatccaagtaataatttaygaaaaggcactttagcatagatgaatctagaatattctaaactttcactgggctccaaggtaaaatggctgttactatggtgaaagcgtaggttttattgggaaatagaagattgtctctacttttatacacacaggtacttccaaaaagccataaagacttctaaactttttatttaaataatcctttatgaattttaacatctactgttttcacaatagtggaatttagaaaataaatgctttatatctcatatctgggaagagttaagaatttgagaagtcaaactgatccaatagt

SEQ ID NO: 125421 - DNA, 601 bp, Human
cttttacttattgataattataaaaattttatcctgagaggcaatcctggctgtgatttactcttgatattagcaatgccgccagtaacgatggattccactttctggcatctatcaaaaaggattaacatacttttttacaggaagccatgaaaatattttactcttcttccgttctcccactgtaacaagagattttggtctgaccctatgttatttttcaaaaaactacttatagtttaactgaacctgtgaaaaagtgctttacacccatgaaagatttttcataagaacccaactstagttaagactacatgagcaggaccacacccagcagggtaaagcaggcataaatgtatgtcctgaataccttcaggagttcaatctaaacattgctcactacataaaacagattttaatttaactgcctcagtcccttctatttcataggaggtggacactaatgagctaatctattgacacccctctttctgaaagccccagggaggtgaacaatcactttattgcaccaactagataggaaggctgtgtatggaaaatgattctactgcacttttacatttcaagcaccccagacagt

SEQ ID NO: 125422 - DNA, 601 bp, Human
cctcaaaaatttaaaaaataaagtaaaataaagcaaaatactgcaggctgtcttatctcttaaggatgtgggagaagggaggaaatgtgaatgaaattttatagtgggaaaaagtcatcatgcaattcctaagtgattggtttgcataaaagcactctttccccaaaatatcagaaagacattaagagaagctatatttgcccacactgttacattatactataaatgatccttaatcctgggacttaaaattaaaagtgaatcgaaaccctgtgaggttattttgccactacagtcaaamggtttctaacagtttcaatgagaattgctcacatatactaagaggcagtaaaccagcatctttcaattgaaataattggaccgataaataggattgtttggagtaatgctcgcataggatgtcagctttgtccctgaacgaaatcaagtgaacattttttaatatgtaaattgtaaacccagcacgatttgaaattagtgctgctatgaggcctccaatatagttaatgggccatttaccacttattgaaacttgcccaaataccaaacagagccatgatattggcacaaaagccaaagt

SEQ ID NO: 125423 - DNA, 601 bp, Human
gtggcttaattgaaattgaggcaattccaatctaatctttccaaattcatttcaacatgtagttttcttgcacaaatataagcatttttaattaagagcctgattttaaaacagtattaactagttatcttggcatctattctgaagaactaatgtaaaccacacctcaaaaatttaaaaaataaagtaaaataaagcaaaatactgcaggctgtcttatctcttaaggatgtgggagaagggaggaaatgtgaatgaaattttatagtgggaaaaagtcatcatgcaattcctaagtgaytggtttgcataaaagcactctttccccaaaatatcagaaagacattaagagaagctatatttgcccacactgttacattatactataaatgatccttaatcctgggacttaaaattaaaagtgaatcgaaaccctgtgaggttattttgccactacagtcaaacggtttctaacagtttcaatgagaattgctcacatatactaagaggcagtaaaccagcatctttcaattgaaataattggaccgataaataggattgtttggagtaatgctcgcataggatgtcagctttgtccctg

SEQ ID NO: 125424 - DNA, 601 bp, Human
acatagaaaaggcaaagaacttgaggcaaagaaaaaaagcaaagtaaagggaaagagggttacaaggaaagagaaaaaactgtcttttaaaacacatattgcctaagaaaaataaaagggcacattagcagataaacatataggaagaaatctctactgccaggagatgtttacaaaagaaggcagtgttggacatattgagactggtcagactgaacaagaatcagtgctgtcatgataaaaaaacatgaggcaaaatccagaatagcttttgaaatatccaacaacctgtaacccctcygtgacttcatttccttgtcaaagaagtgggaatttattctacaagctgcaagctgtttctctacgtaagctaagttttctcagggaatacttaaagggatgaaggaaaataaacctttggaaatctgtatttaaaaatcttaaataattcaagatatgggttttattataattagcaaatctatttgaatttgaaaagggaagtttcagatttcctaattaaacataactgttctggtttgtagaatattagctgtgggtcactcttttcacagcaaaaattcttctggggttaaccctt

SEQ ID NO: 125425 - DNA, 601 bp, Human
atggacaatatcttatctctaccattggtaagaaaaaaacagatgctatattttagggagtggaaaggaactaactgtaaggtaacttgggaatgagctatgaatactttgtctaactggtagaatctaataggacactcctgtcaaccttggcagctaaaaattaccaacaaggtgactgatctacaacatcaaaataaaatccccaaacacttcgatatggtgtttctccttgactctgctttttaatgagaaaaaagaaaacctatccagtcaatgaaaacaacaatgtaaatatatsaacttttgcaaacagaccagcccaaggaattctcgtctgagcacataagcctgttgaaaatgcaagtaatagggtatctataaactccaaacaccagataaagaacagaattggggaaaatggcctcaaactgttcaggctactctacaaatcacttattaagcagtattaaatctagtttcctaaaaccaatcctatgcaaaagagtcacaaaccacagccccaaattttccaaaatcattttccactaactacctatctttggacagccaagactgtggtggaatctaaaaatcaacg

SEQ ID NO: 125426 - DNA, 601 bp, Human
tttataacaagaaggacaatcatataccatgtcctttccttgttaaggaacggaacataagatctcatcacgcttggtattatatcagtgaaaatgtttatacactgacaatgtgaacattaccatttattttatcatatataagcaaaatgattatattaacataaggaaaacacattttaagattttttcccctctcccaaacacatattgtatctcactgttgaaatgctaacttaaatacactcagggtactaaaagataaaagttaacatgacactggctatcccagatacatatmcttttagaagattttccaaagatcctgtccagatcagagtacattaaagtccagttaaaatatatactgcccccaaaatagtttatgatttaaaaagaaaattttaaactaagtttcatattgctgatgtaataacagagagaaaatctagatatgtaaaattgcagcagtgaattatttacaagcagtaatcttattattttctcctatcttgagacacgatccgttaaatataaatcatctacataaaactgcttacctgttattttgtctcttacaagcttacaggactctatttca

SEQ ID NO: 125427 - DNA, 601 bp, Human
aggagattttcacctaatattcaaaatgtactataattaaggctttatctttataacaagaaggacaatcatataccatgtcctttccttgttaaggaacggaacataagatctcatcacgcttggtattatatcagtgaaaatgtttatacactgacaatgtgaacattaccatttattttatcatatataagcaaaatgattatattaacataaggaaaacacattttaagattttttcccctctcccaaacacatattgtatctcactgttgaaatgctaacttaaatacactcaggrtactaaaagataaaagttaacatgacactggctatcccagatacatatacttttagaagattttccaaagatcctgtccagatcagagtacattaaagtccagttaaaatatatactgcccccaaaatagtttatgatttaaaaagaaaattttaaactaagtttcatattgctgatgtaataacagagagaaaatctagatatgtaaaattgcagcagtgaattatttacaagcagtaatcttattattttctcctatcttgagacacgatccgttaaatataaatcatctacataaaa

SEQ ID NO: 125428 - DNA, 601 bp, Human
tgttaccccctttttctctgccttttaccttattttgccaatggaaaccagaagtctagggctgacttatccaatgtcacatgactaggtgagagttcagactcctggtctcattcttcacactgcctttaagtatcttttactcatttcaaatattccattttatatttttggttataagctttgtaaagcaatttggtatacactatcaatcaaatttaattaacatgaaaagtccacagagtctgtctaccttcgtatatttttagtgtttaacttcatatgtatgtctaacttcatrtatttttagtgtttgaaaacaactcctgcaggaagcattaacccttctatcccaagaacgtgctctttaaattaggttttggtttactctaaaaatttagtcaaatcttaaaaaatactaaggagattttcacctaatattcaaaatgtactataattaaggctttatctttataacaagaaggacaatcatataccatgtcctttccttgttaaggaacggaacataagatctcatcacgcttggtattatatcagtgaaaatgtttatacactgacaatgtgaacattaccatttatt

SEQ ID NO: 125429 - DNA, 601 bp, Human
aaaaggttgcaaaatccacatgtcaggggtgttgttttactttaaaaacaaaagataacatgtttaaaacatgttaaaaagatgtttaaaaacatcacgacagagacgtaagagcagccttttgttcttcacctttttcaacttattaaaaacactataaatttcacatatgcttatcacactcattttggaaaagaaattgaaaaatctcatccatctgattatcagtgttcagaaacataagaaccaccttcctaatatcatagtgaacatttaagcaacataattaaaatataatggycgtttgctatggatcaatgacaatcagtttgtacttagctttttaacttgatttcagtaagttgtctctgtgaatctcaatctgtagcttgaggaaatatgattatgagccaagtccaggggctggctctagaactcacttgcagatcttggagagaatgagccctaacgattaacggaatagctcaaagtcccatgtatgaaaaagtcaaaagtgaacttagaaatggcccagtgttaccccctttttctctgccttttaccttattttgccaatggaaaccagaagtctagggctgac

SEQ ID NO: 125430 - DNA, 601 bp, Human
aactataattcaaacaggttttctttactgctggatttttcatagttcttaatacagtgattatcgagtatggatcttaaataaagaactacagagtgcagcacttcctaaacttgtctgtcaatataatacttatgttaagaaataattactagtatctcaccaaatgaaggttgaaaaacatctttcaatcttatacacactatcgtgggaaggcaaattaatacaccaaatacactatgaaaaatggtatgaaagttcctcaaaaaattaaaaacagaactaccgtatgatccagcawccccactactgcatgttaacccaaaagaaatgaaatcaatttgtcaaaagggatgcacgcatatccatatttattgcagcaatgtttacaacagccaaaatatggactcaacccaaatgtccatcaaccaataaatggataaagaaaatatgctatatatacaaaatgaaataccattcagccacaaaaaagaatgaaattctgtcatttccagaaacatgggtcaacttagaggacactatgttaagtgaggtgagacagccaaataccacacgatctcataggtagaatcgaaaaatg

SEQ ID NO: 125431 - DNA, 601 bp, Human
ctggtctgataaccagttaacaacaaatgatttcaaaagcttttatagcaccatgttcagtgtaatctactgtcagggagagatactcactcttcccacagtccccaaataggctctatgatcaaataaggccggggaactataattcaaacaggttttctttactgctggatttttcatagttcttaatacagtgattatcgagtatggatcttaaataaagaactacagagtgcagcacttcctaaacttgtctgtcaatataatacttatgttaagaaataattactagtatctcacsaaatgaaggttgaaaaacatctttcaatcttatacacactatcgtgggaaggcaaattaatacaccaaatacactatgaaaaatggtatgaaagttcctcaaaaaattaaaaacagaactaccgtatgatccagcatccccactactgcatgttaacccaaaagaaatgaaatcaatttgtcaaaagggatgcacgcatatccatatttattgcagcaatgtttacaacagccaaaatatggactcaacccaaatgtccatcaaccaataaatggataaagaaaatatgctatatataca

SEQ ID NO: 125432 - DNA, 601 bp, Human
taccagccatggataatgtggacaaagggatgattcacatcctgggcaggaaggtgcaaaatttaatcacgatactctgaatggtgagcaactcaaaacttatggattgtttatttctgggattttccatttaatattttaacaccatggttgaccaccagttaactaaactgcagaaagcgaaactgttgataatgggaggactacggtatttcatggcacaggctctcttcaacagatagtcaccacttgaaatcaagaacttaacactggctgatattctccagcacacccaaagctsagacaaagactactgaacaactggttaagcttgagtcatctttaatcaagacaagaccttacagctccagaggtagaagaccttcctcatctcaatcagaggcttttggaaactccctacaaacatgagtgcaaagtaggcagtggggataagtctacacaaagcttgcattaagacttacccatgaagtattcacctttttcattattttaaactcttacaacccaggggaggctttctgttaagccccaacacaggaaattgcttttcagttgtcaatagccaacgtctgaaaataaa

SEQ ID NO: 125433 - DNA, 601 bp, Human
tatttctaatgaaggaataaaatagttatatattataaactaatctcctttattcagggaaaaactttaaatatgtatgctgccagatcacttactagcccctgtacccaaacagaatataacctattaagtgcttattctagttatcctaattgacaacaacattattaaggattctacttagattataaactttatttttctcaagcaagagtactttctagcaagaaaacatatatatactgaaatggatcttaacacaaaagcctactatactattttgggcttctttatccttctygcgcaccccccacgaaaaaaaataaaaataaaaataataattaaatctaatagtaaaggaattagaacttttacctcattattccctacaaagctaatttgttccttcatttgcactctctgtcattgtaatctatgacttaaagaaaatgaagcaaaaaaattcttttaaaaataaacaaaccaaaaaaacaggctgggcacagtggctcccaaataccagcacttcgggagtctgaggctagaggatcacttaagctcaggagctcaagactagcctaggcaacaatagggagaacct

SEQ ID NO: 125434 - DNA, 601 bp, Human
ttaattcatcttaaaaacttttaatgtgatgctttctttaatctgctgttactgaagttactcgatttgcttattcacatatctgagacccactcttggggaaggcgctatgtttttatggcaccagattaaacaatatgaaggaccatctgatgtgggaagtaacttctatacacagagcttctcagctatttgggccacattacatgcccacttggcaaacacattttaagattaaggctaagacaagtggatcagaagaatccatcttattaccacaaaggggtccctaaggaaaagkaggttaggagtttaaggcctccagctaactagccttatgaatttgagattgggatctcatctgtgggaaaagaaactgcactaaaggtactctctgatgctcgcccccacctattattctaccgtctccaccttaagtttcacaaatagattctgatgtgcgtgttagaatcactcttgttaaaagaggttcctacaatgtagaatgccatacaaaatgttaggtattcaattacaagtacaccactcgaagaaatgaatgttttactaaataactagtttttcagctcattccaatatt

SEQ ID NO: 125435 - DNA, 601 bp, Human
tgtgtactgatcataaagtatctgctatagaccgatatgtacaacccttccaccggggggaaaatgtccactgtaattccttttatatcaaaaagaaagagcagaattaaattagaggtatttttagcaaagacaaaggaagtaaatttccaaaggacatccatcgtccccagtcgacacaaggattaagtataaataacgtgatttttcttctctttgtacaggacatgttgcttagtttatagttaatgaagaggtagttaatcaagagggtaggaggaacatttttctttctttcctmtaaacttaaaatagtcacacacagcactgatttttacatgcttaggaaaaattccaaaacagactgatggtgtttgggctggtgggggtataaatgctgagtataaaggaaacctatttaaatactacagacacagcttcacaaacctcaagaacactctctctgaagcaataaagaaaaggaatcctaatggaacacagtccccagaggaaattgagctgtacatggttaaagttgtaaaggctatgggtcagatgggaaccatggctacgaattaagtcaaagaggtaccctgacaga

SEQ ID NO: 125436 - DNA, 601 bp, Human
gccctctaagatgctcaaaaattttaagcccaacacagtaaacaagggagagaggcaggcacctaatgaacatgaaatacataaagtgcatcgcaggggtttcaggcttaaccaggaccagcttgaaaaagagaactctttagtgtgtcaaaacagagaagatgaaattcaggtgtttcctgacaaacaaattaaggtaataggaacatggagaagaacaaatttgtaaagaagtataaaagagacaagccaaaagcatactacgctgaacgtaaggcatctatgtagaggtaagcaaacygaccccccatcctggaagcaagactggcccatgtgaaggtttacagcagacaaactgcaggatgcaccaagcactgaggcacaatgaggaaggaggcacacgagggacccagggacagtcaccttagtggcctggtataatcactgagcagatgcagatgtaagactgtaactagggacctcagtgttagaaatcacccacattctttttccttcttccctcccctctcaactctttattccttccctctctagacactcccccttaggcaatccatgcttatctacttaggctcttaag

SEQ ID NO: 125437 - DNA, 601 bp, Human
acttgtggagacaagatgctcaaatgttatagtaattctgccttcataaggaagtcatacgagttttaaatagttcatgtaaaattgttcatacgaaaaatttctacaaataccattaagatgaagtctcaattttaaaaagtgtcatctagagtaatttgatagatttacataaatctgttccacaaatcggtaagtatgaattatgggatgtcagcatataattttgttgaaagtactttttcactaatataattaagtctgctgagactattcatgtacaagtcaaataaaatgcagrgtgaattctgtaaaaacctggtagttgaatcaacaataaaaggtgactacactgattgatgtgtatctattattccatttacagcagtagtaatgttttatgaaataaaagaataaaagccgtgtgaatctttttcaaatcccacagttagcagaaacaggtcactatggtcctctctgtcaaggaagacttgcaacctgaggtttaataatgcaatacttttaaaaagcaaaatggaaagattcgcttcctccaaacacagctcttgcataaaactgcatgccttaacgacaaaaaaaa

SEQ ID NO: 125438 - DNA, 601 bp, Human
atgtctggaacacagctctccaactagccaactcccatgtatcctttgagactctctgaagtcatttcctgccacaacttgccccatccccagtgcacactgtacagtgctcctctcgactagtcctcccacagcttcttatattattccgttatctttgttatgtgtgtctggggtccatttggatgctccctcactagactgctgagcaagggcaagcagaacatagttcctgacaaggaggaccctaagacagatcattaaatgttctgtgaatgactgaatgaaaaacaaatgaagragcagcagcatctgccttccaggagcctgtggtttaggagatagttgcccttataaacatgttcctcatgtccctacattgtaccagatggattacagaacttgtggagacaagatgctcaaatgttatagtaattctgccttcataaggaagtcatacgagttttaaatagttcatgtaaaattgttcatacgaaaaatttctacaaataccattaagatgaagtctcaattttaaaaagtgtcatctagagtaatttgatagatttacataaatctgttccacaaatcggtaagtatg

SEQ ID NO: 125439 - DNA, 601 bp, Human
gaaaagcctgtcttgcttacttcctacttagctgtttcccactctagcctctgaacccttactcctggcctgctgtaggcatggaaacatttgctaaatgaaagaatgagaaacttactgatgttatttatttaaccaaaggtattatcatcatcaccaccaccaccatcagaagacccaaccatcaaatgggtcttccacctgataccctcaagcaatcatgactagctatatgagtcagtcaaatatctagtatctgttaagttgtttatactcagaaatatttatccccaaatgactytgcctccttataaaaagtttcttatttgcctagtggcattattaggatgagtgccactcagaatatgtttgaggtaagcaaaactgtattattatcctaagcaaaataatatgaaagggggtatctgctattaaaagactgcattcctaaacctaccatcgttggtgtattaaaatgttggcactataacaaaagggagttagaactttaaattactttacagtgaaaatctgtaatcaaggcagcaaatatttattggatgtttaaaatatattaagggtatcgcagatgataccaaga

SEQ ID NO: 125440 - DNA, 601 bp, Human
ttaacttggaaaaaataaaaagaatatttgtaatacataaacatcttatcaatctcaagtttcattgcccataaataaagttttattggataacggctgcatccatttgtttatgtagtggctattactgctttcatactataaaggcagagttgagaagttgtgacagaatgcatggctcgcaaaaccttgcttattcactacccagacctttatagaagaacaagtctaaggtttcctcaagttatagggcaagtaattctctataagggaaggagacttgattccgtaggcttcctawaacatttatctaagagagttgttgctctgtccccctttgcgaatacatgaatgattatacatagcactcttgaacaaacagtttcttccatcttgcaacaaacaccaaaattccactatgtctcccaggtaactgtttatatgggcccaaaaggaagaaaggaaagaactacaaataaatcttaatttttttaaacttctgttccgcaagtagatataaaaaaactttaaacatacttttattgttttggtttgaagtctcaatccattcagggtgttgatagctttctctgcatccttg

SEQ ID NO: 125441 - DNA, 601 bp, Human
catgtaagttcctccagtcagtctcctcaaagcaagctgaattagctagagcaaactacaactcaagcaccacatctagcctgccacctttttgtataacccatgagctaagaatggtttttacattttttaacttggaaaaaataaaaagaatatttgtaatacataaacatcttatcaatctcaagtttcattgcccataaataaagttttattggataacggctgcatccatttgtttatgtagtggctattactgctttcatactataaaggcagagttgagaagttgtgacagaaygcatggctcgcaaaaccttgcttattcactacccagacctttatagaagaacaagtctaaggtttcctcaagttatagggcaagtaattctctataagggaaggagacttgattccgtaggcttcctataacatttatctaagagagttgttgctctgtccccctttgcgaatacatgaatgattatacatagcactcttgaacaaacagtttcttccatcttgcaacaaacaccaaaattccactatgtctcccaggtaactgtttatatgggcccaaaaggaagaaaggaaagaacta

SEQ ID NO: 125442 - DNA, 601 bp, Human
agccttttggcaagagtatgcactgctttcacatagctttggggcaacatttggtttacaggtcaaaagggtttctaaattaagtttgcatatagcaaaaaattttttcctttaaaaaattatagcataaaatgtgtggaagctcttataatagagcaaattcccatttattgaggccctggctagaaagctcaaatatcaagacactgggtagggaaggaagaggggtttggttggcaggctataaaaataagacaaatttttattaaattttaaaagccacttttttttttttttttttgagatgggagttttgctcttgttgctcaggttggagtataatggtgtgatctcagcttactgcaacttccgcctcccgggttcaagggattctcctgcctcagcctccccagtagctgggtttacaggcacctgctaccaaacccagctaattttttgtattttaagtagagacgtggtttcactacattgtccacgctgatctcaaactccggacctcaggtgatccacccgcctcagcctcccaaagtgctgggattacaggcgtgagccaccgcgcctggctcaaaagccactttca

SEQ ID NO: 125443 - DNA, 601 bp, Human
ctatccaagatttagtgttttgggccctgatttgacacaattatcagggatctaatgtatgtatacaggtatacatacacaaagaagttaggaagccagctcactttctttcaagggcagcctgtctttggtaatcctcaatcagtagaaactgtaccagttttttaaaaatttaaaaagcagtaacagcaaacactgcagattgcttatggcatttaacaggcagagatggaaatttgtgtaaggcacgtatgataaaggagaaagcaaggaaaaagaataacagaaatgttattaaaakccctccccacagagccaaaggaagttttacctacacatattttgtggggctgacataagttatgcaactatgaaaaatttattcaatacataaggggataacccctgaaacattagtgagtgttgttttatgactttaagtctaccaagatatttctctcacaacatgattagacattagagaataaccatagggaaagctttttttaaatgaactgatttgcaagactaatagtctcattcaaagacaatccttcattctccaagtatctattagacacctgagctgtatattccccct

SEQ ID NO: 125444 - DNA, 601 bp, Human
ctgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatggaaggagaatacagagacagtttcccatcataacgcaggtgaggagaacagtcaaaatcagtgtggtagtaaagttaaatgtaaatgccatctacagttaagtttccctttgtactataactagaaraaaaactgctttgcaacaatgttcagaaacccaagtcttctttgacctacttcatatagtaatgaaaatataatgatcctttcctctgtgtgtacactaaatactgcttagagaaacttcatcttgataccatttgtaaatacttaaatgagtcccatgggtctccacggatctttgcagagcaaggcaaatatgtttctacgagcaaattacttgatccacccaaaattcattcctattgtttctcttataaattaggtcctcactaaagggggataaatgtaaagtacagggctaggt

SEQ ID NO: 125445 - DNA, 601 bp, Human
tagtgacacctaccaacaagttttgaaaaacacacccaaagttaaaaatggcattaaaacaaaaacaaaacaaaacgaaaaacctccaagaatctcaacttttaatttcacttaaactgtgacttttttcgtctttgagcacacagagcaggtcttcactgtctcttataagcaatagacagaagcttcctcatgcagaggttataaataaaaacattctgcaagctgctctccaaagacaaaaatcccgttgccctcagagagcagaccaccaaatagatgagaaaggaaatgtatagtkaagaaatttttatccactttattaatttattttatggccaaataaaactttatcaatgacagggttagagggccatgtaggcagagaataatccaaggcaatggagaattaggcttccatactgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatggaagg

SEQ ID NO: 125446 - DNA, 601 bp, Human
tgtatagtgacacctaccaacaagttttgaaaaacacacccaaagttaaaaatggcattaaaacaaaaacaaaacaaaacgaaaaacctccaagaatctcaacttttaatttcacttaaactgtgacttttttcgtctttgagcacacagagcaggtcttcactgtctcttataagcaatagacagaagcttcctcatgcagaggttataaataaaaacattctgcaagctgctctccaaagacaaaaatcccgttgccctcagagagcagaccaccaaatagatgagaaaggaaatgtayagttaagaaatttttatccactttattaatttattttatggccaaataaaactttatcaatgacagggttagagggccatgtaggcagagaataatccaaggcaatggagaattaggcttccatactgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatgg

SEQ ID NO: 125447 - DNA, 601 bp, Human
caacagattaaaatgctgagttagaatgttaaactaaagaaggactacacactggctggcataaataaactgcaggtgtcttagaataaaaaacaaccagtaccggttggtaatgtgaaaaaagaaaaaaggttctcatcaagccaattttggtgaattaaacatcctaggactttcatacacttcttcatccatgatctgacagagagaagtacatgaaaaggagaagtggataagacaagagacgggtaggtggacattatgtagaaaatctcacataacgggatacctttacttaaawctttgtttttcaccacatgttctcactcataggtgggaagtgaacaatgagaacacttggacacagggtggggaacatcacacaccggggcctgttgtcgggttgggggaggggggagggatagcattaggagatatacctaatgtaaatgatgagttaatgggtgcagcacaccaacatggcacatgtatacatatataacaaacctgcacgttgtgcacatgtaccctagaacttaaagtataattttaaaaatatgtatatataaaaaaactttgtttttgtatgaaacaaaaaagc

SEQ ID NO: 125448 - DNA, 601 bp, Human
taaccatggcaactttatctccaaaaatgtacttaagatataatttgtgtagtatctgaatgtctagtatgcctaagacactgtcaacagattaaaatgctgagttagaatgttaaactaaagaaggactacacactggctggcataaataaactgcaggtgtcttagaataaaaaacaaccagtaccggttggtaatgtgaaaaaagaaaaaaggttctcatcaagccaattttggtgaattaaacatcctaggactttcatacacttcttcatccatgatctgacagagagaagtacaygaaaaggagaagtggataagacaagagacgggtaggtggacattatgtagaaaatctcacataacgggatacctttacttaaatctttgtttttcaccacatgttctcactcataggtgggaagtgaacaatgagaacacttggacacagggtggggaacatcacacaccggggcctgttgtcgggttgggggaggggggagggatagcattaggagatatacctaatgtaaatgatgagttaatgggtgcagcacaccaacatggcacatgtatacatatataacaaacctgcacgttg

SEQ ID NO: 125449 - DNA, 601 bp, Human
cttaaacagcctctgacaaactacactgcactgagtgtggtttattaaatgctacccaaacagttgcatccatgtgtatcaaagagggtctaaataggctgccctgacaggcatctcgtttttagtaaagtacaactggtacataacttctgcccttttattgttgtttctccttggttctagtatgaagttggttcaacaaggacatctcatactggtaaaggcaaatgggatacatggtaaagatattcttgaaatgcaacttaggccataaataccttaccatttcttaaattttttrcctgcagagatacttaacagaaaataaaacaattgagcaatggtagtggatatggcatctgaggtggaggcagtgaaatcaaattcactatggtagtggcagtaggctagccattccaagtctaagcaggaacttgtcaatcaaaatgttccatgttccatttccaatcctgtatatttcacttagccttttcagactttagaaggtgattacactaaagtagtataaaaaatagatgggagttttagcgtaaccaccaaagagtctattcctaccggtagctctctgcattagaaaatt

SEQ ID NO: 125450 - DNA, 601 bp, Human
gagttgggtgcctcttacctgcacccacactgcattatatgccttgttttcttaaatactgacttaaccaaaatgtacttatctcttaaccctttcttgtgactgacttaaccccttgaaataagaaaccttgtcatcatcctactttgtacatcctggtaactaccacacactcactgtaatgaagatgatttataatcacatattaaattgagagtttatttctgaaatactgtttaaaagctaacagaagccacaatctttgtcatatacccaacattatacgcattggtactttgtstacagactacaatgaaaattctattaatcatttcaaaaatgaaatttcatttctcaaattggggattcaagtccccagaggcgacacaatcttcaacaaagtaatatggtgctgataggaggctgtggggcggggggagtcttaattttggagcaaaaagaaaatacagtgatcatttagtccaatttctttgtatctgggaaataggaagactgaggcacagaaaggtgaagcaacttttccaaagacacaaagaaaaagagttgggtgtaggactcgcggtcttagctcttcatcacg

SEQ ID NO: 125451 - DNA, 601 bp, Human
tgtgacattataaatattatttacctctacatgcatctgaaaatttaggtaaatgcccagccccttaaagtagagagaaacctgggtccattacagtgttctagaacaatttactcatgcagtgacattcactgctttgtgcaattcagatgagtgtaggtggtgtgtcttaaaagtcatcctaaaatatatttaggaaaatgggtttatatttaatgcttatataaaggctttgaaaacatacctaggtcagttatgtgattttttttttccccaatgtccactcttcagtttatattgkatctttagttcccagccacattaaaaaggctccaagacaaaccttctcaaaaacagtatctttcagtgacattgtcaaagaaccattttccactaccacaggcaggacaggagtgattagattatatataaacttacgtcggtaacaatgtttaatgttaaacttacatttagggcattatgagacttcaccatttacaaggcattttcacaaactacaatattttgtctgtgcctcacaacaaccccatgaggtaggcagcatacatattagtattttatagctggggaaacaggcaca

SEQ ID NO: 125452 - DNA, 601 bp, Human
gattaatgtaacttagatggaatcaaatcttgggattgctataaactgatgaaacaaggccaatgaattatatatgcattcagtaatatgaatcaatgaaaacttaatttcttttctcgtgtaagattctcaattatccagaaaaggtgaaacctcaccagctgggacgtgcatccctatctaggattctatggcttttttttccacaggagggagcacccaacaagtcagctgttactctgttccagatcatgtgactgaagtactcccattatgaacagccatgtcccatgggctccarggcaggcatctacacattctccaaggaggctaacttccaatgactgatcaagcaaccagcagcaggtgacaggctctgcatgagatcaagtgtcacaggaggcagtggaaatgtggttaaaggtaacagctaatcggtgtgcctgggctcaaaactaggtttaattcataaccagttctgtgaacttagaactaagttcttcaagcctattaccacaattctaccttctttatatggctattaggaataattaaataatttctaatccacatgaaaagcttcagagcctaatctatgtga

SEQ ID NO: 125453 - DNA, 601 bp, Human
tttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtcaatgtgtctgggattgatttgctgaggtaaagtgataactactgcctgctcattttattattggtacccacctttaatccagttaacaacamactttcccaatttacactaatacttaaataacttttagtatgaagcaccaaacattttccccataatttgaattgtgcccacagctctctgttgccactttttcttggctttccagaaaaaaatataagccacattttatactactttataaagacctcgttatctttcacacccctgccccaatggtgttaacatttaatactcttctttattcaaaccgtttgctcattaacaagtgaaaatatacctgttgttccaaaggctatgtttggaagttatattagcactgtcctgttcta

SEQ ID NO: 125454 - DNA, 601 bp, Human
gtatgtactttcaaaaagtttcatgtctttgagatacggtataccaaatcccacaaggacgaaagacaaaataggtctgcatgtatttgtttataatcatcattcctcatgtaaactctgtgagggaagaaaccacatcattcttggtcatcactgtatcctcaatgcctagtgagtgcctgacatgtgatagatgctaacacatttggtgagtaaagcccatccaataataccccattgatcatgcagatccacaacggcttactgaaccagagcatttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtcaatgtgtctgggattgatttgctgaggtaaagtgataactactgcctgctcattttattattggtacccacctttaatccagttaacaacaaactttcccaatttacactaatac

SEQ ID NO: 125455 - DNA, 601 bp, Human
tgaatgtgtgaacaagccctcattatcctttgtctgttgtcttctcatccacaggtctttttaaccttgattttcaaaaggtcttaagtccctataattaactttgcctgccactgtatgtactttcaaaaagtttcatgtctttgagatacggtataccaaatcccacaaggacgaaagacaaaataggtctgcatgtatttgtttataatcatcattcctcatgtaaactctgtgagggaagaaaccacatcattcttggtcatcactgtatcctcaatgcctagtgagtgcctgacaygtgatagatgctaacacatttggtgagtaaagcccatccaataataccccattgatcatgcagatccacaacggcttactgaaccagagcatttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtc

SEQ ID NO: 125456 - DNA, 601 bp, Human
gacctccgcctctggggttcaagtgattctcctgcctcagcctcctgagtacctgggattacaggcatgcgccatcacacccagctaattttgtatttttagtagagatggggcttctctatgttggtcacgctggtcttgaactcccagcctcaggtgatccgccctccttggcctcccaaagtgcttggattataggcatgagccactgtgcctggccaagtattgcttttataatagaaaattgtatctgtattttatttttaaaattcataatcaaatctatattgctatagctttkttaactaagatttggcagaacaactcccttacattcaagagttttaatgaacattttagtcttcccatttcagttgggctaacagtgatattaggaataaaataaatttttaacattcaaaatttcaaactcttacatatgcccatacagcacagcatgaacctggaaaacagcctgaacagcaattaccagtgtggatgtagtgtaatcctcccttggagaactagctgcataccgctgcattaaacttcgctttttgacaaaagaaaggttgtttattagtactctataagcaggatg

SEQ ID NO: 125457 - DNA, 601 bp, Human
attatatggagaaaaagaaaagacgtagattttaaaaataaataaatttctagaagtaaagcatcaaagctttctgacctcagcagcatcactcctgactacagaagatcactccctgccccacattctccccagtgtgaaagacacaaatgggaaaggatagccaagaacctttccaggttatgaaaaattgtagagggaaacccagcttattccatttaattagcgtgaacaggctagtggggtgaccacagctggtcatcatgagataagcagtggcagggaaattttttttggcaastaaatgagcactggaccatcatacttggaggagcttaaaaaaaaaaaaagaaagaaggtctacttgctttaaaattaatactgtgtaaggtcaatgactaagaattttctaatgtagacaaagcattttttccacatatgcgtatctaagacagcccctatcactttaccttttctatttaaagagcatgcattgcacattattaccacctgatggctgaataagaaaattgcagggtttcatttttcatttcaggtaaattgagtaagttcactttgaaagccttaagtatgaagaata

SEQ ID NO: 125458 - DNA, 601 bp, Human
aaaatgctacaaagctatgctaaaaatacatacactgtggtagaaagacatttcggttgaaattttaaataatatattcagcttaataatattgcataggatataggtcctttaggaaaaaaatgcctgaaaatgctcttccagttctctgaagctctcttgtgcttctgactagctatattttattacagaaaaatattatatggagaaaaagaaaagacgtagattttaaaaataaataaatttctagaagtaaagcatcaaagctttctgacctcagcagcatcactcctgactacakaagatcactccctgccccacattctccccagtgtgaaagacacaaatgggaaaggatagccaagaacctttccaggttatgaaaaattgtagagggaaacccagcttattccatttaattagcgtgaacaggctagtggggtgaccacagctggtcatcatgagataagcagtggcagggaaattttttttggcaagtaaatgagcactggaccatcatacttggaggagcttaaaaaaaaaaaaagaaagaaggtctacttgctttaaaattaatactgtgtaaggtcaatgactaaga

SEQ ID NO: 125459 - DNA, 601 bp, Human
caatgaggttaccaaaattatggtcaacttagtccagaatgaaaactagtaagaggattggttggatgaccttgtctgcacataagtaaaaagatgtggggttttattttttgcagaggtgagtacagtcaaagatgccatgcctttatagtcaagaataaggatcacaactaccagcaataaagacaaacacatattagcaccaccaatcataaagtaacaatacaattttatcaaattgctggaatgatcaacacagaatgcatttggcatatgctacctgtagaagagaaccgcataytgaggtctccaaccaaagtgctagaagacccagaatgcagaggcaccttatcaattcactcaaaagttacatcatctatgcccattaattgcatccatgtagggacaggtcatgctttgctaccacccactcaggacaccaagcatacgcccagagacagatgagttttcagaattttcaaacagggtagaaaccaaatctgcccctgaagtgaattaccgtcaggccttttttaacaatggggatatgttctgaaaatgtgtcactaggtgatctcgttgttgtacgatcatagaatgc

SEQ ID NO: 125460 - DNA, 601 bp, Human
tctcattgcaccactgagcacaagccagggtcactgatagtttataataaatatgtgatgaccaaataaagacaatgaggttaccaaaattatggtcaacttagtccagaatgaaaactagtaagaggattggttggatgaccttgtctgcacataagtaaaaagatgtggggttttattttttgcagaggtgagtacagtcaaagatgccatgcctttatagtcaagaataaggatcacaactaccagcaataaagacaaacacatattagcaccaccaatcataaagtaacaatacaaytttatcaaattgctggaatgatcaacacagaatgcatttggcatatgctacctgtagaagagaaccgcatactgaggtctccaaccaaagtgctagaagacccagaatgcagaggcaccttatcaattcactcaaaagttacatcatctatgcccattaattgcatccatgtagggacaggtcatgctttgctaccacccactcaggacaccaagcatacgcccagagacagatgagttttcagaattttcaaacagggtagaaaccaaatctgcccctgaagtgaattaccgtcaggcc

SEQ ID NO: 125461 - DNA, 601 bp, Human
ggtaggaaacaaaacaagccaatctgagcctcacttaaaatgtttatagaaagtaaataggggtgggggtggaggtgtaagtactctttaaaaccttctacatttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaactgctacaatgctcaacactctccaaagacatcccagggttktccctctgggactgggggtgggggtgagaattttttctttaacacccgtgaaaggtaagtttgaaaagtctcagccttatcacctaacctgtggcatcaagtcacgctaaagtatacatgcaaaagccaacaccttttagttttgtaaaagccaaaacacatctcatctggtctttcagaatggggaaatatatagcctcccacatccctgccctcagtctccactgaaaattctgttttgtaaagatgagaagaactgagcttatgcaaagtgtaaggaaacagaacagatcacaatga

SEQ ID NO: 125462 - DNA, 601 bp, Human
ttacaggtagaaaaaaccttatggacaacccaagctaaccctcccatttctcaaatgtgctcagctgaggtctagagaaggaaaaaagaaaaatccatcactccagtgtgcaacaaagccaagagttcagatcctgatctggatgctgtattcaaattacgctacaggaagtgtcgtcctactcagttttcaaaggccaggtaggaaacaaaacaagccaatctgagcctcacttaaaatgtttatagaaagtaaataggggtgggggtggaggtgtaagtactctttaaaaccttctacmtttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaactgctacaatgctcaacactctccaaagacatcccagggttgtccctctgggactgggggtgggggtgagaattttttctttaacacccgtgaaaggtaagtttgaaaagtctcagccttatcacctaacctgtggcatcaag

SEQ ID NO: 125463 - DNA, 601 bp, Human
tttaagtggcttgctcaagaccacagggctagtaaattatggcattgatactcaaactctgcaggttacagaattctatacattttcctttcatttcccaactttgaagggctttcatcttttagaatcaaggaggtataattacaggtagaaaaaaccttatggacaacccaagctaaccctcccatttctcaaatgtgctcagctgaggtctagagaaggaaaaaagaaaaatccatcactccagtgtgcaacaaagccaagagttcagatcctgatctggatgctgtattcaaattaygctacaggaagtgtcgtcctactcagttttcaaaggccaggtaggaaacaaaacaagccaatctgagcctcacttaaaatgtttatagaaagtaaataggggtgggggtggaggtgtaagtactctttaaaaccttctacatttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaact

SEQ ID NO: 125464 - DNA, 601 bp, Human
tgggcaaggtccgcagggctgcgaaaccccagggtgtgagtgggagagaagcgattggttgagggatttcccctcaacgccttttcggggatgctgggaggggtgtttgctcctagcaggattcaggcacaaaaccagtcttctgagaaagacaatgagctttgtgaaaggaaaataaatctcaaggcccgcaagtcaataagctaaagggaaaagtcaagcggggaactgcttagggcctctgcctcccattctagtcaaagtcccccctttgctcactgagatagatgcgtatctgatygcctcctttggaaaggctcatcagaaactcaaaagaaggcaactgttcctctctcacctatctgtgacctggaagccccctccctgcttacagtcttcctgcctttgcttcaagttttccggcctttccagaccgaatcaatgcacttcttacattattgatggatgtctaacactgaattgctacatctccaataattttctgtctgtcgaagagaaaaagaccttagatatcatttgtgctttgtttagaacacagaaggaagggataaggtgtacgccgtgctcgtgaggttttttt

SEQ ID NO: 125465 - DNA, 601 bp, Human
caaaaacatgtttctttgccatatcttgaaatggccctgcaaagctgtcctttgtggggaaaaatttgcatctgtaaagatgtaaagaatctctattcacatagatattcacatctttttctaccggacccttccaatcctgaaaagattgactaagactctagcaccttttaaaagtctgaataggaaacaattgtcatctattgtctctaagggcagccgctacaagacttcaaaataaccttggtctccacaatcttttctcttaacctgaagatttcttttctagggatcccagggttttttttttttttttttaatctttcttttttatttttttgagacggagtcttgctctgttgcccaggctggagtgcaatggcgcgatcttggctcactgcaagctccgcctcccgggttcaagtgattctcctgcctcagcctcctaggatcccaggtctttagatgaactcaaccaattgtcaaccaggaaatgtttaaatctatgtataagctggaagccccctgactttgagttgttccacctttctggaccaaaccaatgtgtatcttaaatgtatttgattgacacctcatgcct

SEQ ID NO: 125466 - DNA, 601 bp, Human
ctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcrggcgcctgtagtcccagctactcgggaggctgaggcaggagaatggtgtgaacctgggaggcggagcttgcagtgagccgagatcgcgccactgcactccagcctgggcgacagagcgagactccgtctcaaaaaaaaaaaaaaaaaaaaaaaaaagaagagaaagaagggaaggaaggaagagaaagaaagaaagaaagaaaggagactactaatgagtgcatataattgtatcttaccaagaatggtgcagatgtaacatgttgtctctctctctacttcctgtaagacataaagatg

SEQ ID NO: 125467 - DNA, 601 bp, Human
cgcctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtrgcgggcgcctgtagtcccagctactcgggaggctgaggcaggagaatggtgtgaacctgggaggcggagcttgcagtgagccgagatcgcgccactgcactccagcctgggcgacagagcgagactccgtctcaaaaaaaaaaaaaaaaaaaaaaaaaagaagagaaagaagggaaggaaggaagagaaagaaagaaagaaagaaaggagactactaatgagtgcatataattgtatcttaccaagaatggtgcagatgtaacatgttgtctctctctctacttcctgtaagacataaag

SEQ ID NO: 125468 - DNA, 601 bp, Human
tagtaggggaaaccctgattttccctggaaaaccagacacctggccgatggtagcggttgatgcccacctgatttgcagagaatgaaatacaattccttctgaggctgcctggggcaacatcaaatcaagggagcctggagcacatctattaatcacgggtctcatgcttcattctccagatgcaggataaatcactatcagtgcattctgagaaagcaccatcaagagatccagaagcggtcaggcgtggtggctcatacccattatctgagcacgttgggaggccaaggtgggagcatygcctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggta

SEQ ID NO: 125469 - DNA, 601 bp, Human
gtgggatgcagtaaagatgtaatctgagtctccaaggtttgtagtaggggaaaccctgattttccctggaaaaccagacacctggccgatggtagcggttgatgcccacctgatttgcagagaatgaaatacaattccttctgaggctgcctggggcaacatcaaatcaagggagcctggagcacatctattaatcacgggtctcatgcttcattctccagatgcaggataaatcactatcagtgcattctgagaaagcaccatcaagagatccagaagcggtcaggcgtggtggctcatrcccattatctgagcacgttgggaggccaaggtgggagcatcgcctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaacc

SEQ ID NO: 125470 - DNA, 601 bp, Human
gccgtcctctgcaaggcggtcaatattcggagtcctatggagggacaaattaacagctttacttgttaaaattagacaggcttttcataagcatagctacatgctacttcatagaaggtctgctggtcatcgctgagtgcttcaagatgttctcaggaatgacccaaaggtaatgtcaaagatttctaatgtcttctgaactttcgaggaaacatcaactcatttaaataggaatgagtggctggacgcggtggctcatgcctgtaatcccagcactttggaaagccacagcgggaggatmgtttagggccaggagttcaagaccagccgggccaacatggcgagaccctgtctctacaaaaaaatctacaaaaatagaaaaattagccaggattggtggtgcatgtctgtagaaccagctacttgggagactgaggaaggaggattgcttgagctcaggagtttgaagctgcagtgagctgtgattgcaacactgcacttcaacctgggtgacagagagacaacctgtctctaaaataaataaatgaatgagtagatagagtgactaagtttccacaaggcactgttggtactgagagac

SEQ ID NO: 125471 - DNA, 601 bp, Human
cccatctctacaaaaaaaaaaaaaaaaaaaaagaaaaaaaagaaaaaattaaccgggcatggtggtgcaagcctgtagtaccaactgcttgggagactaaggtgggaggatcacttgagtctgggaggtcgagactgcagtgagctgtgactgcaccattgccctctagcctgagtaacagagtgagtaccctgtttaaaaaaaaaaaaaagtctattggaaaaaatacacctttgtttgacagcgatgactgaatctccccagaatttgttttttttttttttttggtaaaaaattaaasaaagaacattttataatttttaatttttagaaatatagtttattgaattttatactcattgtatccactagtcatgttgtttgttatcaataaatggaactgttgataacaatcattactataacacaataatgataatggcaacttggtctcctctcaaggaactgttgtcattaattttatttttcatccaatacatgacatgtttgttgacttgtagaaaaataaccatgttagttatggaagctgacagggaggtactaaatctagtaaagacattttcatacacaccaaggggaa

SEQ ID NO: 125472 - DNA, 601 bp, Human
aggagcattgcttcagcctaggagttcaagaccagcatgggaaacatagcaagaccccatctctactaaaaatacaaaaattagcgggatgtggtgacatgcacctgtactcccaactgctcaggagggtggggtgggaggattgcttgaccctgggaggaggaggttgcggtgagctgagattgcgccactgcacttcagcctggacaaccggattgaaatcctgtctcaaaataaataaataaataaataaaaacccacactgatctaatgcatcttttcccccccgaatattataatkttctaactctactgcttaatgcaaagttaaaagaactgtaggttactgacatgacttttattttgttcaattatttcaatatctatttttaacctcaagctttagcttatagaataagtggtgccacacattccattttctttataattgctatcacgtagtgaggattaggacataaaatagttataaaaaacacactttacaaatgaggcatattgggttattcatattatttccattgtcctccttgaaagcagtgttttagcttctccctcccttcacccggccttcatggtctaa

SEQ ID NO: 125473 - DNA, 601 bp, Human
cgggaggcggaggttgcagtgagctgagaccgtgccattgcactccagcctgggcaacagagtgagactcggtctcaaaaaaaaaacaaaaaaaacaaaaaaaaaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccaccacctaaaccctgcggttcctaagttcttttytgggaggcagggatgtgctgtgcccatatacaggtgctcacccagccctgactcactcaagcaatattccccttccatcctgttctaaacccaggaaatataatgagggaatgaggcaagacaatccggccccacaggagtttatattcccctgggggaaatggaaaatcaacctacctaacacatggtcacgaagagaagcaatggtgatgctgtgttaggaaaaaaagaagaaagaagacagaaagaagaaagaagaagaagaggaagaagtggaagaggaagaagaaggaggaggag

SEQ ID NO: 125474 - DNA, 601 bp, Human
cgcagtggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactccggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaacaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccaccacctaaaccctgcggttcctaagttcttttctgggaggcagggatgtgctgtgcccatatacaggtgctcacccagccctgactcactcaagcaatattccccttccatcctgttctaaacccaggaaatataa

SEQ ID NO: 125475 - DNA, 601 bp, Human
ggccaggcgcagtggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactccggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaaaaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccaccacctaaaccctgcggttcctaagttcttttctgggaggcagggatgtgctgtgcccatatacaggtgctcacccagccctgactcactcaagcaatattccccttccatcctgttctaaacccagga

SEQ ID NO: 125476 - DNA, 601 bp, Human
tgcacacctgtggtcccaggtacttgggaggctgaggtgggaggattgcttgagcctgggaaggcagggtgcagtgagccacggttgcaccactgcactccagcctgggtaagagtgagaccctgtcggccaggcgcagtggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactcsggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaaaaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccacc

SEQ ID NO: 125477 - DNA, 601 bp, Human
tcactcacagttggccgggcacagtggctcatgcctgaaatctcagcaatttgagaggctgaggtgggaggctctttgagcctatgagtttgagaccagcctgaacaacacagcaagaacttgtctctacaaataataaaaaaattagccgggtgtggtagtgcacacctgtggtcccaggtacttgggaggctgaggtgggaggattgcttgagcctgggaaggcagggtgcagtgagccacggttgcaccactgcactccagcctgggtaagagtgagaccctgtcggccaggcgcagkggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactccggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaaaaaaca

SEQ ID NO: 125478 - DNA, 601 bp, Human
ctttctatgcctatgcgtgtctctgtcacccctctctgtctgcttgtctctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctkattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctatctctctctgtgtctctttctctcttttcatctctccctgtttgtctctctctgtttttctttctgtctccctccatctgtctctctttttccacctctctttctgtttctctctgtctccctccctctgtttatctctctt

SEQ ID NO: 125479 - DNA, 601 bp, Human
gattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatgragtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaaaccatcttccctctttggcctccaaaagttctgggattacaggcatgagcaactgcacccaacctggtgactttttttgtttgtttggttttttgcttttgagatagggtctccctttgttg

SEQ ID NO: 125480 - DNA, 601 bp, Human
atcgcacgtatcaaccctactgccagtctgctgacactgactttggacgagaagaaagaaaaggtcttttttggctgagtgcagtggctcatgcctgtaatcccagcactttgggaggccaaggcgggcagatcatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcaccgctgcactccagcctggtgacaaagygagacttcatctcaaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcat

SEQ ID NO: 125481 - DNA, 601 bp, Human
aacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtytttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgtt

SEQ ID NO: 125482 - DNA, 601 bp, Human
atcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaarttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaa

SEQ ID NO: 125483 - DNA, 601 bp, Human
cacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaaattctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggag

SEQ ID NO: 125484 - DNA, 601 bp, Human
aaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatkaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggat

SEQ ID NO: 125485 - DNA, 601 bp, Human
ctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaag

SEQ ID NO: 125486 - DNA, 601 bp, Human
gataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatgcatacatacatacatacatacatacatacatagatgcatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgt

SEQ ID NO: 125487 - DNA, 601 bp, Human
tgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatacatacatacatacatacatacatacatacatagatrcatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcga

SEQ ID NO: 125488 - DNA, 601 bp, Human
gctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatrttataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaact

SEQ ID NO: 125489 - DNA, 601 bp, Human
acataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatayatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatata

SEQ ID NO: 125490 - DNA, 601 bp, Human
ttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttrtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaagg

SEQ ID NO: 125491 - DNA, 601 bp, Human
gaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatktatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttat

SEQ ID NO: 125492 - DNA, 601 bp, Human
tattggaccaaggtcaagaaaattggtcttacatttgttaacatttctgtggaaggaagccatgtatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtayagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattc

SEQ ID NO: 125493 - DNA, 601 bp, Human
ttcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggrttaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctatt

SEQ ID NO: 125494 - DNA, 601 bp, Human
taaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctatttwaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatcca

SEQ ID NO: 125495 - DNA, 601 bp, Human
gtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttcyttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgta

SEQ ID NO: 125496 - DNA, 601 bp, Human
tttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataaytggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcat

SEQ ID NO: 125497 - DNA, 601 bp, Human; identical to SEQ ID NO: 23986

SEQ ID NO: 125498 - DNA, 601 bp, Human; identical to SEQ ID NO: 23987

SEQ ID NO: 125499 - DNA, 601 bp, Human; identical to SEQ ID NO: 23988

SEQ ID NO: 125500 - DNA, 601 bp, Human; identical to SEQ ID NO: 23989

SEQ ID NO: 125501 - DNA, 601 bp, Human; identical to SEQ ID NO: 23990

SEQ ID NO: 125502 - DNA, 601 bp, Human; identical to SEQ ID NO: 23991

SEQ ID NO: 125503 - DNA, 601 bp, Human; identical to SEQ ID NO: 23992

SEQ ID NO: 125504 - DNA, 601 bp, Human; identical to SEQ ID NO: 23993

SEQ ID NO: 125505 - DNA, 601 bp, Human; identical to SEQ ID NO: 23994

SEQ ID NO: 125506 - DNA, 601 bp, Human; identical to SEQ ID NO: 23995

SEQ ID NO: 125507 - DNA, 601 bp, Human; identical to SEQ ID NO: 23996

SEQ ID NO: 125508 - DNA, 601 bp, Human; identical to SEQ ID NO: 23997

SEQ ID NO: 125509 - DNA, 601 bp, Human; identical to SEQ ID NO: 23998

SEQ ID NO: 125510 - DNA, 601 bp, Human; identical to SEQ ID NO: 23999

SEQ ID NO: 125511 - DNA, 601 bp, Human; identical to SEQ ID NO: 24000

SEQ ID NO: 125512 - DNA, 601 bp, Human; identical to SEQ ID NO: 24001

SEQ ID NO: 125513 - DNA, 601 bp, Human; identical to SEQ ID NO: 24002

SEQ ID NO: 125514 - DNA, 601 bp, Human; identical to SEQ ID NO: 24003

SEQ ID NO: 125515 - DNA, 601 bp, Human; identical to SEQ ID NO: 24004

SEQ ID NO: 125516 - DNA, 601 bp, Human; identical to SEQ ID NO: 24005

SEQ ID NO: 125517 - DNA, 601 bp, Human; identical to SEQ ID NO: 24006

SEQ ID NO: 125518 - DNA, 601 bp, Human; identical to SEQ ID NO: 24007

SEQ ID NO: 125519 - DNA, 601 bp, Human; identical to SEQ ID NO: 24008

SEQ ID NO: 125520 - DNA, 601 bp, Human; identical to SEQ ID NO: 24009

SEQ ID NO: 125521 - DNA, 601 bp, Human; identical to SEQ ID NO: 24010

SEQ ID NO: 125522 - DNA, 601 bp, Human; identical to SEQ ID NO: 24011

SEQ ID NO: 125523 - DNA, 601 bp, Human; identical to SEQ ID NO: 24012

SEQ ID NO: 125524 - DNA, 601 bp, Human; identical to SEQ ID NO: 24013

SEQ ID NO: 125525 - DNA, 601 bp, Human; identical to SEQ ID NO: 24014

SEQ ID NO: 125526 - DNA, 601 bp, Human; identical to SEQ ID NO: 24015

SEQ ID NO: 125527 - DNA, 601 bp, Human; identical to SEQ ID NO: 24016

SEQ ID NO: 125528 - DNA, 601 bp, Human; identical to SEQ ID NO: 24017

SEQ ID NO: 125529 - DNA, 601 bp, Human; identical to SEQ ID NO: 24018

SEQ ID NO: 125530 - DNA, 601 bp, Human; identical to SEQ ID NO: 24019

SEQ ID NO: 125531 - DNA, 601 bp, Human; identical to SEQ ID NO: 24020

SEQ ID NO: 125532 - DNA, 601 bp, Human; identical to SEQ ID NO: 24021

SEQ ID NO: 125533 - DNA, 601 bp, Human; identical to SEQ ID NO: 24022

SEQ ID NO: 125534 - DNA, 601 bp, Human; identical to SEQ ID NO: 24023

SEQ ID NO: 125535 - DNA, 601 bp, Human; identical to SEQ ID NO: 24024

SEQ ID NO: 125536 - DNA, 601 bp, Human; identical to SEQ ID NO: 24025

SEQ ID NO: 125537 - DNA, 601 bp, Human; identical to SEQ ID NO: 24026

SEQ ID NO: 125538 - DNA, 601 bp, Human; identical to SEQ ID NO: 24027

SEQ ID NO: 125539 - DNA, 601 bp, Human; identical to SEQ ID NO: 24028

SEQ ID NO: 125540 - DNA, 601 bp, Human; identical to SEQ ID NO: 24029

SEQ ID NO: 125541 - DNA, 601 bp, Human; identical to SEQ ID NO: 24030

SEQ ID NO: 125542 - DNA, 601 bp, Human; identical to SEQ ID NO: 24031

SEQ ID NO: 125543 - DNA, 601 bp, Human; identical to SEQ ID NO: 24032

SEQ ID NO: 125544 - DNA, 601 bp, Human; identical to SEQ ID NO: 24033

SEQ ID NO: 125545 - DNA, 601 bp, Human; identical to SEQ ID NO: 24034

SEQ ID NO: 125546 - DNA, 601 bp, Human; identical to SEQ ID NO: 24035

SEQ ID NO: 125547 - DNA, 601 bp, Human; identical to SEQ ID NO: 24036

SEQ ID NO: 125548 - DNA, 601 bp, Human; identical to SEQ ID NO: 24037

SEQ ID NO: 125549 - DNA, 601 bp, Human; identical to SEQ ID NO: 24038

SEQ ID NO: 125550 - DNA, 601 bp, Human; identical to SEQ ID NO: 24039

SEQ ID NO: 125551 - DNA, 601 bp, Human; identical to SEQ ID NO: 24040

SEQ ID NO: 125552 - DNA, 601 bp, Human; identical to SEQ ID NO: 24041

SEQ ID NO: 125553 - DNA, 601 bp, Human; identical to SEQ ID NO: 24042

SEQ ID NO: 125554 - DNA, 601 bp, Human; identical to SEQ ID NO: 24043

SEQ ID NO: 125555 - DNA, 601 bp, Human; identical to SEQ ID NO: 24044

SEQ ID NO: 125556 - DNA, 601 bp, Human; identical to SEQ ID NO: 24045

SEQ ID NO: 125557 - DNA, 601 bp, Human; identical to SEQ ID NO: 24046

SEQ ID NO: 125558 - DNA, 601 bp, Human; identical to SEQ ID NO: 24047

SEQ ID NO: 125559 - DNA, 601 bp, Human
gcaggggccagctgtggggactcctcacccaaagcagggcaccagcaatccgtagtagcccgcaggaaaggggcagctgcccagccgcagcccaggtgcaaggggcatttgtttccacggggcaagcaaggaagactttaccctgaaacaaagaattgagaccaaccgagactgtcccagcctcttcgacggcagaggaatcccagcttctggactgaggggctacatctatccccctcccccacctctttaactttaaaatagtttaatgaacacagagagagaaatcatttttttttttctgcgtggtgagcagtctacaaagagaaatgggaaaggagggagagagctttaactctgatccccgcaattagttccctgggattgttggtgtgtgtgtggggggggcaacccgggagcctcagttcttcagatacaaaagcatttagatcgctttagaccggttaatcctgagtctggctcgggtctcttttgtttcccaactccattgtgggttttgtgcagtttctctctgttcgcgtgattgactagccaatagatggtaattatccaaatgtcccctctgtcctttgactgactt

SEQ ID NO: 125560 - DNA, 601 bp, Human
ccagatcggtaaaacttaagcatacagacaattgatagttatgttttgtttccacatcttaaaaaaacaaagtgaagatttttgatttttctatctgcagaccagtctttaccagctaagtgcccctcaccagaggagctgaggcatccctattgataaaaccccctggaaattgaaccaaaattggcatccctcaaaaaagttgatccacctagaaacggatgaatcagtcctgattgggtggacatgccctttcacctcattgtgtctgacctatcacttaattaatctctcccagagyagagctgttgacaataccaaagataagcagtattttgaacaaagcaggaagcttttaaaagaacaagccacagtgaggtttgaggctcttaaaaatgtgtaaatcatcagcattaggatgtaaggtacctttataacgtagctgaagctcagagatgatcccacctttgccagaaactttctgtgcctttctttagccatggatgtctttagacattcatattctgcctctcccctctgctgctggttccctttctcctgtctttccctttctctggattcatactctccatggctactt

SEQ ID NO: 125561 - DNA, 601 bp, Human
agccacagtgaggtttgaggctcttaaaaatgtgtaaatcatcagcattaggatgtaaggtacctttataacgtagctgaagctcagagatgatcccacctttgccagaaactttctgtgcctttctttagccatggatgtctttagacattcatattctgcctctcccctctgctgctggttccctttctcctgtctttccctttctctggattcatactctccatggctactttcctgaaaattgttctctgctttccagccttgcctttggctcttcacatcctttttttagtgttarggctgtcgaggtagtcagcttctaaggctttgggggacaaactatcgactgcatctgctggtacctatgaaggaggacatttgtgctgcaggcaccttggtgacatacagggaatagttcattaattaaaagacttgctaattgctgcttgaattactgtacagaaggaatgaaatgagtttgtaaaagatgacgatttggagaatgcatttttttttgtttaaaatatttttataaacagctcctagaaaatgtgttgcttttgctgttgactctatcgtcaacaattcaactgagctt

SEQ ID NO: 125562 - DNA, 601 bp, Human
gaggtagtcagcttctaaggctttgggggacaaactatcgactgcatctgctggtacctatgaaggaggacatttgtgctgcaggcaccttggtgacatacagggaatagttcattaattaaaagacttgctaattgctgcttgaattactgtacagaaggaatgaaatgagtttgtaaaagatgacgatttggagaatgcatttttttttgtttaaaatatttttataaacagctcctagaaaatgtgttgcttttgctgttgactctatcgtcaacaattcaactgagcttcaattaaygataatatatggtctgggatccttcgctgggcccgactgatggaagagctttgttgaatttggtgcaggtggcactgtttaataagcacaggaaagagtgaataatgtagtgcttgcaaagagaagtaaatgcaaaatagatcgctctaattatggcagcccccagaaatggagatgcaagctgaaatggccaagtagctgggaaattctaaatagtgtcgattgtcccctgcctttttactttcgagggctgacatggtagcttaaaagtaaatttgggtgagctcatctcactcaaca

SEQ ID NO: 125563 - DNA, 601 bp, Human
actgtttaataagcacaggaaagagtgaataatgtagtgcttgcaaagagaagtaaatgcaaaatagatcgctctaattatggcagcccccagaaatggagatgcaagctgaaatggccaagtagctgggaaattctaaatagtgtcgattgtcccctgcctttttactttcgagggctgacatggtagcttaaaagtaaatttgggtgagctcatctcactcaacacaaacagaaattcaaaacctgagtctgatgacctatcaatgtttgccttcactgtctagaatccattaccagayagtaaaactcagcactaaaacagggccatctgaacatttcttcctgcaagagatcggcacaagctctttacaactagcattcgtattttattgcaaagtgccaggagattttgtttttgtttttgttttgttttgtttgaatttctttatgcttgagaaaattagcctataggaaatcaaagtgtgaatacttaagcaaacagaatttctcatatacctgcaagggcttgtagtgattttcattcatgcaaagataatcaatgggacattagttgtcttaattaatggaagaataaaaat

SEQ ID NO: 125564 - DNA, 601 bp, Human
gtgctgggagcctagcatgctttgtgatggtaaaatagtgccagtggctgggaagctcaaatcaacattctttagcctggactaaagagaggctggggctgaatgggtgtgctagacatggggtgatctgtaaagcgtggctccagcaagtgggtagagaccctcgtcctctgattgagaacccaaggaggagccaagtccagcatctttagctaaaaactccttttttgttatgtagaaatgtttaccaaacccaactccagtcagtgctggctgggcactccagtcgattggtgttagygtatgggaagctcataaaagctttatggggaaacctgtgcttagaaatggagtttagaggtgtcctgctgtcagagaaggatggcagagatgcctttgaatgaagaaggctgtgataggaaaaatttttagtctcaagtgcatggaaatatgagttgtcagacagtcaagggttcatctgcttcctcctcttcccccgtccccactttttccatacaaaatcttttggattctcctctaagcaaaatgtggtttcctatgtgaggaaatttgttgctagtttttcttgtgcttcaacctg

SEQ ID NO: 125565 - DNA, 601 bp, Human
ggctgccaacctccacgtttcctgatgcatcatgttcaaacctgaaattcacacttcgtgtttcattttaagttcagtgcatttaacagggccctagagagagagccctggttagttccccaacctgctcagctgacgcccagggaggcggtttcagaattgttcagatcgctgcagggagaagaggaggaggaattgggcttctctctgcctgcaacaggccaagccacttatctattctaatgtcacagacacggggttcctcttcggaaacaactaaggctccactaatttttattgycgatagcggtgataagcagattttctgtgtagtgtgaccaaggcaatgagctgatttcgtaaagaaagagatagctatgcctgaactgatttactgctgactgacagcctctcgcatcaatataaaacactccctgctttgctgaatgaggcccacaagcctgggaaaggtgtgtgtgtgtgggtcctcattgaagatacagagcttttctgctctccctgtgactcagcctcaccccaccctttcttggagataaccctaaccctgcattcctgtgcagtggcaaggaatcacccttcc

SEQ ID NO: 125566 - DNA, 601 bp, Human
ggaggacagaagatgttacactttactcagggaacagaggcgggcaactggccctgtgactgcagccaacagctttaagaacacagtcctttctgcttcaaggttagggagacgttctcgcctctttcttctttgcagttattattcaagaggcttcccccgaccccagtccccagcaccatcctcagagcttcagaccatacattgacagtgagcaaagggggccccaggcaggcgggtctggggccaaggagggcggctcccctgcgcggatccttccctggtggctcccaaatccggsgttttctctgccgcctctccctcgggggagactcggaaaggctgcaaaaatctgggcgcccgttcgctcgcttgtcaagaagcaaactgtcttcacattctccaagagcaacatccctgcctaggaagaggaaggaagaggcaaaataaataaaaccagttaatgttgtagttaacttgcaaatcaagtaaatctgttggtgccgtatttgagaaataaaccatcacagcgtcacagcaaacacacacttctgaacgtcttcattttgatttaatggtatatcagcgtcaactatcgctt

SEQ ID NO: 125567 - DNA, 601 bp, Human
tgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattarcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagta

SEQ ID NO: 125568 - DNA, 601 bp, Human
gcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagccctcccgagagtggagttgcaccaaggacaaacactctagcgtcattacaaattttttctrccccttgggcgacctccagatgaaccctggtgactctcagattggattttcattccttactttctttgaaagaaagtgccccagatgcgtcaataaaacatgcctatgtattcgtgtaggcgtccgcatgcctgcgcgccggccgtgtgcaggcgccgaagcacacgtctgtgtgaacacacgggcacgcgcgtctttgggtttagtggtccttccctcgcgttggggcatctgtacacatgcagaatatacacatatgattgtaacttcaagttttttcaattatgcaaaacgacctcg

SEQ ID NO: 125569 - DNA, 601 bp, Human
ctgtaaccgaagtgcttattcagtttttgtctacaatcattttatttcctaaatccctcccccaccagacacctgggtatttccctccagtccccaggagactctagggtgagcctgaaacctggaggctgggggtagcagttgggatttacccagcacgctactttgttggcccctggggaggtggtgcagccaggcgggtaaggaggactcgcgccatcagcggggtctgagacatggtgtgcccagtgggcagagaataggcctgtggtttttaagaacctcactgatatcgaatgtrtcttggagtgagaaagtttttaatggaaaaggagcaagagagagtaatgaaataatttgctaagtgcctactatgttccaggcattttacatccacagtctctttcaatcaacacgtccatgcggaggagagcttcttgtcgcccattataaaggtcagaaacaggctaagggaggataagtcactgcctaaggttacagtgcatgtaaatggcagagctaggattcgaaccctggcctttctgagttcctaaagccatgctcgcccccactcttccaggctggggagagaccgggaaga

SEQ ID NO: 125570 - DNA, 601 bp, Human
gggtgaggtggggggcttggttcggatttccggcatctttgaaccccaggccattcccggagaagctctgccccctcccgcgcccctccctgctcaggacagctgcagaggttctgagttccggcaaatgagccgtcaacatctgcccgaagtctgcaaggcccggaaaggtttatgactctccgggcttccgaactagagtttatgtgcaattattttctttctttcgtttgcaacagaattagatttggagattttgtgttcttcttccttttccctttagtctaatgcacaagcagaraaaagcaaaaacaaaaacaaacccaagactgtgcagagggtgctacggcgggaagaagtcagttattttcatcttaaagaatctgagttgaatagagagggaaatgaggggcgggtgttcgctccaacgaaatcgcttggaggatcatggggcgtgtgtccctgtgtgcggaactgggaggaaaacgcagcccccagtttggtaaatggtgaagcagcggtaggccggtcggtggcgcggatttaagatttgctgaaggcactaccacagatgtagctctctggaacttccatccctcct

SEQ ID NO: 125571 - DNA, 601 bp, Human
atcaagtgggtcaacttccactcggaagcacctcgcggggctcggctccagggcacctggtggctggggagctgtattgttttcctgggcacggaggttcggcgccggttttaggattgtgcaaaaagagagtagaaggtacagagatttatttctgctttttgctgttcagccgccgtttgccccagcgaggtgggctggaggctgaatttcaagccttgtttaacctctacaagagacaccctccattcagccatctcactttctctctggcctccctctctctttttttcctttccgytctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaa

SEQ ID NO: 125572 - DNA, 601 bp, Human
ccagacacggtagggggagacggcagaaagcactcctccttagagtgccttggaaaacaggaggagggcaggcccagagaccctgtcctgctgtgtccaaagtcaagtgacttcccttgctgagcctcagtttcaacatctgtaaaaacgggaaaaataatacctggtgctcctaggattgttttaagtacctaaagaaaatgtgcctggaaagccctttaacacatcacctggagttcaatcggccatcaacaagtcgtagctgttgttgctgctgctgctgctgctgctactattgttyttattgtaacataatggctcagaatgatttttggattctcccagagccgggattcagtgctgcagttcttagcagtgtgatcctgggtggatcgctgtctctgagcctcagtgtttccatctataaaatggggatgatgtccccctttcattgtggcgcagacatgcagcagggttaaggattgaaatgtttggcagtgggtggggcgagtgtggatttggcatggggggcgggtcaggaagttcacccaccggctctgtgtctcctccctagcgctaagctgcaacgaaaacgacgcag

SEQ ID NO: 125573 - DNA, 601 bp, Human
cgtacacccaaggtgactatcattagctcctgcttcttgcttcttacccactctagtttctcttctcttgctgtctgcctctgtctcactcccccctctctcttccttcaggcatctctctagatttatcttctgcctcccagactctcctggaagcaaggtttggtggtggggatgtgtgtgggcagattccctgggtgggcaggtgggggcgggactgcccagaggacatggtggggtgggggagcggctgggtgcctgtgaaactcagcagaactgcacttacatgtgcgagtaactwcttaatagagaagatccagaactttcaccaaattttcacacccctagagatgttaagaaccctagtctggaggcacagaagcaggtcccaggctcctgcatgacccaaagttgtggcagagtcgtgggccacatctcaaacggtcagctcctccttttactcattttagggtcttaggcaagtcacttgactttttgtagcctgtttcctcatacaagaaatggatacaataaattatgctgccgggttatccaaggagccactgaaatgacgtgcctgtggtgcgacctgacacttcgt

SEQ ID NO: 125574 - DNA, 601 bp, Human
acaaaaaacaaacaaaaaaatgccctctgtggggcgggtggaggctgtgacgcggcgcaactgcagctgcagctgcggggggagccgggagttggggcccctaggctcccgaggcgcccccttgagcagcgctgcccacggggagcgggcgaggggctgcgggagagggaggactgggtgacgtagccgagggagggagcgtcggccaatgggatgccgatgcgcccctctgggcccgcccctccctcatggtctgttttgctttggagtcccagtggcctgagctcctggtggatggagracgtgactacactggctggggtagcaggtccctctcgtctgtttccttcgttgtttgccttcttggggttaggtcaaggaccctctttggcgtcccctcccttcagccgtgggtgagttcggactgaggacttggggttgggctgccttttctctgcttagtaggacccttcgtccttccccaacccagttgctctgtggcagggatgtccaatcttttggcttccctgggccacattggaagaagaagaattgttttgggttacacataaaatacactaacacgaacgatagttgttga

SEQ ID NO: 125575 - DNA, 601 bp, Human
aaaaacaaacaaaaaaatgccctctgtggggcgggtggaggctgtgacgcggcgcaactgcagctgcagctgcggggggagccgggagttggggcccctaggctcccgaggcgcccccttgagcagcgctgcccacggggagcgggcgaggggctgcgggagagggaggactgggtgacgtagccgagggagggagcgtcggccaatgggatgccgatgcgcccctctgggcccgcccctccctcatggtctgttttgctttggagtcccagtggcctgagctcctggtggatggagaacktgactacactggctggggtagcaggtccctctcgtctgtttccttcgttgtttgccttcttggggttaggtcaaggaccctctttggcgtcccctcccttcagccgtgggtgagttcggactgaggacttggggttgggctgccttttctctgcttagtaggacccttcgtccttccccaacccagttgctctgtggcagggatgtccaatcttttggcttccctgggccacattggaagaagaagaattgttttgggttacacataaaatacactaacacgaacgatagttgttgagct

SEQ ID NO: 125576 - DNA, 601 bp, Human
tgtagcactgttctccctttttcccagaccacatttgcacaaatcccaaatattcctattgcacatggtgatgcagcagtttacaaagcattatctttccagccacgtatctaccttaccttaagatttttctgcccattttacagatgagaagcttaagacctagtaagatgaggtgatttgctgctggatacaggagccaggcattggcagggtggggcttgcccccaggtgccctgaatgctgatggggaatctggcagacatgggatgggaacagtttgaggcagttggtagtatgsctttgaaaggtaacagactggttttaatcctgtctgacttaccagcagtgagatttggatgttttaatttctcctctctgagcctgatgccttatctatgaaatggggatgagaaggataccttactggtggttgcacggagtaaataagatgacatacagtataatttacagagtgtagagtcaggacccaggcatgctgatctcatgcactcatttacacagtacagttcagtctcctgcagtcatttacacagtacagttcattctgcaaccctctttgcacacattttaaaaatgt

SEQ ID NO: 125577 - DNA, 601 bp, Human
gctggatacaggagccaggcattggcagggtggggcttgcccccaggtgccctgaatgctgatggggaatctggcagacatgggatgggaacagtttgaggcagttggtagtatgcctttgaaaggtaacagactggttttaatcctgtctgacttaccagcagtgagatttggatgttttaatttctcctctctgagcctgatgccttatctatgaaatggggatgagaaggataccttactggtggttgcacggagtaaataagatgacatacagtataatttacagagtgtagagtcmggacccaggcatgctgatctcatgcactcatttacacagtacagttcagtctcctgcagtcatttacacagtacagttcattctgcaaccctctttgcacacattttaaaaatgtgattatcttcattttgcagatgatgaaactgagattctgagagtctagaaccctggccctgagtctcacagctagtaagtgatgaagccaggagtcgagttcagattggtctgaaatttccaaagctctttccaatattgcacacgaagggattttgacttttttcccttggatctggctgcaga

SEQ ID NO: 125578 - DNA, 601 bp, Human
gaacagtttgaggcagttggtagtatgcctttgaaaggtaacagactggttttaatcctgtctgacttaccagcagtgagatttggatgttttaatttctcctctctgagcctgatgccttatctatgaaatggggatgagaaggataccttactggtggttgcacggagtaaataagatgacatacagtataatttacagagtgtagagtcaggacccaggcatgctgatctcatgcactcatttacacagtacagttcagtctcctgcagtcatttacacagtacagttcattctgcarccctctttgcacacattttaaaaatgtgattatcttcattttgcagatgatgaaactgagattctgagagtctagaaccctggccctgagtctcacagctagtaagtgatgaagccaggagtcgagttcagattggtctgaaatttccaaagctctttccaatattgcacacgaagggattttgacttttttcccttggatctggctgcagagtgcagcagtacagtgggagaggagggaaggtgtgggtcacagatgccatgtcttggtagggaagcagaaacctctagtaaagtgctc

SEQ ID NO: 125579 - DNA, 601 bp, Human
ggctcacacttataatcccagtactttgggaggctgaagtgggcagatcacttgaggccaggcatttgagaccagcctggccaacatggtgaaaacccgttccctactaaaaatacaaaaattagccaggcatggtggcgcacacctgtagtcccaggtactcgggaggctgaggcaggagaatcacttgaacccaggaggtggaggttgcagtgagctgagattgtgccactgcactccagcctgggcaacagagcaagactctgtctccaaaataaataaataaatagcatctttcagrtgactagttagttattactaacctgtgtgagaatttaggagttgagtactctagctttcctctggccactcacttgtttgacagatatattgacctgccatgtgccgggcagggctggaggcactgaggattcagtggggaacaagacaatgaacaagactggctgggcgtggtggctcacgcctgtaattccagcactttgggaggcggaggcgggtggatcacctgaggtcaggagttcaagaccagcctcaccaacatggtgaaacccgtctctactaaaaacacaaaaattagctg

SEQ ID NO: 125580 - DNA, 601 bp, Human
cagtactttgggaggctgaagtgggcagatcacttgaggccaggcatttgagaccagcctggccaacatggtgaaaacccgttccctactaaaaatacaaaaattagccaggcatggtggcgcacacctgtagtcccaggtactcgggaggctgaggcaggagaatcacttgaacccaggaggtggaggttgcagtgagctgagattgtgccactgcactccagcctgggcaacagagcaagactctgtctccaaaataaataaataaatagcatctttcaggtgactagttagttattaytaacctgtgtgagaatttaggagttgagtactctagctttcctctggccactcacttgtttgacagatatattgacctgccatgtgccgggcagggctggaggcactgaggattcagtggggaacaagacaatgaacaagactggctgggcgtggtggctcacgcctgtaattccagcactttgggaggcggaggcgggtggatcacctgaggtcaggagttcaagaccagcctcaccaacatggtgaaacccgtctctactaaaaacacaaaaattagctgggcatggtggcatgtgcc

SEQ ID NO: 125581 - DNA, 601 bp, Human
caggagaatcacttgaacccaggaggtggaggttgcagtgagctgagattgtgccactgcactccagcctgggcaacagagcaagactctgtctccaaaataaataaataaatagcatctttcaggtgactagttagttattactaacctgtgtgagaatttaggagttgagtactctagctttcctctggccactcacttgtttgacagatatattgacctgccatgtgccgggcagggctggaggcactgaggattcagtggggaacaagacaatgaacaagactggctgggcgtggtrgctcacgcctgtaattccagcactttgggaggcggaggcgggtggatcacctgaggtcaggagttcaagaccagcctcaccaacatggtgaaacccgtctctactaaaaacacaaaaattagctgggcatggtggcatgtgcctgtaatcccagctacttgggaggctgaggcaggaggaggatcgcttgagcccaggaggtggaggttgcagtgagccaaggttgcaccactgtactccagccagggtgacagagcaagactctgtctcaaaaaaaaaaaaaaaagacattgaacaaga

SEQ ID NO: 125582 - DNA, 601 bp, Human
aagaccagcctcaccaacatggtgaaacccgtctctactaaaaacacaaaaattagctgggcatggtggcatgtgcctgtaatcccagctacttgggaggctgaggcaggaggaggatcgcttgagcccaggaggtggaggttgcagtgagccaaggttgcaccactgtactccagccagggtgacagagcaagactctgtctcaaaaaaaaaaaaaaaagacattgaacaagaccccactggaacatccacccagagggcatgtggagcaaggtgtgggataaacaattgacaaggtgcyaagattaatctctgtgtttttcttttaaatgattctaagctcaaataggtttgggaaaggctcaaggttgactgtgtctttctcttggagatcagagcatgttagcattaatacaggcactgagaaatctggaagagactcaactttgtctaatctaacatttcccaaattttatttggccatataattcttatttaactcttgtaaagaaataaaatggtagacgtgctaggtaggaaaaatgcaagggtacaattagagcacagagacctgacctgctgaaggaggtagtcagggaag

SEQ ID NO: 125583 - DNA, 601 bp, Human
aaaacacaaaaattagctgggcatggtggcatgtgcctgtaatcccagctacttgggaggctgaggcaggaggaggatcgcttgagcccaggaggtggaggttgcagtgagccaaggttgcaccactgtactccagccagggtgacagagcaagactctgtctcaaaaaaaaaaaaaaaagacattgaacaagaccccactggaacatccacccagagggcatgtggagcaaggtgtgggataaacaattgacaaggtgccaagattaatctctgtgtttttcttttaaatgattctaagmtcaaataggtttgggaaaggctcaaggttgactgtgtctttctcttggagatcagagcatgttagcattaatacaggcactgagaaatctggaagagactcaactttgtctaatctaacatttcccaaattttatttggccatataattcttatttaactcttgtaaagaaataaaatggtagacgtgctaggtaggaaaaatgcaagggtacaattagagcacagagacctgacctgctgaaggaggtagtcagggaaggcttccctgaggaggaggtgtggtttatatcagggcaagt

SEQ ID NO: 125584 - DNA, 601 bp, Human
gcctgtaatcccagctacttgggaggctgaggcaggaggaggatcgcttgagcccaggaggtggaggttgcagtgagccaaggttgcaccactgtactccagccagggtgacagagcaagactctgtctcaaaaaaaaaaaaaaaagacattgaacaagaccccactggaacatccacccagagggcatgtggagcaaggtgtgggataaacaattgacaaggtgccaagattaatctctgtgtttttcttttaaatgattctaagctcaaataggtttgggaaaggctcaaggttgactrtgtctttctcttggagatcagagcatgttagcattaatacaggcactgagaaatctggaagagactcaactttgtctaatctaacatttcccaaattttatttggccatataattcttatttaactcttgtaaagaaataaaatggtagacgtgctaggtaggaaaaatgcaagggtacaattagagcacagagacctgacctgctgaaggaggtagtcagggaaggcttccctgaggaggaggtgtggtttatatcagggcaagtcacttcattactttgaacctccatttccctacct

SEQ ID NO: 125585 - DNA, 601 bp, Human
gctgaggcaggaggaggatcgcttgagcccaggaggtggaggttgcagtgagccaaggttgcaccactgtactccagccagggtgacagagcaagactctgtctcaaaaaaaaaaaaaaaagacattgaacaagaccccactggaacatccacccagagggcatgtggagcaaggtgtgggataaacaattgacaaggtgccaagattaatctctgtgtttttcttttaaatgattctaagctcaaataggtttgggaaaggctcaaggttgactgtgtctttctcttggagatcagagcrtgttagcattaatacaggcactgagaaatctggaagagactcaactttgtctaatctaacatttcccaaattttatttggccatataattcttatttaactcttgtaaagaaataaaatggtagacgtgctaggtaggaaaaatgcaagggtacaattagagcacagagacctgacctgctgaaggaggtagtcagggaaggcttccctgaggaggaggtgtggtttatatcagggcaagtcacttcattactttgaacctccatttccctacctgtaaagtggtctttttcctgcctgt

SEQ ID NO: 125586 - DNA, 601 bp, Human
actgtactccagccagggtgacagagcaagactctgtctcaaaaaaaaaaaaaaaagacattgaacaagaccccactggaacatccacccagagggcatgtggagcaaggtgtgggataaacaattgacaaggtgccaagattaatctctgtgtttttcttttaaatgattctaagctcaaataggtttgggaaaggctcaaggttgactgtgtctttctcttggagatcagagcatgttagcattaatacaggcactgagaaatctggaagagactcaactttgtctaatctaacatttyccaaattttatttggccatataattcttatttaactcttgtaaagaaataaaatggtagacgtgctaggtaggaaaaatgcaagggtacaattagagcacagagacctgacctgctgaaggaggtagtcagggaaggcttccctgaggaggaggtgtggtttatatcagggcaagtcacttcattactttgaacctccatttccctacctgtaaagtggtctttttcctgcctgtctaccacccaggtgggtgataagtgtccaatctagtcctagatggcctaagctgtatggagtttc

SEQ ID NO: 125587 - DNA, 601 bp, Human
ctgtgtctttctcttggagatcagagcatgttagcattaatacaggcactgagaaatctggaagagactcaactttgtctaatctaacatttcccaaattttatttggccatataattcttatttaactcttgtaaagaaataaaatggtagacgtgctaggtaggaaaaatgcaagggtacaattagagcacagagacctgacctgctgaaggaggtagtcagggaaggcttccctgaggaggaggtgtggtttatatcagggcaagtcacttcattactttgaacctccatttccctayctgtaaagtggtctttttcctgcctgtctaccacccaggtgggtgataagtgtccaatctagtcctagatggcctaagctgtatggagtttcacagacaatttggcctaaacctctcagttcaaaggaaaggaaatcaagactcagagaggtggagtgactttcccaagaaccacagcaaagtggttctaggcctggggctagaaccaagggtttctgatttccagttcagtgcttattacttttggttctttaaagaaaacttctttaaaagtttacaaaatactagaactgccatacc

SEQ ID NO: 125588 - DNA, 601 bp, Human
tacctgtaaagtggtctttttcctgcctgtctaccacccaggtgggtgataagtgtccaatctagtcctagatggcctaagctgtatggagtttcacagacaatttggcctaaacctctcagttcaaaggaaaggaaatcaagactcagagaggtggagtgactttcccaagaaccacagcaaagtggttctaggcctggggctagaaccaagggtttctgatttccagttcagtgcttattacttttggttctttaaagaaaacttctttaaaagtttacaaaatactagaactgccatrccaacagtttagaaaaataggaaaaacagaaaacaacaacagcaaaacaaacaaaaaaaaccgtacccttctaagagcacaggaatccaataattaaagtgtgtgatttagaggttaagtagtggttaagggcatagaaccagtctgttggaagtcacatctcaattctgtttgtgcagtaagaggcacacagtttctactcctgcaaattggcaataatattcacatctaccgcatagggttattataaggaccaaatgagttaatgtgtaaagtgcttaggactttgcttataaaatg

SEQ ID NO: 125589 - DNA, 601 bp, Human
agtcctagatggcctaagctgtatggagtttcacagacaatttggcctaaacctctcagttcaaaggaaaggaaatcaagactcagagaggtggagtgactttcccaagaaccacagcaaagtggttctaggcctggggctagaaccaagggtttctgatttccagttcagtgcttattacttttggttctttaaagaaaacttctttaaaagtttacaaaatactagaactgccataccaacagtttagaaaaataggaaaaacagaaaacaacaacagcaaaacaaacaaaaaaaaccktacccttctaagagcacaggaatccaataattaaagtgtgtgatttagaggttaagtagtggttaagggcatagaaccagtctgttggaagtcacatctcaattctgtttgtgcagtaagaggcacacagtttctactcctgcaaattggcaataatattcacatctaccgcatagggttattataaggaccaaatgagttaatgtgtaaagtgcttaggactttgcttataaaatgcctggcactggctgggtgtggtgtctcctgcctgtaatcccagcactttgggaggccgaggtg

SEQ ID NO: 125590 - DNA, 601 bp, Human
gaaccacagcaaagtggttctaggcctggggctagaaccaagggtttctgatttccagttcagtgcttattacttttggttctttaaagaaaacttctttaaaagtttacaaaatactagaactgccataccaacagtttagaaaaataggaaaaacagaaaacaacaacagcaaaacaaacaaaaaaaaccgtacccttctaagagcacaggaatccaataattaaagtgtgtgatttagaggttaagtagtggttaagggcatagaaccagtctgttggaagtcacatctcaattctgkttgtgcagtaagaggcacacagtttctactcctgcaaattggcaataatattcacatctaccgcatagggttattataaggaccaaatgagttaatgtgtaaagtgcttaggactttgcttataaaatgcctggcactggctgggtgtggtgtctcctgcctgtaatcccagcactttgggaggccgaggtgggcagatcacaaggtcaggaggtggagaccatcctggctaatacagtgaaacccatctctactaaaaaatataaaaaattagccgggcatggtgccacatgcttgtat

SEQ ID NO: 125591 - DNA, 601 bp, Human
aaccacagcaaagtggttctaggcctggggctagaaccaagggtttctgatttccagttcagtgcttattacttttggttctttaaagaaaacttctttaaaagtttacaaaatactagaactgccataccaacagtttagaaaaataggaaaaacagaaaacaacaacagcaaaacaaacaaaaaaaaccgtacccttctaagagcacaggaatccaataattaaagtgtgtgatttagaggttaagtagtggttaagggcatagaaccagtctgttggaagtcacatctcaattctgtytgtgcagtaagaggcacacagtttctactcctgcaaattggcaataatattcacatctaccgcatagggttattataaggaccaaatgagttaatgtgtaaagtgcttaggactttgcttataaaatgcctggcactggctgggtgtggtgtctcctgcctgtaatcccagcactttgggaggccgaggtgggcagatcacaaggtcaggaggtggagaccatcctggctaatacagtgaaacccatctctactaaaaaatataaaaaattagccgggcatggtgccacatgcttgtatt

SEQ ID NO: 125592 - DNA, 601 bp, Human
gaggtgggcagatcacaaggtcaggaggtggagaccatcctggctaatacagtgaaacccatctctactaaaaaatataaaaaattagccgggcatggtgccacatgcttgtattcccagctacttgggaggctgaggcaggagaattgcttgaacccgggaggcagaggttgcagtgagctgagatcgcactactgtactccagcctgggcaacagagcgagacttcatctcaaaaaaaaagatgcctggcacttcatgaggaatagtattcatcattattatttgctttatgaaggtayaataccagaaggcatagtttttttttatcctttttttcacctaacagccatcacaagacatttcccctgtggcatcgtggagtggctgtgtcatgactcccacttgccgcatctgagtggacactttggatgcagccattagtttgatgttattaaaaatgccatgatgggcatgaagctttcatcttttggctgatttccttagcatcccaggtggggatttgctgggggcaaagtgggtttcccactggccctcctggctttcttgatgaaagaattctggggaaggaggtttgtgag

SEQ ID NO: 125593 - DNA, 601 bp, Human
ggtggagaccatcctggctaatacagtgaaacccatctctactaaaaaatataaaaaattagccgggcatggtgccacatgcttgtattcccagctacttgggaggctgaggcaggagaattgcttgaacccgggaggcagaggttgcagtgagctgagatcgcactactgtactccagcctgggcaacagagcgagacttcatctcaaaaaaaaagatgcctggcacttcatgaggaatagtattcatcattattatttgctttatgaaggtacaataccagaaggcatagtttttttttatcctttttttcacctaacagccatcacaagacatttcccctgtggcatcgtggagtggctgtgtcatgactcccacttgccgcatctgagtggacactttggatgcagccattagtttgatgttattaaaaatgccatgatgggcatgaagctttcatcttttggctgatttccttagcatcccaggtggggatttgctgggggcaaagtgggtttcccactggccctcctggctttcttgatgaaagaattctggggaaggaggtttgtgaggcaaaacacaacttgcatggtcaggt

SEQ ID NO: 125594 - DNA, 601 bp, Human
tcctggctaatacagtgaaacccatctctactaaaaaatataaaaaattagccgggcatggtgccacatgcttgtattcccagctacttgggaggctgaggcaggagaattgcttgaacccgggaggcagaggttgcagtgagctgagatcgcactactgtactccagcctgggcaacagagcgagacttcatctcaaaaaaaaagatgcctggcacttcatgaggaatagtattcatcattattatttgctttatgaaggtacaataccagaaggcatagtttttttttatccttttttycacctaacagccatcacaagacatttcccctgtggcatcgtggagtggctgtgtcatgactcccacttgccgcatctgagtggacactttggatgcagccattagtttgatgttattaaaaatgccatgatgggcatgaagctttcatcttttggctgatttccttagcatcccaggtggggatttgctgggggcaaagtgggtttcccactggccctcctggctttcttgatgaaagaattctggggaaggaggtttgtgaggcaaaacacaacttgcatggtcaggtagtgcctggga

SEQ ID NO: 125595 - DNA, 601 bp, Human
tttgatgttattaaaaatgccatgatgggcatgaagctttcatcttttggctgatttccttagcatcccaggtggggatttgctgggggcaaagtgggtttcccactggccctcctggctttcttgatgaaagaattctggggaaggaggtttgtgaggcaaaacacaacttgcatggtcaggtagtgcctgggaaggggcaagaagcaacgtgtgcttcttcatctacccagggcttattggagatctaccgcgcaccaggctggggcaccccggcctggtgttagttgtgtcctgatgmttctctgtctgaacttcgccttcttgtcccagacacacagtccagagaacttgaggcatgtgaaaagagaaggcctgtcagtttcagaagatgggtgggtggggcagactgcaccttgttgcttgcagctgcctaagaatcccagcctgtcagaaccctgagagccatagagatcgtatgatgtggtctaaccctcttgttgtacaagtgaagaaactgaggccggtccagaggtgagggacaaacccgaggtcacgtggtagtcccaggactggaagctgctctttccactgcactata

SEQ ID NO: 125596 - DNA, 601 bp, Human
ttagcatcccaggtggggatttgctgggggcaaagtgggtttcccactggccctcctggctttcttgatgaaagaattctggggaaggaggtttgtgaggcaaaacacaacttgcatggtcaggtagtgcctgggaaggggcaagaagcaacgtgtgcttcttcatctacccagggcttattggagatctaccgcgcaccaggctggggcaccccggcctggtgttagttgtgtcctgatgattctctgtctgaacttcgccttcttgtcccagacacacagtccagagaacttgaggcaygtgaaaagagaaggcctgtcagtttcagaagatgggtgggtggggcagactgcaccttgttgcttgcagctgcctaagaatcccagcctgtcagaaccctgagagccatagagatcgtatgatgtggtctaaccctcttgttgtacaagtgaagaaactgaggccggtccagaggtgagggacaaacccgaggtcacgtggtagtcccaggactggaagctgctctttccactgcactatagttgcttctctgtttcttcatccatttattcactcattcatggacttgctacctccctc

SEQ ID NO: 125597 - DNA, 601 bp, Human
actcattcatggacttgctacctccctcaggaccatgtggcagggagagcatggactcttttagggcaagtggtcctggattccagtctcaggttgccctctgtgtgacctttggcaagtggttttaccactctgaccctctctggtttttaaatctatacagtgagggcaggcacggtggctcatgcctataatcccagaactttgggaggccaaggtgggcggatcacctgaggtcaggagttcaagaccagcctggccaacatggtgaaactccgtctgtactaaaaatacaaaaaarttagccaggcatggtggcgggtgcctgtaatcccagccactcaggagactgaggcaggagagaatcacttgaacctgggaggcagaggttgaaatgagctgagatcgtgccactgcactccagcctgggtgacagagcaagactctgtctcaaaaaataataataataataataatagtcaataaataaatctataaaatgggaataataatagtcgaatccacctacttggcttttcatgggaataacctgtggcagtgcatgctggagggtggcatggagcctggcacatagtaaaag

SEQ ID NO: 125598 - DNA, 601 bp, Human
agccctgacaacatgaagaacaaaccccacacaaccccagagcagccgggcttttaatgaagttgttgaattttcatctaccagattcccagtgcctcagctctggaaagcagagaaggtagttgtggacgatggtgtcattgtttacaagcccactgttaggggcaacagcctgagaaatagcaaacagccggcaactaaccgggtccagccctgcccgaggtcttggagccccggatggatgagcaaatgagcacccggcaaagcaccctcaaaccctcgacccaggctccccgctccrgctactgctctgagagtcagacgcacagagcacaggctgctcaggggtcacacgcacacaggccaggacagtggcaaggcagcggcaccaaggctccggccttctccaccccaatctgcatgactttggggaagtcacttcctctctctgagggcctctgggggcttccccatccattttctttaggccaccaggacacagtctctcccctacagatttctgctggccgggaaagggaaggacccccccaccccagggaaagcatgtcaagggtggtctgagaagcactgtacttatttg

SEQ ID NO: 125599 - DNA, 601 bp, Human
cagattcccagtgcctcagctctggaaagcagagaaggtagttgtggacgatggtgtcattgtttacaagcccactgttaggggcaacagcctgagaaatagcaaacagccggcaactaaccgggtccagccctgcccgaggtcttggagccccggatggatgagcaaatgagcacccggcaaagcaccctcaaaccctcgacccaggctccccgctccagctactgctctgagagtcagacgcacagagcacaggctgctcaggggtcacacgcacacaggccaggacagtggcaaggcrgcggcaccaaggctccggccttctccaccccaatctgcatgactttggggaagtcacttcctctctctgagggcctctgggggcttccccatccattttctttaggccaccaggacacagtctctcccctacagatttctgctggccgggaaagggaaggacccccccaccccagggaaagcatgtcaagggtggtctgagaagcactgtacttatttgccagcccccagaaggggtgatgggctttctttgggcggagagccagggaaaatgtgccttcttcctgggaagatccagcac

SEQ ID NO: 125600 - DNA, 601 bp, Human
cggcaactaaccgggtccagccctgcccgaggtcttggagccccggatggatgagcaaatgagcacccggcaaagcaccctcaaaccctcgacccaggctccccgctccagctactgctctgagagtcagacgcacagagcacaggctgctcaggggtcacacgcacacaggccaggacagtggcaaggcagcggcaccaaggctccggccttctccaccccaatctgcatgactttggggaagtcacttcctctctctgagggcctctgggggcttccccatccattttctttaggccascaggacacagtctctcccctacagatttctgctggccgggaaagggaaggacccccccaccccagggaaagcatgtcaagggtggtctgagaagcactgtacttatttgccagcccccagaaggggtgatgggctttctttgggcggagagccagggaaaatgtgccttcttcctgggaagatccagcactgaggagggagcttggtttctccacttcacagggtctggatctcccactttactccaagattcttgtggatttgcttttaattgagcccaaattgtgttacgccaccaga

SEQ ID NO: 125601 - DNA, 601 bp, Human
ggacatctggaaatgcgcaactggacaccccagaatctgcagagtgccctgaggccctttgttttatggggaggcttctggcgggtgttttcctcacgcaaagggaagtgaaggggccctgcctttcaggactttttccttggaaggttcaacccccccagagtggcctggatttcctaagcccctcccaaagtacttcgtggacctctgggtacagcgggtccctgtgtttgtgctgttagatgggtggtggtacttaggtgctggctgtgtagatgaatttcatttttcttttcttttytttttttttttttttttgagatggagtcttgctctgtggcccaggctggagtgcagtggtgggatcttggctcactgtatcctccgcctcccgggttcaagcagttcttctgtctcagcctcccgagtagctgaggttacaggagcgcaccatcacacccagctaattttttatatttttagtagagatggggtttcaccatgttggacaggctggtctcgaactgctgacctcaagtgatccacctgcctcggcctcccaaagtgctgggattacgggcttgagccactgtgcccgtcc

SEQ ID NO: 125602 - DNA, 601 bp, Human
caactggacaccccagaatctgcagagtgccctgaggccctttgttttatggggaggcttctggcgggtgttttcctcacgcaaagggaagtgaaggggccctgcctttcaggactttttccttggaaggttcaacccccccagagtggcctggatttcctaagcccctcccaaagtacttcgtggacctctgggtacagcgggtccctgtgtttgtgctgttagatgggtggtggtacttaggtgctggctgtgtagatgaatttcatttttcttttcttttttttttttttttttttttgagatggagtcttgctctgtggcccaggctggagtgcagtggtgggatcttggctcactgtatcctccgcctcccgggttcaagcagttcttctgtctcagcctcccgagtagctgaggttacaggagcgcaccatcacacccagctaattttttatatttttagtagagatggggtttcaccatgttggacaggctggtctcgaactgctgacctcaagtgatccacctgcctcggcctcccaaagtgctgggattacgggcttgagccactgtgcccgtccttagatgaatttctgtg

SEQ ID NO: 125603 - DNA, 601 bp, Human
cgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaactacttggggctgctgccatttggttgggtgtgaaattgacaggacctaagagttttactgaggcccagagatcaattctaggtcttcacatattcatcagatattcctggggctcctgtcttgtg

SEQ ID NO: 125604 - DNA, 601 bp, Human
ctccctatatctacctactcttgcccctctgcagtccgtcttccatgaggtagccatggtgatcttttcaaggtgtcagtcagaacagatcattcccctgcttaaactcaatggcttctcactgcatctagaataaaatccaaatccttacactagccaataaaatcctacattatctgataccttcctaccactatgattcacagctttctactttccctctgactgtgctccaacagcactaatcttccttctcttttttaagcacaccaagtttactcctaccccaggtcctttgcarttgatgtttatttcttcctgaaacactctttcttcagatctctgcatggctgcctccttgtgatgatttatgcctcaacccaactgtcatttgctaaggaaagctttccatgactaacctggctaaagtcatgcactccctaccctcaatcactctgtaccacaccatcctcttttacttacttcagcacttattagtgtctggaataattttatttgtttatattttatgatatctttcatatttctataatgtaagtcattgagggagggattctggttttgtttcctggtgtgtctc

SEQ ID NO: 125605 - DNA, 601 bp, Human
ggatccttcctgaaatctaatttcccagatgacagcaaaaagcagaccttgcagcaggcctgtctaaggatagcagtttttcacttctatgttaactctgttctgcagtcatcccacccaattcactgaaaactttagcaccagctaaattcctgccataatgctgcactacctccgtatcaacgtggaagagccattcaacacccttgcctctctttttcatgaggtcagcaacctcttcttccactcaaattcagccacctattcatcaattatctgcacttacaccttgccatcactrtaccacctgcaaaaatctctaagacattccgccctctgaccatcatttcctatcctgctactttttctagtactttcactccaataattctccaaactcattgagccctctgatcctaaccactttttcacaatcttccacctttacctagcctttctttcttgttcagattccttgttctagcaccatacacaatcaattaaaaactataaagttttaacttccttgattctcttcttctccactgtactcacctgtcaaagcctcaaccttggttaaatccaactctcctcttaatct

SEQ ID NO: 125606 - DNA, 601 bp, Human
ctgggcctatagttccaaaatgactgggtaaagcaaacctcccaatcagtagcagcagcagatctccccagccacttgcccccacagacactccaatcacatattctcacaggttcctcaaccaatgatacccacaggacactggtaatctatctcctattaccccaaatccctcatcttatcaatccccaatcactaaacagaattctcaagcagtggcctttatagaaactctaattactgccagcaaattccactcctccctcaacctctttagccactcccttcatttgcatgcttyacctgaaatctacctgtctcctgaggatcctgcttccttataggagcctcagaggagtggaggctgtctttcctgcaccacccctctccctgccatgacccatgtacctcagggtctaaagatgaggtaaatgattactttcaacaatttctcattcttccttcaaaattcatagcttatttatagtatcaccaggttttcagccattaacccttctgggtccggtgatttgctaggaggactcacatgactcagtatataattgtactcatagctattatttattgtagcaaaagtgta

SEQ ID NO: 125607 - DNA, 601 bp, Human
tgaaagtatccttaaaatcaagaggtatgatattaaaaaataagcagaaccctaactaggggggtgggagtagggaagaaattaaagtatgttgaagtcctcttattaggcaggtgggggaggacggcacagctattggagaattttgatactaataaatatattcaaacatgtttgtctaacatttaaagataatcccttatccttacaggcaaccaaattttttttccttcttttttttgcagtggggtgggggagcagataaagtctcactctgttgcccaggctgaagtgcaatagygtaatcatagctcaccgacaccttgaattcctggactcaagcaattctcccaccacagcctcccaagtagctgggactataggcaagcaacacccatgcctgactgatttttaaatttttttgtagagacaggttcttgctatgttgcccaggctgggctcaaactcctgggctcaagcaatccttccacctcagcttcccaaagtgctgagattacagatgtcagccactgtgcctggccagaccaccattcaattacctgcaaaagtcatcaaattagccccacagacctgtagtcac

SEQ ID NO: 125608 - DNA, 601 bp, Human
ggtcactgctccttctgaagactgagcaattgagcacaggaataaggatatgtggctatatggaagggtcagttaggcatctgaggggctggtaccaagtttcagagccttgattttcaccttttatcctaccacaacctgagtggtgtgacagatagtattattgcttcctgtggcaagattatacctcccagccccttccaaatgcatagccttttgaattatagcgcacttcccagtggaaggattatacgttcctaccatgttgaactcaggagtggccagatggcctgctttgacyaataaaatatgagctgaaagggatatctacaacttccaagcagtgactttaagagttaccatgtggttccactcaccctgtttttttttgcctctgccatgagaccagaatttgctaaatggagaatgctctttcagcataggtccccaaataaagataatatggaatagggctgtggcttgagcaagcaatcaatttttcttattgtaagtaactaaaatttcaggggctcattccttcatggagcaaaactgagtggaaattgactgatacaggtgatataaccaaactcccgtagtt

SEQ ID NO: 125609 - DNA, 601 bp, Human
catgacttcagagagaaagaagcaggaagtgaatagccaccttgatggtaaagaaacattacactgagaaagtgaaaactggactcaaaccaaaaagagttacggtatctgaatggatagaaaggaaatattattacttttataaaggacattagagagattaattcccatgttgcagaagatcagtttttgaaaaataaaatatatatctgtctatatatatagacagatatatatctatatatagacagatatatatctatatatgtagacagatatatatctatatatagacatatatctatatatatatagacagataaatatctatatatatacaggcagatatatatctatatatatattagggagtctagagaagtgcagttgctggctgctttttcatttaggaaattttaagtgatgcagagagtataacaaacttttaggtaccatgacaaggctgtgtctttcaatgcccaaggatgatggaaaacattgaggaaaaatttccttctggaaagaaaggaatcaaaactgaaaactttccccttgacatgtaatattataagaacctttacaatgatgaatttggctggtc

SEQ ID NO: 125610 - DNA, 601 bp, Human
atccccatgacttcagagagaaagaagcaggaagtgaatagccaccttgatggtaaagaaacattacactgagaaagtgaaaactggactcaaaccaaaaagagttacggtatctgaatggatagaaaggaaatattattacttttataaaggacattagagagattaattcccatgttgcagaagatcagtttttgaaaaataaaatatatatctgtctatatatatagacagatatatatctatatatagacagatatatatctatatatgtagacagatatatatctatatatagacatatatctatatatatatagacagataaatatctatatatatacaggcagatatatatctatatatatattagggagtctagagaagtgcagttgctggctgctttttcatttaggaaattttaagtgatgcagagagtataacaaacttttaggtaccatgacaaggctgtgtctttcaatgcccaaggatgatggaaaacattgaggaaaaatttccttctggaaagaaaggaatcaaaactgaaaactttccccttgacatgtaatattataagaacctttacaatgatgaatttggc

SEQ ID NO: 125611 - DNA, 601 bp, Human
tattcttttgcctaagaacctgaaattgaaatttatagacttctgttagctagctatggatactacatgtataaaaacctataatcttaagagctggggccaccatttaggggtgtcatttttcagctacatgctatagcatggaatagcagaaaaagcttcagagtgagaattaaacagtcttagagagaagcagatataaaaatccccatgacttcagagagaaagaagcaggaagtgaatagccaccttgatggtaaagaaacattacactgagaaagtgaaaactggactcaaaccraaaagagttacggtatctgaatggatagaaaggaaatattattacttttataaaggacattagagagattaattcccatgttgcagaagatcagtttttgaaaaataaaatatatatctgtctatatatatagacagatatatatctatatatagacagatatatatctatatatgtagacagatatatatctatatatagacatatatctatatatatatagacagataaatatctatatatatacaggcagatatatatctatatatatattagggagtctagagaagtgcagttgct

SEQ ID NO: 125612 - DNA, 601 bp, Human
ggaggtctgggcaaagctaggtgtctgcacgggggctgcagggcagtggcaggcaggacaaagccttctctggagcaggttcccattaacacaagggttccccttggagcccacgaggacagtgcagaaggtgaggatgtttgactcatagaatgtcagccaagaggcccacggaatggcaggggatagagctgtaccttcaaaggatcccataatcccagatgatctgagtggaagcctgagaccccgagacaggccgcacttgcccagcagggcccatctgcctggactccccatcacyacatccaccctaccacagagagcggcagccttacccgagagatattgaagttttcctgcacttggatgttgtcgggcggcgttggcacagggccagcgctcaccgccaggcaggcgctcagcagcaagagcagggccccgaggctcctcatggctatgggctcctctgccttggtatatcccacaggctcggtctagcaacagaagggccaccgcctccctgcaacagggcagctgtgaactgaggctggggaaggggcctgtggcttgtagttgacctcagtgtttgccctgctcagct

SEQ ID NO: 125613 - DNA, 601 bp, Human
tgctggccacatgcccacgctgtgccaccccaggtgtctgtccacagtcaggccaggatgtgggcaggggacacaggaagagctaagggaaagatgccacagagagaggggagtcattagagaaggaagggctgggaggtctgggcaaagctaggtgtctgcacgggggctgcagggcagtggcaggcaggacaaagccttctctggagcaggttcccattaacacaagggttccccttggagcccacgaggacagtgcagaaggtgaggatgtttgactcatagaatgtcagccaagagrcccacggaatggcaggggatagagctgtaccttcaaaggatcccataatcccagatgatctgagtggaagcctgagaccccgagacaggccgcacttgcccagcagggcccatctgcctggactccccatcaccacatccaccctaccacagagagcggcagccttacccgagagatattgaagttttcctgcacttggatgttgtcgggcggcgttggcacagggccagcgctcaccgccaggcaggcgctcagcagcaagagcagggccccgaggctcctcatggctatgggctcctc

SEQ ID NO: 125614 - DNA, 601 bp, Human
ggcacaaagaagggcatgtaacctgaacctgggtgtctgggagggcttcctggaggaggtgacatgaaacctgagttctgaagaatccacaggaactaattagcccagggaaatgaggagaggtgctcccagtaaaagggacatcaggtgcaaggacctggaggcgtgagagttccagaactgaaagcaggttcacgtgagtaggactcagagtacatagcagagtgtgtggcaggagttctgggtgctgggagggtcctggaaagccacatcaagagtttgaatcttactcccagggcaytggggagtcatggaagggtctcgagcagatgtgagttttcaaaaggtctttctggttactgggtgaagaggggatggggtggaagggtggaggtcagaggtgaggaaagagtagagaggttgtggcagacaaccaggaaagaaagggaggtggcttggaccaggatggtggcagtggagaggggagaagtgaacaggttgggggggatttaggaggagaatgggcaggacttgatgatgggtgacaggggagagaggagcccagttcccaggttgggtccctggggggctgaagtaccca

SEQ ID NO: 125615 - DNA, 601 bp, Human
ccaggtctcctgagtccccacaaaggactcttccccttttttttttttttgagacggagtctcactctgtcgcctaggctggagtgcagtggcgtgatctcagctcactgcaagctctgcctcccgggttcccgccattctcctgcctcagcctcctgagtagctgggacttcaggcacctgccaccacgcccagctaatgttttgtattttcagtagagacggggtttcaccatgttagccaggatggtctcaatagccaggatggtctcaatccctgttttttttttttttttttttttgagacagggtcttgctctgttgcccaggctgaaatgcagtggcacaatcatggctcattgtagcctcatactcctgggctcaagtgaccctcctgcctaagcttcctgagtagctgggactgcaagcacacatgcactatgcccagctaattctttaattttttgtagagatgctgtctcagtatattgcccaaggtggtctcaaactcctggcctcaagcaatcctcttgccttggcctctcaaagtgttgggattacaggtgtgagccacagcccccagtccccactggttcttttaa

SEQ ID NO: 125616 - DNA, 601 bp, Human
ccacaccctgggcaaccactctgaagtcctgcaggagagtttccctcagctgcggcgcccgccctgcaaggaggaagcagaggagacgcctagaaccaccaggtgcttggagtggaagggcctgaaatgattttgcccagtgattttcacttagggaaaatttgaaaactattgatgcagtttaatctatttgatacactgaaggaaagacaggctcccaagaggaagaggggtctctcccaggttcccacccaggtctcctgagtccccacaaaggactcttccccttttttttttttttgagacggagtctcactctgtcgcctaggctggagtgcagtggcgtgatctcagctcactgcaagctctgcctcccgggttcccgccattctcctgcctcagcctcctgagtagctgggacttcaggcacctgccaccacgcccagctaatgttttgtattttcagtagagacggggtttcaccatgttagccaggatggtctcaatagccaggatggtctcaatccctgttttttttttttttttttttttgagacagggtcttgctctgttgcccaggctgaaatgcagtggcacaatc

SEQ ID NO: 125617 - DNA, 601 bp, Human
tacattttgcgactatgtaatacaatatatgatttagacagaactacccttatgtacctactaccatttgctcttgctctcagttgctttatgtgtgctacaaggattccattagatttttccctcacagtcacagcgtacattcagttaacaggacacagttcatctaggttaaaacacttttaagttctttgctggttaccattcacatttatgaaaactgcatatttatttgttatctctattgtatcatattatacaacaatttacaaaatgggtcaaaggcttataaaaacagtgragtattttaactcactacaatgtttaaaccataaataataaacagtgctctggagtgaatattgaatgtgaatatgagtacactgaggcaaatgaagcatcatttgtgggtccaatcagtaagtgtggattttatcagattatcaacccattcatcttcctgttctcaggacaagatgctatgcaactggcaaacaggggtgaggagccaccaagacttttgcattgtttaaaactcaataaataaacttttaagtgcttttcctccagaataagaaaaaaagttttctagtacaaaata

SEQ ID NO: 125618 - DNA, 601 bp, Human
atatgaaagagacacattagatgactctttctttctgttcatcactaacactaagctagaggggaagaacaatttaatttgtttctgatgattttgtggtatggaatgtaaactggaaacctctgctttaggatgaaaggaccagctaggaatacagcaaggatgatgcagtaatgcaagtgaaaagagctggcatataaatactcatccacatagacatcagttatttgccagcagtgttctttctgaacatgatttaacattaaaggcaatagaaatattgcaaacatgatcagatgaktggtaaattatatcttttaaacttgctgtgtaacaagatagtagcatgtacaagattctgttcctctttgctccccactccacaactaaagtttgccaactgttaatgaaaagataccaactcaagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgg

SEQ ID NO: 125619 - DNA, 601 bp, Human
gatagtagcatgtacaagattctgttcctctttgctccccactccacaactaaagtttgccaactgttaatgaaaagataccaactcaagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgggcgcctgtagtcccagctactcgggaggctgaggcaraagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatgtttatttcttaaatgtcctacacctaaaattttatatctgaat

SEQ ID NO: 125620 - DNA, 601 bp, Human
actgttaatgaaaagataccaactcaagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgggcgcctgtagtcccagctactcgggaggctgaggcagaagaatggcgtgaacccgggaagcggagcttgcagtgagccgagattgcgccactgcagtcygcagtccggcctgggcgacagagcgagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatgtttatttcttaaatgtcctacacctaaaattttatatctgaattgtcaaaatgtttaagattgaagagattagtgtaagggtttataactgttgcattatggtgc

SEQ ID NO: 125621 - DNA, 601 bp, Human
caagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgggcgcctgtagtcccagctactcgggaggctgaggcagaagaatggcgtgaacccgggaagcggagcttgcagtgagccgagattgcgccactgcagtctgcagtccggcctgggcgacagagygagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatgtttatttcttaaatgtcctacacctaaaattttatatctgaattgtcaaaatgtttaagattgaagagattagtgtaagggtttataactgttgcattatggtgcaaatcagctgattgccaagaattt

SEQ ID NO: 125622 - DNA, 601 bp, Human
gtggcgggcgcctgtagtcccagctactcgggaggctgaggcagaagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatrtttatttcttaaatgtcctacacctaaaattttatatctgaattgtcaaaatgtttaagattgaagagattagtgtaagggtttataactgttgcattatggtgcaaatcagctgattgccaagaatttgactcctcaagcacagaatagaaagctcctcacttgtttgagctatttaacatacaatgctgtatgtatttaagatccacattcatatgaagcaacagaacaagaagatacagtttccaatgcagtaaaattggggaaagggaaacttctcactgttctctcccacattaa

SEQ ID NO: 125623 - DNA, 601 bp, Human
ttgcgccactgcagtctgcagtccggcctgggcgacagagcgagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatgtttatttcttaaatgtcctacacctaaaattttatatctgaattgtcaaaatgtttaagattgaagagattagtgtaagggtttataastgttgcattatggtgcaaatcagctgattgccaagaatttgactcctcaagcacagaatagaaagctcctcacttgtttgagctatttaacatacaatgctgtatgtatttaagatccacattcatatgaagcaacagaacaagaagatacagtttccaatgcagtaaaattggggaaagggaaacttctcactgttctctcccacattaatacatcaaattccagcttttgataaagttgctgtctgagggaacattgaacaactaaacagaggactctccatggagaaagtaccccat

SEQ ID NO: 125624 - DNA, 601 bp, Human
tgaattgtcaaaatgtttaagattgaagagattagtgtaagggtttataactgttgcattatggtgcaaatcagctgattgccaagaatttgactcctcaagcacagaatagaaagctcctcacttgtttgagctatttaacatacaatgctgtatgtatttaagatccacattcatatgaagcaacagaacaagaagatacagtttccaatgcagtaaaattggggaaagggaaacttctcactgttctctcccacattaatacatcaaattccagcttttgataaagttgctgtctgakggaacattgaacaactaaacagaggactctccatggagaaagtaccccatcatttgtgggtccaagattgaacttcatatctagactatccagaaaacatttgcagtcactggtgataactcataattgtgatttgggaatttctaatttagcccaattttttttttaagtcatcagatttggagcctcatctacagctcatctcagctcatggtggaaacagatatagatgaattggttaaacactgcaaatgatatcattcttgctgatctaaaactattagtatcataattattatt

SEQ ID NO: 125625 - DNA, 601 bp, Human
gaatgatgcaagttaatttgctctgtctgtaaaataatttatgaagaaatatggatagactcagcactcagtgaggcccttaatggatgagtgctgtcttaaatgatccatagcaacaggttctacatttgatagatcgggtaaaggtgaaggcaatggatgaacgttttgataatgacaataatatttatacacacttcttgagtctctactgtgcatgaagcactgtgctacattattgtctccttgagttctcccacccaacagccatgtgagataggtcttattataatactttacrgataaacaatgaatacacaaagagattacagaggttttctcaagcttccacatctggtaagatgtagaaccaatacatgaacagagggcccagattctcatctggattccccattgcattgttgtgtgatgtgacaactctgcaaaactaacaagtaaaggagtggctgcatgctgtctgttatatcctaggcactgtgccagaaactggggtgctaggatgatgaagactctgtcacttcctttggcaaattacagcctcttataaggggctctcaagtaacaggcaaaggcagtcagt

SEQ ID NO: 125626 - DNA, 601 bp, Human
ttaattgcctgggtgaaaggaaaagtctaaggcctcttccatgctgtgacaggtcccagctggtctctggggagggagggacagctgtcacacactctgcagagacctcccaacgcaaagtgggaatggggactgtgattccttgagcatcttctatgtgtcacccactgtgccaaccactttaagctactcagaggcataggactaattatctccattttagcacatgagaaaactgaagttcagcatccacaggagcactgttcaatggatttttctgcaatgatggaaatgtgttctrtgctgtccattacagtagccactagctacatgtggttcctgaatacttgaaatgtggctactatgactgaggattggaattttaattataattcatttcaattaatttaaatgtaaatcatcacagaaatatcagatcaagaggtcaagtgactttgtcaagattatacagttagtttgagacatggggttctaaacccaagtgttttgttttttaaaggatgaccgttttccagaaagcagtaacccatccagactttcaggtgttgttcctccttctcatcacctaagcccaattcaa

SEQ ID NO: 125627 - DNA, 601 bp, Human
ctgcaaactatggtccataggccatagccagcctgccccctgtaattgtaaataaagatttattggaacacagtcacactcatttgcatattgactgtggctgctttcatgctacaatgagagttcagtgatgacagcagagattctatgacccaaagaaactaaaatatttattatctggtattttacctgtgaagtttatcaacccttgttccatgaatttgggatattttatatgcttgtttactggagccaggtgcagagagtaggtgaaaattataatgtggttcaccatttcttrttaacaaaaaactgaattttaaacatacagtgtagctgggagtggtggcgggcacccataatcccagctactctggaggctgaagcaggagaatcacttgaacccaggagacggaggttgcagtgagccgagatcatgccattgcattccagcctgggtgacagagcgagaccctgtctcaaaataaaataaaaaagatgagggagtttccaagaggatgagactgagatcctcctagattcattttatagactgttgttctctaccagattctgtgttctgctgctgatggtgatattt

SEQ ID NO: 125628 - DNA, 601 bp, Human
gtgcagagagtaggtgaaaattataatgtggttcaccatttcttgttaacaaaaaactgaattttaaacatacagtgtagctgggagtggtggcgggcacccataatcccagctactctggaggctgaagcaggagaatcacttgaacccaggagacggaggttgcagtgagccgagatcatgccattgcattccagcctgggtgacagagcgagaccctgtctcaaaataaaataaaaaagatgagggagtttccaagaggatgagactgagatcctcctagattcattttatagactgytgttctctaccagattctgtgttctgctgctgatggtgatatttgcttaatacttcttatataccaagcacatttataaactcttattctcgtaacaactcttttactgaactgctctttcaaaagaggaaattgaggtatggggtgatgatctaaggatacacagttaaatggtggagctggaatttaaacccagagagcctgactccagagctcactgtggtaagctacctgcaaaaaaaaaaaagatagctcctggtcttgcaggctttcagggtgaatgaaaaaaaaacattgcaa

SEQ ID NO: 125629 - DNA, 601 bp, Human
ccccgtcttctgggtagcttgagtgtgggtatatacaacctaggctttccctctgccctccagtcagacacaccaacccaagactttgaattggaagctagtagtgattagacttagggatactgtagacaccattttgctgaggatggtgggagtagccacatccataccagcctcctaagtaccagggaaggcatctagcatcaaagctgagctagctatgcacagcaccagctctggatcccctcactaaactagttctgggacctaatcttgggcttggaattgagcttcagagcaygcaagcctggctctccagagagtgttccatacgtaaccaatattctttgaacaaattttgcttgtttgttttgcttaagttatccaaagttggtttttgttgactgtcactcagaatcttgactgaaaattattgccataagataatgtgagatttaaccccatttctagcaagttggatgtgcttgatgcacagatgcacattagctattacttttctctatgtgtgtttgtgtggaatgttgcgggcacaggataccagcaacaaccaccatttatggatacccactaggtgataggt

SEQ ID NO: 125630 - DNA, 601 bp, Human
ccacccacatgacctctcaggcaaggcaggcttcatccctttgcaatgtggaagttatcttgtctttttttcccctcttttaaaaatataacatacaccaggcctgaggtttcagtgaaaaaatgtggtatcagtaaaatgataactctccccaacaggcactggctgcaggcattgttcacagcattgggaattctgtctctaaagcattgagtcataaactacagacaggctgctgataaaagctgaaggaggtgggataatagtcaaattagtcagacaaaatgtgaagggtccccaraaggggttatactgtgtaatatatctttagctggtgctggaaatgtgttaccttctgagatggaatctagtgcattacaggagatgcagctgtggagaagccctcatgctctgttttgactttccaccctgtattcttcagcatagttgggtccagttcccagtttagatctagaggcctcctggctgcagcttagcacctcagagcctcagtttcttcctttgtgaaattagggagactggactgaggactctaaagcttcttccctcatctgatactgaggaatctccgatttgtcaa

SEQ ID NO: 125631 - DNA, 601 bp, Human
ttaatattttattttttattttaattttttattttttgagacagaatctcactctgtcacccagctggggtgcagcagcatgatctggactcactgcaacctccgcctcccaggttcaagtgattctcctacgtcagcctcctgagtagctgggattacaggcgcgtgccaccacacccagctactttttgtagagacagagtttcaccatgtcggacaggctagtctcaaactcctgacctcaggtgatctgcctgccttggcctcccaaagtgctgggattacaggcgtgagccaccgygcctgactgaatatgattaattcagaagttatatccatcttcccagaaaccctatgagataaataatgttatccccgttttgtagaggaaaaaactgtggttcagagagatttagtaacttgcctacagttacacagagacatagcagacgtgagattcacagcatctaggcagagtctacacattttaaccatgaagttattccatttattagatacccagctgtgccagtttttctgctaagaactctttgtaaaaatgatttcattcaccctcccagcaactctgtagagtcaaaat

SEQ ID NO: 125632 - DNA, 601 bp, Human
tggaaatacttggaagtatataaccaaagggcctcctttacattgagggggtcaaggagatctccttgaagatttgacatttaagctgagacttgagggttgagtaggatgtggactcattagggagatatggaacaggtaactgagcaaggattgcaagaagttaagactattcaattcccaaggcagagaagaacttttgaagagggaaaaggaagtcagcattgctggactgtagtgaacaaaggagggatgaggctgaagtctagcagtctctgatttctcaggcccttgaggactrtggtgaagctgctatttacggcatgaaggaaggagaagttgactcaagcatataccttctacactctctaccaagccctgccctgggcataatagccatgtgcatgcttgcacagaccaggtgtcagtaaaccaccacccatggccaacccagcctgctgcctgttttcatagacaaagttttactgaaacacaactatgctcctttgtttacatatttgccactacaaaggtggagttgagtcattccaacagaaatcttgtatggaccacaaagccaaaatatttaccatctggtcct

SEQ ID NO: 125633 - DNA, 601 bp, Human
ctgagcccccaagtagtgccaaatcatagggcatccgagagagaatcagatcagcccatctcatcagattctcctgaatatccacatccattcaaaatagattaactggacagcatgggaatgacttaccctcttgaaacctcaatttcattgtctgtaaaatggggataataataggaccaaacacggggctcttctagatttgaatgccttatgtacttgaaacatttagcacaatgcccagcatggagaaagtcatccagttattcatttcacaaatacgctaagtacaattttaacyggggaagcggatgatggtataggaagacctagtgagggtccattagcccttctgggggtgggtttccaggcaggtttttgagaggttaaactgtgaataaaggacaaatggggactagtcacagaaaaggcagctctggggatttgaagaaagcttctgcaaacgtggggaggtgagagggaacatggtccactcagggcaacgacaatttgtgtctggagcttagactagagtgcgttcgagaagagagaagcctgcagaggcaggcaaggaccagagtacaccttgtcaatcatcatc

SEQ ID NO: 125634 - DNA, 601 bp, Human
agcccttctgggggtgggtttccaggcaggtttttgagaggttaaactgtgaataaaggacaaatggggactagtcacagaaaaggcagctctggggatttgaagaaagcttctgcaaacgtggggaggtgagagggaacatggtccactcagggcaacgacaatttgtgtctggagcttagactagagtgcgttcgagaagagagaagcctgcagaggcaggcaaggaccagagtacaccttgtcaatcatcatcaagctcctgttgggaaaagttgaatgaataactcagtatcttctrgggcaaccactttcaattttagaccaactgtactttgttagaagagttttccattgtgtcctccctgagccttcttttcttcaggttaagcatcttcatacctacatgattattgctcagtggttggtgcctatccagggtcctattctttgaccatatcctaccacatcagtggcccagaattggcctcttcagccatgactggtccagctaggactggagacaacttctctggcctctagcttggaatctatagccaatgactcaatctgcagtctcatgcttttgtttgggcaaaca

SEQ ID NO: 125635 - DNA, 601 bp, Human
ataaaggacaaatggggactagtcacagaaaaggcagctctggggatttgaagaaagcttctgcaaacgtggggaggtgagagggaacatggtccactcagggcaacgacaatttgtgtctggagcttagactagagtgcgttcgagaagagagaagcctgcagaggcaggcaaggaccagagtacaccttgtcaatcatcatcaagctcctgttgggaaaagttgaatgaataactcagtatcttctagggcaaccactttcaattttagaccaactgtactttgttagaagagttttcyattgtgtcctccctgagccttcttttcttcaggttaagcatcttcatacctacatgattattgctcagtggttggtgcctatccagggtcctattctttgaccatatcctaccacatcagtggcccagaattggcctcttcagccatgactggtccagctaggactggagacaacttctctggcctctagcttggaatctatagccaatgactcaatctgcagtctcatgcttttgtttgggcaaacacatccttcatttggcggaatctgacttcagagtgactgcttcttggaacttt

SEQ ID NO: 125636 - DNA, 601 bp, Human
ttcgttcagcaaatatttctgattatcttctatgtactagtatctgactgcaacaatgcacacaacagcctatgtttctgctctcaaggagttgccattctgttttagagagaatacaattatcaagcaaacatttgaagaagtgagatcatgctatgaagggaataaaatagactagtggtatagacactctagtgaaggtgaaaactattttttgatagtgtgtttagaaaagtcctcactgagaaggtaatggttgagctaagacctaaacaaaaaattagaaaagccatttgataaytggggagatgaggtctggattgtatctgcaaaagtaaaatgtgaaaacaacacagcttatagtttttatgtttgagtagtttttagttttcacagcattattttactttatctttacacccacttttgaaaatgggtaggaaaataatgctgtcattttttttaataagcaaaaagaatcagatgcagaatgatgatgtatgttactggtaccatgaaagtaagttagcaacagagttgaggcacacactttaccttctggccccttattccatctgcttttcgttatagttctatgcat

SEQ ID NO: 125637 - DNA, 601 bp, Human
atctcttggctgctatataattcatgtgacactggattttaccgcctctttcatatcttgagatatcattgaaacccaaaagagaactggctgaaagtcatttagggctttgaacattctgctctgttggctgcattgtcatttataaggattactatctttgcttacaatctttttaagccattcaaattactatactaaatttaaggtgatgtaaatgcatcttcaagttccaattcataagactgtcaaatctctttattaaattttactctaatatgtgctacctttcctatccagwtattccatttcttttcaaattcagttaggatagaaaataaaacaatatataagacagatggtgaggcatgatgtctcataggaaaaaaaatatattgtgggacaatttgtgtagaattggattttccccctaatatgtgcttggatttatgctctgacctctttataattaatattttcataaaaatttttacataatactatctgctaaagcagattgaaatcaggtttgggacatcttcagaatcattgataacagagattctaaaactccaaaataactttgttaattcatcattta

SEQ ID NO: 125638 - DNA, 601 bp, Human
tgtgataacacaggaatgacactcagctagggtggggtcaggaaaaagggatgaggaatagagaagacttgcaaaggagatgctctagatgaaccttgaagaaccagtgggagttagcaaagtgaaaaatggaaagcacatttcaggcagagaaaaacaacctttgtaagggtgtggagaaatgaaacggaattgttcgtgtggaatgtgcatgaagaggacagtttgtggatggtcttgtatgccaagctaaggaaaatgatgttttttaaaattatttttatgtgtttattttttttttgagacagagtcttgctctgtcacccaggctggagtgcagtggcgtgatctcagctcactgcaacctccacctcccatgttcaactgattctcctgcctcagcctcctgtgtagctgggattacaggcatacaccaccatgcctggctaatttttgtattttttgtagacacagggtttcaccatgttagccaggctggtcttgaactcctgacctcggatgatctgcctgcctcaacctcccaaagtgctgggattacaggcatgagccaccatgtctggcagaaaatgaccttctataa

SEQ ID NO: 125639 - DNA, 601 bp, Human
cacaatagctttgtcagcagaatcttggagaagaaactgcatcttctgtctctctttctctctctctcccttgctttctttttaactccatcttatttttctgtcttttaactcttcctctacgtatctatatatcatctattacttatcgacctgcctgtatacctgtttacctacctgtgtctatttctacctttcctccattctcaggttctgctgattcctagcagacaaatttattgtggtctttaacataatcaggaagaaattagcctttagaagaactaaaatctaaccccaatttctgtcattccgagaggttttttgctaaggaaattaagtcactttagagactagatcttacccttacagagaacataatcttaccctatttttctttacattggaggagaagaaagtgataccaagaattaggcacccctatgatcttatttccaagaggttgttttcgtcattctgtagctatggcatgtagggagaagatttctctgctaggtgtaaaaaggccagtcttctacttcttgctctgctaccacctgtctctgtgacctggaagcagatggcttcttcctcaagctca

SEQ ID NO: 125640 - DNA, 601 bp, Human
gaagaaagtgataccaagaattaggcacccctatgatcttatttccaagaggttgttttcgtcattctgtagctatggcatgtagggagaagatttctctgctaggtgtaaaaaggccagtcttctacttcttgctctgctaccacctgtctctgtgacctggaagcagatggcttcttcctcaagctcacagttttccattagataaaatggatgaaggggccagcattatacccacaatcatctgaaatcactgcaacaacgctgggtaaatatcattacctccattttttttttttttcagatgaggaaaatgaagttcagagaggttaggttattttatttatgtcctctttgtagtgcttataggaagcagaattcagatttgtacctacttctgcctgatgtcaaaacccttgctcttttcagttctctgtattgggtttctgaagagtaaagtctggatttatggctggtcactcttggattgggcctaggttatacgatatgtagagtggccacattcacatgaggttggagctactgagaagtactgagcctgtattctttctatattgaactgccatgaatgctactggtc

SEQ ID NO: 125641 - DNA, 601 bp, Human
tacttctgcctgatgtcaaaacccttgctcttttcagttctctgtattgggtttctgaagagtaaagtctggatttatggctggtcactcttggattgggcctaggttatacgatatgtagagtggccacattcacatgaggttggagctactgagaagtactgagcctgtattctttctatattgaactgccatgaatgctactggtcacttataatgaattgatttattctgtttcttttgctcattctttctttcttttctctttctgtttttcttttgttttgttttgttttgtttgtttgtttttttcagacagggtcttgctctgtcacccaggctggagtgcagtggtgtgatcactactcactgcagctctgacctactgggctcaataaatcctcccacctcagcctcatgagtagctgggactacagatgtgcaccactgtgcccagctaacttttgtatgttttggagagacagggtctcatcatgttgctcaggctcatctgattgctcaagcaatctgcctgccttggctctccccaaagtgctgggattacaggcatgagccactgtgcccggccctatttgggctc

SEQ ID NO: 125642 - DNA, 601 bp, Human
ctgtgcccggccctatttgggctcttttgatagtatttcactgggtaaactgttggcagaaataaacaagggattttgcagcttggaagaagttcagcattctggtgcccctgaatccaatgactcttcttttcagatacttagcatcatagaaatctgtcttgtttctccttggcaggggctctttctagctaggggaaagttgcttgaatgtgtttcaagtgagcactgatttcacaagctgatttaattcctccacttagaagcaaatcaacccattaaaagaagagtatttttttttctctcgatgattattctaggatgtacaaagcacatttatgttcatttcctattagagttctatggttatcctgagaggttttcctggttgggactataatttctacattacagactggggacagggggaagaggccaagaagtaagtgaagccagttgtgcaaagatacatagctaatgtaagggacagaaaccaaacccttgtctttggccctaaattcagtgccctctccagagctccactctattattttgtggaagaatgttctaaatcaagcagaagccttagggtgaccatata

SEQ ID NO: 125643 - DNA, 601 bp, Human
atgacatgggagcttgagaattcacttggtctttaactaaaactcctagggtatccgacaagcccttagaagcctatagcattagacaggaagggttcttggtgtctcaatagtgtaacctctttctctgctctgatggttgagcccagtgtggcaaggagacttattcaaattaacagagcaatttggtttcagagctggaattgaagccaatgtcccttgtaaatcagttcatgttttaaagcaaaactgaaatcctctttggagttaaacaacccccagtttgcctctgtgaaattcytttgtgtcaaataatgcactcagaacttggaaagtgaatgcctgagttggagacccagatcaggtattaacacactgtgtgatcttgggcaagttattaaagatgtatggaatctcagtttcctcatctggaagaataatatcttccacatgaagtttttatgaggaatatttcgaataatgaaggtgaaagtgtttgtgaactttttattacagtatagacacacaacacaaggtctaccttctttatatattttaaatgtaaagtacaatattgttaactataagcacactattttac

SEQ ID NO: 125644 - DNA, 601 bp, Human
ccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtaagatcctaaccatgtgtggcatttcctgcagacattcaaagtctccgctatgccccacaaggctactcacctctaaggcagtgtcattggctatagccacttgagcatatctttattaaatgtacygttagggcttcatgaataccatttgtaaaagattagatctggaattgttagggcagggaacattgtatgatagggtaatgactgtcctcctatttccttgcctgtaataactaatatttggagaaagaactccattttgcatatatcatgtatttcaatgaggtaagaatgaatttatattggaagtcccactttttagggggcgccaagctgtgtactacttgaattaacagtaattatacagtaatttgctatgtggccttagactagttctcccacctctctgggccctatttttcg

SEQ ID NO: 125645 - DNA, 601 bp, Human
agatgaatggctagggttcatcctccccctgtgccacgtctgtacttggtggaatcatctgtgtggttgcatttatcatactgaactctgaagtatctatttgtctgtctggctcccccattaggctgctggttctttgagaacaagtttcagtttattcatctttgtcctctcatgttcaagcaaaggctagataggtgcccagcaaatgtgtgtttaattgactgtagatacacacacatacacatacatacatcccattgccacatgcaaatgaacgacactgacagaaaacactcaygcattgcctctctatcacatagaatgtcctgcttcagaaacaacagtgctggggccagcaagagaacaaggaatccaaattcaacactagcatccagttcttagaaatgttttaaaaacaaccttcaaacaagagaattattaacacactcagaacctcccatgaggaagagttgaggtagcagctgtgcttaaaaatcacccaaatgttattgcgactaatgtgagaaaaggagagaaagaattttccagtcttagcatttgaaaagaagcttcatggggcaattattccaatcttgta

SEQ ID NO: 125646 - DNA, 601 bp, Human
ccaccaccacacacagaggcacaggcacacgcatacacaagtacgtgggcacacagacacacacacacacacacacacacacacacacacacacacacggagtctgcataattagaggtaaaggctattcctgaagtgtaaacgtaccttccttccaacaacagagaatgaggaggaagtataattgtgctcttcattaccttgtacagtgattagaagagattggtagttaattttcaccctgtcagggcttccagtgaagatgttgatagcttgagaggaggagctgggaggctcttaraagttgggcttaggaagaagatgggaattgtatcatgtgcttctcactttccccccagatgctcatactctccctcttctctctctctctctcacacacacacacacacatacatacacaaatttacacaccaaaaggccctgtaggagcatgggagtaccaaagcagatagaagagaatagcaggaaagaaatagtagttatcaaggtccaccaggcactggacacatgtatgcacattacagccaatccccttgtcattcttcaaggtaggaattgttgtctaccttggagaaactga

SEQ ID NO: 125647 - DNA, 601 bp, Human
acacagtggcttcactataagttacatggtccataagggaagaatctaggattagaagaatctcatggaagatgaatgacagtgggtccttgggaacatgaggtcacattcaaaagttggaagtggctggattcctggaaaacttcactacaaaacaggcagaaagactcctagatggatagatctcagcattgagtgtcactctgcagacctcatgaggtacttcagttctccttgaacaaacttatagtcactgcccataccttcaaattcaggctgttcccattccctgacaaggtgsccctgttccatgatgccctggagttccctaggacactccattaacttagggaatgatgaaataacctagtcattcccatttcctctttacaattcagtttggtcccactttctgtctttccctgatgcaataaaaatgataaatgcgaaggtgtttattggagttatgtgcctagttctgtgctagagcctgtggaagaaaccaaagaactgaaatacccagcctctgacctagtcactgtacaagagttaggagtgagaattctatcaaaggcacattcttatcacaataagtctgcag

SEQ ID NO: 125648 - DNA, 601 bp, Human
cattttgagttgctattatcattccttggcccatccataatacttcatgcctctactagaatacaaaccaggccgggcacggtggctcacgcttgtaattccagcgctttgggaggctgaggcgggcggatcacctgaggtcaggagtttgaggccagcctgaccaacatggtgaaaccccgtctctactaaaaatacaaaattgagtcggttgtggtggcaggcacctgtaatcccagctacttgggaagctgaggcaggagaatcgcttgaacccggttcaagcggttgcagtgagccragacggtgccattacattccagccttggtgatgagagggaaaatccatctcaagaaaaataaaaataaaataaaatacaaaccatactataccttgtaatataacaatttatacattaatttatttattcacttgattgaacagaaatatatttgagtcctgcactgaggaatgtgagagagagagagagagcatggccgttaatgaggtgaagtagaaatcatgcagatctggctctgctctcttaaattccattctgacatggaaaccttgagtaagttactcttctgggaatcttag

SEQ ID NO: 125649 - DNA, 601 bp, Human
ctggacaaattataaaaatagcatttatcaacttcttccaggctttccaccaaatttcacgaatcctactaaagctactacaaaaataggaatcactgttttcattttacagattaggacacaaaggctcagagagcagagtaacttgcttcagggctcatctctataaggggcagaaccaagatgcaggccactgtgttcataatagaaatacagctacaggaccaggcagctcaagcctgctccaatgactgacacatgagaacaagctagaagagctagtgtcttttgcatcttttaatatgtggtacgtatttaaggaacaccgggaaagtgggcattccctctctctaatacccaaaatactgccctacaatttttgcctgctgctaagatctccatcttttggcccccattctttcacccattgccctttccagagagttttctaaaatgtgtgtatggaaataagagagacacataagtgttgtaaattgccaacccttgcatgtaaaaattatttcttaaattttggaatgtctgcttaattatagtagggatatggggagaaaaaaataataaatgcacaaataggaagaag

SEQ ID NO: 125650 - DNA, 601 bp, Human
tgacaagtgttgaacacttcttacatgccaggccctgtattattttgcatagatttcagaacaaccctgctgagaattcttaatattcctctctcaaaatgaagaaactgagtctcagggagatgaatcaccccacccatggtactctttcttctgttttcttttcttataccaggatactggtattgcattaaaacagcctcacttggaaattctgcattgataagcaattctgcaatgctaattagagtgtgctatttgcaaagggcaggaagaaatcctgtgctctatacccaatgcygaagtcacttctaaggggctctctgccccttccttgcctgctctgcctgctatggccttcaccaaagcattcatctcctctcattagtgaaatgagagagcctttgccaatggtggtggaaggaggaaaggcgaagggaacatgctgaaatttcagagacaattccaagcagttttcccaaatacccaaaggatctgctttctcctggtggtttctgaataatttttcaagagcacgtgtgcaagtcatctaaggagacagaacagaaagtaccatggtctagttcagcctgtcccatgg

SEQ ID NO: 125651 - DNA, 601 bp, Human
tgagaattcttaatattcctctctcaaaatgaagaaactgagtctcagggagatgaatcaccccacccatggtactctttcttctgttttcttttcttataccaggatactggtattgcattaaaacagcctcacttggaaattctgcattgataagcaattctgcaatgctaattagagtgtgctatttgcaaagggcaggaagaaatcctgtgctctatacccaatgccgaagtcacttctaaggggctctctgccccttccttgcctgctctgcctgctatggccttcaccaaagcaytcatctcctctcattagtgaaatgagagagcctttgccaatggtggtggaaggaggaaaggcgaagggaacatgctgaaatttcagagacaattccaagcagttttcccaaatacccaaaggatctgctttctcctggtggtttctgaataatttttcaagagcacgtgtgcaagtcatctaaggagacagaacagaaagtaccatggtctagttcagcctgtcccatggtgtggggcaccaaaaaaatccctccaggaaagtaaaaatcagagcctgcctcagaaaggagcccactgag

SEQ ID NO: 125652 - DNA, 601 bp, Human
attaaaacagcctcacttggaaattctgcattgataagcaattctgcaatgctaattagagtgtgctatttgcaaagggcaggaagaaatcctgtgctctatacccaatgccgaagtcacttctaaggggctctctgccccttccttgcctgctctgcctgctatggccttcaccaaagcattcatctcctctcattagtgaaatgagagagcctttgccaatggtggtggaaggaggaaaggcgaagggaacatgctgaaatttcagagacaattccaagcagttttcccaaatacccaraggatctgctttctcctggtggtttctgaataatttttcaagagcacgtgtgcaagtcatctaaggagacagaacagaaagtaccatggtctagttcagcctgtcccatggtgtggggcaccaaaaaaatccctccaggaaagtaaaaatcagagcctgcctcagaaaggagcccactgagttggtcactataaccacccccaaaactttcatggaaaccttggactgtgggagactttaaatctactgaatcttatggggccccagcaaagagatctactagattctgctcctggctct

SEQ ID NO: 125653 - DNA, 601 bp, Human
ttaaaacagcctcacttggaaattctgcattgataagcaattctgcaatgctaattagagtgtgctatttgcaaagggcaggaagaaatcctgtgctctatacccaatgccgaagtcacttctaaggggctctctgccccttccttgcctgctctgcctgctatggccttcaccaaagcattcatctcctctcattagtgaaatgagagagcctttgccaatggtggtggaaggaggaaaggcgaagggaacatgctgaaatttcagagacaattccaagcagttttcccaaatacccaarggatctgctttctcctggtggtttctgaataatttttcaagagcacgtgtgcaagtcatctaaggagacagaacagaaagtaccatggtctagttcagcctgtcccatggtgtggggcaccaaaaaaatccctccaggaaagtaaaaatcagagcctgcctcagaaaggagcccactgagttggtcactataaccacccccaaaactttcatggaaaccttggactgtgggagactttaaatctactgaatcttatggggccccagcaaagagatctactagattctgctcctggctctc

SEQ ID NO: 125654 - DNA, 601 bp, Human
actgtttgttaccagctgtctgatgcctggcgaatgatttcagttttctgagcctcaattgtcctcatcttcacatgatcctgctgtcattctgtgagatggtatgaggatccaatgagctaacatatataaagtgtataatacgtggctacgtcttgcgaggcatctaattcttgtcagttcacatccctactaaactacattatccctgagcaaattgaatctggagaaggaacaaaaatgtgtaagagaggaaagcaaggaagggatgggtttggcatttgtaggcatacaacaaacwcatattgattgatcagggaaggtgccacgtggaacggtgagatcctgctttgaatagcgagtcttcatttttcagttgacacttgactcttgacttgaagcccaagaataagcaaggctttgtggtttggggctgcatctactggttctccatgtagactagataaaaccctgccaaccccttccatggcccatctaggaagattccttggcctctgtcttcctttttcttccaaacctggcctacccctatctcattaccttcattctccacatcctctttagcttcaggaccagaaac

SEQ ID NO: 125655 - DNA, 601 bp, Human
ttgacttgaagcccaagaataagcaaggctttgtggtttggggctgcatctactggttctccatgtagactagataaaaccctgccaaccccttccatggcccatctaggaagattccttggcctctgtcttcctttttcttccaaacctggcctacccctatctcattaccttcattctccacatcctctttagcttcaggaccagaaacctttcttttatccctgtcatttgttctggctcccttaaaacccttctttgttcttgtctttcattttcttttcttttctttctttctttyttttttttttttttgttattgttttgttttaagtggggtcaccagcattcagccagcatggcctttgctgtgtaatttagtttcatgttctgtacccaagaaacatgtaaaaaatgtaaacagcgttcactctcctgggctgtaatgcacttaggaagcaatagccagttgagcttgctgagcctgctgctttggcggtattgaattttgtccctaaaaccacatactcatttctctaagtctgaaagtaaactttctcaagccagacccaaaggatggggttttgaggtgagttagagt

SEQ ID NO: 125656 - DNA, 601 bp, Human
atatagaatgaagagacagagaaaaaggaaggactacacaataacaacaaataccagtaataaccataatgtaatagtaatcacagaaattgataatgatgagtagagtaaagagaatggcttggctgtcagagtgattacattatgtagagaactctacactgttttttgtacatttaaacctgtcaaccaccgtatgaggtaactactgtaattaagactcacaaaggttaggtcacttacccaagttctacaggtagcccagtggtagaacagggaagtctagaatttgaaaccagarccatgtccctctacagccaggaagaaagaagcagcaagtgatggaggaaaatgtcaattttgtatttttagtgagtagggtgtatctaaatatttgcatgtgcaagagctctttgaatcctcacaatgctacaacataggtaccatcatctcattctgcagtggaagatattagagtttatgaagggttcaaggccatgttgtcagtgaatggcagaagctgaaattccaactcacattcctttgatttaaaatacatgtgtcttctggtgcttagtggaagattcagggaagtggcagg

SEQ ID NO: 125657 - DNA, 601 bp, Human
actagggaaaagcatcactctggaaggtccttgttcctcagagaaccctgctgatagagtggtggacatataagtcaacagtgtccattgcacctgtggtggacaaagctccccggtttgtacatcacagtcactgtttctacctctgaagcctggaggggcaggccagggagaaataccacttttgtctttaaaaatgggagttcttgtttgagttggaaggtctgcaggatgctgttaaaaacataagtgactgctgtccacctgttcctttcatacatcactgcattgcatcctttgragactcttcctaggaaaaatcaagctcgaggcaacctagacaagagtactgcctcctcttcaaaagcaaaaggaagagagcgaatcatgtagtgattcccagcccttactcattgaggctataggaggggatgggaggaccctgaggtctgcagtgagaagcaggactcagagacaatgcactctgcatgatcatcttggcatctagtggggttccctgcaggtaatgtgacttgtacttcaatttcaacacaatctggaacacacagatcttaatttggaaagctgaataacaggagaa

SEQ ID NO: 125658 - DNA, 601 bp, Human
tcatcactttcctgattaacccatgaatgcccagggactttgatttaaaatcaaaggacaaagagaggtgtagaagcttcctaagacatccccctttagtcttaatagctctgagctgagtgatggagatgtccatattttagtgccttactccagggttgtctgtgtttctgaatttcactctagagccagcagagaaagcatttggattaaagctaagtagatttttgttttttatcttcagtgtctaaatctcagtcagtttcaggtttggggctatagagcagaaggcattacccasccctgttttaggattatggtgttttcgtattctggtccagaacttagaagtgtttcagtgctcaacatactgctctagaactgacaatgcctcgggccctgaaataaaattcatgatttttcaggattcttatctggagctggaaatgcctcagaattttctactgctggcaatagctctgtgctcctgtctagagttgagtgttcatcctgactgaagttaacagtgctctcttgatctgatccagagtctacactggttttatattctgatctagaattcatgacatttcattaattt

SEQ ID NO: 125659 - DNA, 601 bp, Human
ctgaacctgtgtgtatgaaattgaggaatttaatgagtagtctctaagaatcaattctatgattctgaaccatatcatttctaagaaacttagtttccctatctgtaaaaatgttagtatgctgtagggcaatacgtcttatatgatttctatattccctttccattgaaagcctggcttttcctccatgatcatttggtctggccaggggtttgcaccctaaatcccaggatttcagacttgtggggaggtgccagcctgaagggtatgagacccctaaggagtgtgaaatgcctaatgygttagggacagatccctggagcaacgaggtgctaatcagcccagagctgagccccaaggctggagggcatccaatgccaagttatcttatcagaaagtgtctcctgggtagaggctctgagatctgctgctatttctagaactctgggagggaagaagaagccatctctctgtttcacactctggccctgcacacaggaaatgcttctttccttgattgtctgtctatgccgaataataaatgctcatattgaaagaaacgcaaaccacccctccctttcccctctatctctttaaggca

SEQ ID NO: 125660 - DNA, 601 bp, Human
agagttggtgctggccaggcgcggtgactcacgcctgtaatcctagcactttggtaggccaaggcaggtggatcacctgacgcctggccaacatggtaaaaaccccatctctactaaaaatacaaaaattagctgggtgtggtggcaggagcctgtaatcccagctactcggggggtggaggcaggagaaccgcttgaacctggtaggcagaggttgcagtgagctgagatcgtgccatcgcattccagcctggggtacaataggaagacttagtctcaaaaaaaaaaaaaaaaaaaaaaggagctggtgccctctctcactctcccaggaaagcactgaggagggagaacatcatctgataaaaacagcaaagcctggtttatggaggaggttttatttcacctgggccattctgtgtccaggttccctgaggccctttacagctgtagtcttataggctgtctcccagcaggctttccctcctgtagtcctcaggacccttaagaatcttggaggtttatatcaggaaaccaacttctgtccttcttgcacccttgcaattcttgggaaataacctggcattggaactgcaagcctgag

SEQ ID NO: 125661 - DNA, 601 bp, Human
actgaggagggagaacatcatctgataaaaacagcaaagcctggtttatggaggaggttttatttcacctgggccattctgtgtccaggttccctgaggccctttacagctgtagtcttataggctgtctcccagcaggctttccctcctgtagtcctcaggacccttaagaatcttggaggtttatatcaggaaaccaacttctgtccttcttgcacccttgcaattcttgggaaataacctggcattggaactgcaagcctgaggttaaaatgtggcctaaggagaaatattgagaaayactggctggctgtgtgtgtgtgtgtgtgtgtctgtgtttgtgtgtgttgcacacttgtacatttatgggtactgttagtgtcagtatccatccccgcactcctcctccccattccttttcctattttcttctataaggctcattcgcaggtccctttgggtggaaaaaggaaattggagaggttggactagaggcttgatgagcacttcctccctcccatgattgacaaaagggcatgtaaatctgtaaaatcgaaattcaatggaaacctcatggcatgtcccctgtgtgggaaaatac

SEQ ID NO: 125662 - DNA, 601 bp, Human
cctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagaggtaagggatccgcggcagactcgccctaggccacttgtagccgagtggagacagtgtgattttgaagctgggtagccatttgtgtggatgtaaaaagtctgtgcatttctcccttctccatccatcctctggcctctggccrgctctgccttgtggcccatgagtctctgaattcctggggcaattaagggaaacggttgtgtggtgaaaaaagaacctccttcacctggcttgcagcggcagaattgacaatagcttgcaggttgaccctggaaacatcggtttccttctctgagcttcagtgtcctcatctgaacaaaaagaggattagctctcttttatctctgaaatactggaatattctgcttcccgtggcacaagcaggaggcataaccttcctaaccaagggggatagagtgagactggtatttgcatcatccta

SEQ ID NO: 125663 - DNA, 601 bp, Human
aagaacgggtggaattcagactggcagaaaggtagaattcagagttgcagcaagatgcaagacatagtctctgtacaactccactaatgatgtgtaagttatcttacagtttataaaagacttctacctccatcacctcagttgagtctcgtggctatatgaggttggccaaatttaagagtataccgaagctcagagatgtgatgtactttgccaactaggtaatagagcataggtatatttacaacatcagctaccacttatttttatttatttatttatttatttatttatttatttttttagagatggagtttcactcttgttgcccaggctggagtgcaatggcgcaatctcagctcactgcaacctccacctcccaggttcaagctattctcctgcctcaacctcctgagtagctgggattacaggcgcctgccaccacgcccagctaattttttgtattttcttttttagcagaggtggggttttaccatgttggtcagcctggtctcaaactcctgacctcgtgatctgcccatctcaggctccgaaagtgctgggattacaggcatgagccaccgcgcccagcccagctacc

SEQ ID NO: 125664 - DNA, 601 bp, Human
cttgatggaatctaatctctaatatcaacacctctatgaagagacgttaccctctaccaggaacttcaggctcagacatgccttcacttcgtgtcttgagtcatgttcccccaggaaatacggtgggggaatgaggacaggagacatggaactgacaaaagtcaacaggctctcttctaaagcaagttgccactgtgggcaactagagctcagtccctctgggaaactctgggagacggtggagaacatgcctccgagttattgcaactctggaaactggcacatgaatccaacaactccrccattagtttagtggtgcttccaggggcattaactccttggtactttaaactcaccctgcatatggacagagtaagcatcaatgaccagtataataagcatccatgagcagtataatagccctcaggcagagagttggcagtgcagtaagcatctttcacagtatacaggccagtgccaagaagacaaacgaagggcacatcatgtatcataccctactttcttcaaagccacattgtagatgcagggtagtggctacagctggtgcacagaaatactgcccagttgaaaactctcttgg

SEQ ID NO: 125665 - DNA, 601 bp, Human
tgctttagctgtggtgcactgctaacttctattcaccctcttccagaaagcacatttctggtttgcattttctctcttgattaacattttggaaactttatgttctcttgtcacagaaaaccacgactttcacttcataatttacaatatacatagctaatacaatgtactttttaagagtcccaacaccttttccacagatatgttatctctcttaggcaatttggagagggtgtgcttcctgtactttatatacagctccccttcccactaaccttgtgcattagctgggcaccccaaagcaatgactgccccgattacaagggcaatgcaaaaagaagtttgtagacactgactggtattctggacgcttctatgcttctatggaaaccaaatgaatcacctttctgcacactttactctttttacttgatgttaaaatatatatagttgtcagtctcacagtttgtcaatgtggaatcccctatggggtttacagacaccaatctgccttgtgctaaccagatgaatcatactgacaaagaagaaaaatgaaaaaaatgagaaggaataagataagtggaggagcgtacataaaatt

SEQ ID NO: 125666 - DNA, 601 bp, Human
aattagtgtagaccatgtcctcccagaaagagggtcagggacagggatatggtgacacaatggtgggtgagtgtgcacagttacaacagaatacagaaaagctgtcaggtgcctggtggggacacagaagactcccacaggaagggatgcttacttggggatttgaaaaagcttgtcggggaagaaatgctattgcaggcagaagaaactctgtggctgaggagcaggagttatgaaagcacacatcacatttagggaagcaatagcagtctggtgcagcttcttttattattaatcttgwaatttgcatcatactaaacattcatgagtacctgatatagttcaggcccttcatcaagcacttgaaaggcattatatcttatcctcacaataacctttaacagatgagggaatcaaaacttgaggggataatggaacatgctcccaaatcctgagacccatcctattccaaagtctgacttctttccatggcatctcagctgcatccaagatgagcataaactgcattttcaaaatactctttgcatggtgacaggccagctcgagaaatacacacagtgagaagagacaagctgggatt

SEQ ID NO: 125667 - DNA, 601 bp, Human
ctggggaggcttctgtggcagttatgagccctcagaaagttgctgctgctgccaccagggctgccaccctccccgcgcctcccgggaaggagacgcggaggcctggtgagatcaccactctgtaaggatgccaataatggctcatatatcacaacacagcagcctggtcctaaagccccagagctggggtaggggaggagagcctgggggagggagacgcggagaaagagaaattaagacatgaccgctgcataggacagcaagtgtctcctgttttgaccaccgttttttttttttttttcctctcttgggataagatagcctttgtctatttctcagaggctgcatttttttttttcaaaaggattttattatcacagccttgtctcatctttgctccctaaaaactcctttagaactggtctcatgataaagcacactccataagcagtttctctgactgcttagggatttttgctccttattctcatcactcatcatttttgtctgtgttatccccatttcttgtctctcctctggcctctcaccatctctcctgtttcgatggctgcctccttctctcctctctctgtgtggctgc

SEQ ID NO: 125668 - DNA, 601 bp, Human
gggctgccaccctccccgcgcctcccgggaaggagacgcggaggcctggtgagatcaccactctgtaaggatgccaataatggctcatatatcacaacacagcagcctggtcctaaagccccagagctggggtaggggaggagagcctgggggagggagacgcggagaaagagaaattaagacatgaccgctgcataggacagcaagtgtctcctgttttgaccaccgttttttttttttttttcctctcttgggataagatagcctttgtctatttctcagaggctgcatttttttttttcaaaaggattttattatcacagccttgtctcatctttgctccctaaaaactcctttagaactggtctcatgataaagcacactccataagcagtttctctgactgcttagggatttttgctccttattctcatcactcatcatttttgtctgtgttatccccatttcttgtctctcctctggcctctcaccatctctcctgtttcgatggctgcctccttctctcctctctctgtgtggctgcactgttatcgattgtggggcctggaattagagatgtggctctctcctcaccagcttt

SEQ ID NO: 125669 - DNA, 601 bp, Human
cactctgtaaggatgccaataatggctcatatatcacaacacagcagcctggtcctaaagccccagagctggggtaggggaggagagcctgggggagggagacgcggagaaagagaaattaagacatgaccgctgcataggacagcaagtgtctcctgttttgaccaccgttttttttttttttttcctctcttgggataagatagcctttgtctatttctcagaggctgcatttttttttttcaaaaggattttattatcacagccttgtctcatctttgctccctaaaaactcctttaraactggtctcatgataaagcacactccataagcagtttctctgactgcttagggatttttgctccttattctcatcactcatcatttttgtctgtgttatccccatttcttgtctctcctctggcctctcaccatctctcctgtttcgatggctgcctccttctctcctctctctgtgtggctgcactgttatcgattgtggggcctggaattagagatgtggctctctcctcaccagctttgtgccctgagctttgtgccttttggctctccaacctgtgaaacgggtgtcatgtacat

SEQ ID NO: 125670 - DNA, 601 bp, Human
gggggcctctgaaatagctaatacatacatatgtatatttggaaggggggactttaaaatagctaatagaataggatatttaaagaaaagagttgacttgctcctagtgtttggagggtggtttcgatactaagagaaatggcctctttcaggcctagtcagattctgacaggttgtttctttgcccacatgaataaatgcctctttggggtactgagtactttccatggactaggcttgatttttcagatgacctcaggatgtgtgaggtcagggtagagaatgaatgagctgaattacrgtcaacttgccaacccacagcctggaagtcaactgtcttcacccaaaagttcctggaccaagggcttctatgtagtagccctatctctattagtcatttaccccttctttgactcattacctgattttttttattcctttatccatttaatccataactcactcattcacttatccatttatgtacttacttcttccttcatacgacacctaaatgcatattcatcagtcagtcatcatgccattcatttatccattaatccactcatttcctgatccattgatgtacttattcactcac

SEQ ID NO: 125671 - DNA, 601 bp, Human
ttttatttactgtccactaaatgctgatgtcagcctaggaataaactgaggcaccaataacagaggtagggagcatagagccaggtttcagacctgagtctgtctggctggaaagtccatactcataaggatggtgttgtatggcttctctggtgccctcccatgtagccttccactttacatagcctaggtttctggtatccttctccaagctttacctgttttggggaaagcaattaataggtgtctagcaaactagtaacatcggttgtttgtggagaacctgccacgttcatgtgtycggtgcttagcacgaagactccattttagcctcagcacagttgtatgagagaagggtcattgtctgcattttccagttgtggacactgaaatctcggaagtgaggtgatgggccctgaaccaaggcttgaacccaaacctgagtctgagccctgtgtgcttcccacagtgccaggccggtgtgcccccagccagatgactacagaggccccctcctcagggcagtgtcagtttgacttcaaggttggctgttcccactcgcctttgtgtcacccaatcaactggggcccccagagctgat

SEQ ID NO: 125672 - DNA, 601 bp, Human
tgaggcaccaataacagaggtagggagcatagagccaggtttcagacctgagtctgtctggctggaaagtccatactcataaggatggtgttgtatggcttctctggtgccctcccatgtagccttccactttacatagcctaggtttctggtatccttctccaagctttacctgttttggggaaagcaattaataggtgtctagcaaactagtaacatcggttgtttgtggagaacctgccacgttcatgtgtccggtgcttagcacgaagactccattttagcctcagcacagttgtaygagagaagggtcattgtctgcattttccagttgtggacactgaaatctcggaagtgaggtgatgggccctgaaccaaggcttgaacccaaacctgagtctgagccctgtgtgcttcccacagtgccaggccggtgtgcccccagccagatgactacagaggccccctcctcagggcagtgtcagtttgacttcaaggttggctgttcccactcgcctttgtgtcacccaatcaactggggcccccagagctgatgtgggccctgcttttctcccccaggacatcgcaggtcccaggcctt

SEQ ID NO: 125673 - DNA, 601 bp, Human
tttttagtggagatgaggtctcactgtgttgcccaggctggttttgaactcctgtcctcaagtgatccttctgcctcagcctccttcttttttattgagctataacttacttctttaagtgtaaggcattataaattgttttgggtacactcatgaaaccactactcatattaggatgtggacctgtccaaatcttcagggagtcctccctccccaggccaggcaatttctccagcaccaaggtaaccactgttttgttctctattgctatggattggttttgcttatttgtaaatttatytgtagacttggtccctatcactacgaattggttttgcttatttgtaaacttcatataattagaaatcatgaggcattttcataagtgtgttttcaacttctataaagagaaacacaatgtaccttcttttttgtgtcctaaaccttctttttctcagtccccttccctgtacatgcacttttcaaagtgattagaggtacagagaactcttcctctaatctaataaacaaaatgatacaaactcaataataggtggaaatgcccctcaggttcaatgctagagagaaactgcagggaatg

SEQ ID NO: 125674 - DNA, 601 bp, Human
agcaatgtggaaatgtgggcctcctgtggccaaatttttcattttttcttgggtacaagaaatctggagttcttaaaatttgaaatctctttctttttttaaaaagtttggcaactaattttgactttttttaaacacttgtatgccaaacaaaacatttctgtggtttgtgtagcctagaagctgttggcttgcaacctttggatgagatagactattccagtctggagacctagaattctggggtggcagcctgtctcccatcagttcctaagaaatagatccaatttgctcacacatygtcccttgcccagggatgctgagagtgtttcacaatagaaagtgcatctccctatcctcagaaccttataattcctttaggtgctgagaccttggcttttataatagcttctgaaaaaaaaatgggaggcggaaagagagggagggaatgacttaaggaaagaagaggtaaattgccatttattgactatctctaatatgtagacatggtttgctaggcaattctatatatgccatttcattttgtctccatcactccccagtgaggtaaggattatcacgttacagatgaagaagctga

SEQ ID NO: 125675 - DNA, 601 bp, Human
tctcaaagggcctctccacctttctgaactttggtcttcccatcggtcaaaaaagtaagctattttatacttacagcttcaggggatggtatactttgaaggagattatggcgttcaaagcctagaccttaaaaccagataaatgtgggtttaattgctgactgtcactacctatgtgtacgatttggggcaggtcatttaacttctctgtgccccagttttctcttgtgtaaaccagagtcaaaaatagtacctatctcatagttacggtgagaattaaatgagatgaaagctctgagcycagggcttagagcataatatttattaaatagagaattttgtgccgatgaggatgaggatactgatggtgatgatgatattgacgttggtggaggtggtgatgttagtgatggtgttttcatgctggtgatgatggtggtggtagtggtggtgctatgatgatgatgataaaaagaagatggtgcagatgatggtggtgttggtggtggtgttgatgatgatgatggtggtgatgatgatggtggtgccaatggtgctgatgatgatgacagtgatgatgatggtaattgcaaccaggaag

SEQ ID NO: 125676 - DNA, 601 bp, Human
aaccagagtcaaaaatagtacctatctcatagttacggtgagaattaaatgagatgaaagctctgagcccagggcttagagcataatatttattaaatagagaattttgtgccgatgaggatgaggatactgatggtgatgatgatattgacgttggtggaggtggtgatgttagtgatggtgttttcatgctggtgatgatggtggtggtagtggtggtgctatgatgatgatgataaaaagaagatggtgcagatgatggtggtgttggtggtggtgttgatgatgatgatggtggtgrtgatgatggtggtgccaatggtgctgatgatgatgacagtgatgatgatggtaattgcaaccaggaagaaaagatagtctattcttcctaccaccaaggcaggaaatgaaagccttcttacaaaacctgatctgaaaaagctctggctgggctagatgtctcactggtatcaagaggaaaaaggctgacatctgaggggccccatctgagatctcccaacttctcctgtaaacagcctagccaatccttcagctcccactgcctgtcccctttcccagttctagcacacagaggggtcct

SEQ ID NO: 125677 - DNA, 601 bp, Human
tctgttcctttataaaataaatatttatttagcatcccctctgtcaggcattcctgaaggcatggcatatctaatgtgaacctgagattttatggagcagagaagaaaggcacccaatccagtcttggggtcacctgattccctctgtcacagcctcaccaagaggcctaattacaatttggctaccatataggtctgccctcagggagagaataggctgtttacatggattttccacattttggcccaggtgactcttcattttttaattaaaattaatcaactggcctctcagtcagtygaacaacctctgatcatgtggacttccatagttggttgttcacagttacctgtcactacacatctaagcatgtaccattttattttatttcattttattctttaaagaaataattgtaatctggcatgaaaactggggcatccatggagaatagaaaagggaacttccaggatttttttttttttttttttgagacggagtctcgctctgtcgccaggctagagtgcagtggtatgatgtcagctcactgcaacatctgcctcccgggttcaagcgattctcctccctcagcctcccaag

SEQ ID NO: 125678 - DNA, 601 bp, Human
ccctctgtcaggcattcctgaaggcatggcatatctaatgtgaacctgagattttatggagcagagaagaaaggcacccaatccagtcttggggtcacctgattccctctgtcacagcctcaccaagaggcctaattacaatttggctaccatataggtctgccctcagggagagaataggctgtttacatggattttccacattttggcccaggtgactcttcattttttaattaaaattaatcaactggcctctcagtcagttgaacaacctctgatcatgtggacttccatagttggytgttcacagttacctgtcactacacatctaagcatgtaccattttattttatttcattttattctttaaagaaataattgtaatctggcatgaaaactggggcatccatggagaatagaaaagggaacttccaggatttttttttttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagc

SEQ ID NO: 125679 - DNA, 601 bp, Human
ggcctaattacaatttggctaccatataggtctgccctcagggagagaataggctgtttacatggattttccacattttggcccaggtgactcttcattttttaattaaaattaatcaactggcctctcagtcagttgaacaacctctgatcatgtggacttccatagttggttgttcacagttacctgtcactacacatctaagcatgtaccattttattttatttcattttattctttaaagaaataattgtaatctggcatgaaaactggggcatccatggagaatagaaaagggaamttccaggatttttttttttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagctaatttttgtatttttagtagagacggggtttcaccatgttggccaggatagtctcgatcttttgacctcatgatccacctgcctcggcctcccaaagtgctgagattacaggcgtgagccaccacgc

SEQ ID NO: 125680 - DNA, 601 bp, Human
ggctaccatataggtctgccctcagggagagaataggctgtttacatggattttccacattttggcccaggtgactcttcattttttaattaaaattaatcaactggcctctcagtcagttgaacaacctctgatcatgtggacttccatagttggttgttcacagttacctgtcactacacatctaagcatgtaccattttattttatttcattttattctttaaagaaataattgtaatctggcatgaaaactggggcatccatggagaatagaaaagggaacttccaggatttttttwtttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagctaatttttgtatttttagtagagacggggtttcaccatgttggccaggatagtctcgatcttttgacctcatgatccacctgcctcggcctcccaaagtgctgagattacaggcgtgagccaccacgcctggccaagcttctag

SEQ ID NO: 125681 - DNA, 601 bp, Human
aggtctgccctcagggagagaataggctgtttacatggattttccacattttggcccaggtgactcttcattttttaattaaaattaatcaactggcctctcagtcagttgaacaacctctgatcatgtggacttccatagttggttgttcacagttacctgtcactacacatctaagcatgtaccattttattttatttcattttattctttaaagaaataattgtaatctggcatgaaaactggggcatccatggagaatagaaaagggaacttccaggatttttttttttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagctaatttttgtatttttagtagagacggggtttcaccatgttggccaggatagtctcgatcttttgacctcatgatccacctgcctcggcctcccaaagtgctgagattacaggcgtgagccaccacgcctggccaagcttctagaatttttatgg

SEQ ID NO: 125682 - DNA, 601 bp, Human
ataatagcccatgtgctctcagactgtagtgtgcattggaatcatctgcaaggcttgctaaaatgcagagtctcagggcctggtctcagagagtccaattcattaaatccaaagcaggtctgaggaatctgccgttaattaaacacactcccacggcaatgctgatgaaagtggtcttcagctcatgctttgagaaatgctgctccacagttttctcccatccgcctgctgcagtcacacacatgtatgcacacatacacacacacacatgcaaacacacacatgcacacacacacacacccccctcctccccccaccttatcccaactccacgaatgggtcgaatattagtcgagaattttctgaaaggcctttctgatcgtgtctctaccctccagttctgcttctcctcaacccttgttcctgccagggaaatacagaaccatgacacatgcggtgaacacaaatattattttaatcttgtggctcctgttattgcaagtacccgggcaagttctccatgtaaaagccagggtgaggtcaggaattggaaggtcccagaagaggtgaggtggttaaatgtaatgccaacacggaggtg

SEQ ID NO: 125683 - DNA, 601 bp, Human
gcctgtggtctacaaaatatgggatctgtaagaaaggaagggcagggggctataatgatttaccatctagaatatgctaatgttggaaatttaccaacattgttacatttaacctttacagagtcaggtgaggtggttttatttttaatttccattttactgatgacctttacttgcagacctattccttctgccccacatcttagtcatttactcatgcctcaatcccagaaggaatatgaatgccttagacctaaccattgagctgaagtgaaagagcctttataacccttaaattctrtgacttcacagttgagccattccttacagcttggaattatagagatctgtctctgtgtgtcagtgacaagcttgggaggactcaaggagcatggttcttgggagatcagctgtgtcctgaagggagggctgtccacggaactcaaagacatttctgcacatcactctgccccttgtggctcttcccagctggcagtgaaaaagcggccccaaatcccttccaggtggatggccaaatctctgtggttcatccagagcccactgaggcaaacgcaggtgaaaaggatcagaccatgcccta

SEQ ID NO: 125684 - DNA, 601 bp, Human
ttggcggtctgggcaaccagtgtgacagcggaattcaatccctccttggactcagcagtgagacccaagagaccctcacctgtcagactctgagccctgccagtgatgtttatcacctttgcccttgcaggtgcccctcatctcctgtcctctttagctttgttctaatagtgccttgtctggagctgaaaattatgcttagaagacatacaaactctgggactatcaaccttgaatatccagaggtatccaagataaagaaagggtttggggacccctgagcccctgttttctgcaccaygctgggtccaaagtgatcattcactcacttgttcaccaaagcttcactgagaacctcttatatgccagatactgttccagttctgggaatacattggtgttagtccagtgaaaatagtaactatgctctccttgagtcatctatgatatcttcttgcctgtcatccatccatccatccatccatccatccatccatccatccatcgttttactaaataaacatttatggaatctatatttgataaagttttgcacaaatacgagacattttgctagcaatctaggatacagaaatggatg

SEQ ID NO: 125685 - DNA, 601 bp, Human
agcagacagcatcctgaggctattaggggtggcattttggagaggtaacatttgagctagatcttgaaggatggtttgtttgtctgaatgcgttactagtagaaggagcaacatgagataaaccagagacaggagaaatctctaagtaccagagcttttctcatattgttccctgtctctagaaattctctcttctccacccccacctaattaactcctactcatctttatgatctcagctgaagcgtcatttcttcagggacttcactgagctccctgtctagatcaaatctttctactytttaatagcatcacaaacctcttctccatagctcttatcagagttgaaattggttaattagatgtgtgattatgtgattaaagtctgtctcttcaccagagtataaggtctggaggggtaggaactatatctatattaattcactattgcatccttttccttagcataatgtgtaacacatcgtaggaattaaatacataggatggaataaggataaatgaatggatggatggatggatggacggatggatggataggtggatgaaaggatatggttgcaggaaagaacatatagggtag

SEQ ID NO: 125686 - DNA, 601 bp, Human
aagcgtcatttcttcagggacttcactgagctccctgtctagatcaaatctttctactttttaatagcatcacaaacctcttctccatagctcttatcagagttgaaattggttaattagatgtgtgattatgtgattaaagtctgtctcttcaccagagtataaggtctggaggggtaggaactatatctatattaattcactattgcatccttttccttagcataatgtgtaacacatcgtaggaattaaatacataggatggaataaggataaatgaatggatggatggatggatgggcggatggatggataggtggatgaaaggatatggttgcaggaaagaacatatagggtagagtaactagtgatgggactggagaattttttcagggccaaataaagaagtatcaccttcatttaatttttctcttttcccctagctacttctttatcaagccagttccttttattctaaggaagggacaattagtctccatcattattctgttcatttattacataaaaaagaacataacccacaggcagatctcctgaggcaggaaggaaaagaaagggtttattgtttgttgtttgttta

SEQ ID NO: 125687 - DNA, 601 bp, Human
atctgtagagtgagaaaaccaatacctacctcacttattgtttggagagcaaaagaagaaaacaaacatgtaaaatgtgtgacatcaagtacatctgccctccttgtgagagggagcccactatcacacacagaccatggtgccaaattcctatgagttcttacattttatcttaatgcttcttgggcagtttacattcagcttcctaacatatttgcatatattttattacaaattacgtttttaattacatactgctgaaaaaagtgggagaaggaggcttacatttcctggtcatttmtttgagtaaaatgagccctctttcaggaagatgtaagccatctattttgtggttttgcatacccaagcacacaagagtatgtctctcagcataaccatactctagttggaaaaaactgggtaagagtctttatgaatggtagaaagaaagataagagtctttatgaatggtagaggtgataactcattcaagggggtgttggggatgtgaagcctggccagctaatcgtggaaggctgtgaaaagatgacagacacccgaaggactgcagacgtcagctcccactcactccaggatgcta

SEQ ID NO: 125688 - DNA, 601 bp, Human
cggcagctgcctcctgcccacttctccagcttgtggggccaggatcactccttcatggctggacaacccttgtcctaactctgccagcactgtccacacgctttatttctttttttaatttttattcttttggtcagtagttgaactaatatcataggctgggccctggttgatttttgcagatgtggttctcaaagcttagaattgggtacggaagcaggtaataaaactgcaataagtactttcggaaaggaaggacaaagtgcttggggggctaggcaaggggtcagagaaggcactscagagcaagaggcatctgcactgaaacttgagggataagaggaaggggtgaggaggtggtcaaaagaacggtgtctggagcaggagactggcatgtaaaatcccagtgagaacacacatttttagggggtagggctgaagtctaggaaacagaaaatagtacatccctaatgaggtcatttacagtctttgagcattttattatctatcttatttgtcacacctgtagaattagagaaagatggtcatggtcatggtattttttctttatatcaggacacacccaggagtgattcaagtg

SEQ ID NO: 125689 - DNA, 601 bp, Human
ggcagctgcctcctgcccacttctccagcttgtggggccaggatcactccttcatggctggacaacccttgtcctaactctgccagcactgtccacacgctttatttctttttttaatttttattcttttggtcagtagttgaactaatatcataggctgggccctggttgatttttgcagatgtggttctcaaagcttagaattgggtacggaagcaggtaataaaactgcaataagtactttcggaaaggaaggacaaagtgcttggggggctaggcaaggggtcagagaaggcactgyagagcaagaggcatctgcactgaaacttgagggataagaggaaggggtgaggaggtggtcaaaagaacggtgtctggagcaggagactggcatgtaaaatcccagtgagaacacacatttttagggggtagggctgaagtctaggaaacagaaaatagtacatccctaatgaggtcatttacagtctttgagcattttattatctatcttatttgtcacacctgtagaattagagaaagatggtcatggtcatggtattttttctttatatcaggacacacccaggagtgattcaagtgt

SEQ ID NO: 125690 - DNA, 601 bp, Human
tcacagaaaagtggccacctccatttttctccgactgccgctgagaccagagtgaggagccccagccaagggttgggagggaggtggtaaccctgctagcctgggctgagaagcgttcttgtgatgaatgagttaatggaaaactatttctatttttatattcatctgcagtcagagctgaaagatcatttcatctgtgtcattttaaagaagggggaactgagtttctgagacaggaaaagcaaagaatcatagtcaatcatgcctaaagagccctctatgactatcttggcccaaacgyttcattttattaataggggcactgaggcccataaaagaggaatgatttgtcccaggtgacaaagtgaatgatagaaagagtgaggttcctggattccaatcccagtccctttattttgcaacatccttaggagagttggtttcttcaagaaagaatctctgacccaaaatacaggaacaaatgggacaagacccaaggaacacattctaatcagatggctgttagttactgaatcttttggttgaggaataaaatttctgggattgtccaggatcagtcagtcccaggtgggcaacagtt

SEQ ID NO: 125691 - DNA, 601 bp, Human
gattcctctctctacagagtgcattgtgggaatatgaagtcatgagaccagcctcgccaagatggtgaaaccccgtctctactaaaaatacaaaaattagccgggtgtggtggtgggcacctgtaatcccagctgcttgggaggctgaggcaggagaatcacttgaacctgggaggcagaggttgcggtgagccgatatcgtgccactgtactccagcctgggtgacaaaacgagactccatctcaaaataaataaataaataaataaataaataaataaataaataataatttggaatcygcacctgaacctcaatctcatgacttcatagtcccacaatgcactctgtagagagagaatccatttggaaagttctctgacctcatgatccacccacctcagcctcccaaagtgctgggattacaggcatgagccaccgcacctgaccagattccaaattattatagtaactttaccatatacatatatttgaacaccaagccaccattttggctctctgttcccatactcagttccagtgcagcaatttcagactcccaggccccaagataagcacagactcttcactaaggaacccca

SEQ ID NO: 125692 - DNA, 601 bp, Human
gaggttgcggtgagccgatatcgtgccactgtactccagcctgggtgacaaaacgagactccatctcaaaataaataaataaataaataaataaataaataaataaataataatttggaatccgcacctgaacctcaatctcatgacttcatagtcccacaatgcactctgtagagagagaatccatttggaaagttctctgacctcatgatccacccacctcagcctcccaaagtgctgggattacaggcatgagccaccgcacctgaccagattccaaattattatagtaactttaccrtatacatatatttgaacaccaagccaccattttggctctctgttcccatactcagttccagtgcagcaatttcagactcccaggccccaagataagcacagactcttcactaaggaaccccagaaccagttctttgctagctctgaatgcatttcatactgttgtttcctccttgtctacccacattataaatgtagttaggctttttgtgttaagaaatcctcttcttccactttaaattcttgtttcttcttgttggctgagggtgcagaatgcagatggccaagctgccttcatcca

SEQ ID NO: 125693 - DNA, 601 bp, Human
agattaaagtcacacttcctacaatttagatttcccagtttgacttttaagggaactccaacttcttgaaacttttctcctctttcttggacacccccaactactccctgcagtagactggcttaaaggtggtgctagatggagaaaataaataagaacacaagacttccctaagtgaactattgcatatttcagacactctgcgagacacttggcctctgttatcctctttaatcctcttgtcaacacagagaggtcactattcttattcccatcacacagatgaaccagtctgggcttrgagtacatatgggacttgcccaagttcacttggcaaatgagtggggaagcccaagtttgaacccagttctatctgactcaaaagttctgctttttctcctgcatggtgctgagtttcagaagaagaaagcatgcagggtgcctgtgtccttggcacaccttggcatgaccctccctgttctggttggaaacatttcaccatgagcccagactgccagggaactttggcaaagaggagagcagcttttcccagtagcagcaaagatggggtcgggggaagataagtctcccagccttccca

SEQ ID NO: 125694 - DNA, 601 bp, Human
cagactgccagggaactttggcaaagaggagagcagcttttcccagtagcagcaaagatggggtcgggggaagataagtctcccagccttcccatcatccctgacatccctggcagcccagagaggagtttcccgtgggcatccacagaacagaagaaagttctggtttttgtttccatcttccaccgcaggaagcctctcagagaaggagagaggttactttcctttcatgcctctgcccttacctgctggacctgtttaggtcccacttgtcccctcagccccagtcccatatcaagasacaatcccttcccttacacacccaggctagcgctcagagaaactcacccctgggtgagtttcaagcaccttcctaaatcacaggaattcagttaactgagcacttaatatgtgcttcgctgtggcctggatctctgtgcatgtcatctcacttaaactccagaataattcagccaagtagagcactgaggttgagggaaatggaataatttgtacaaggtgatagagctatgtttgggatttaggatttcctaactgaacaaatggtaatagctaagagttattgctttgctttacatgt

SEQ ID NO: 125695 - DNA, 601 bp, Human
ctggtcttgaactcctgggctccagtgatcctccagcctcagcttcccaaagtgctgggatcacagatgtgagccgccatggacggccctaggcgttatctttttaatcctcattttatagatgatgaaactggggcttagaagggttaaattcacacagttagcaagtggtaaagctaagatgcaaaccaagagaattcaagctgcacagcacctgcctctaaccccttggaacatccttttgcagcaggcttgtgtcttgcccaagcgtcttgtcctgccccttgtgggtgatattctkgcttcatagacctccaggaatggagttcttggtatgaactccaggcccagagttaagcactcagcatcttctcccagacttccttcttgccagttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtctgacaggggt

SEQ ID NO: 125696 - DNA, 601 bp, Human
ccagctgttccccacatccgccttatggggtgacctgggcccggctggcagacaagagcaagacggtgcaggaaactctgtctgacaggggtgtccaatttcccacccagacacctgcctgcagtgtgaggcagacaggaaggggcaggactcagcctctcaggatgtcagtttattattttcctgttggagccttgaggagcctcaaatacaaagcagatttccagaatggttgctccagtggtttcccttcatgacaaaaaaaattcaatttataattggaatcattctaagtaagcaygtgttagggtgtgagggagaaaagggaaacaaccttaacatattcaacataccaaagctttctaaggtgtggtggcctggaacactagttgtggtcatgtttcagatggctgctaagagagtgattcttatagatgtctggggagttggggtatagtcctggttctgtgacttattaactctgtgaccttgggtaggccagactcactttgggtttttatgttttgatatttgaattagattcctgtctaataactcaacataacaaggctttctaaaaatgtgcctaaggactcttcac

SEQ ID NO: 125697 - DNA, 601 bp, Human
agactgagacctacagagaataagaagaggttaatcccagaaacacatctcagcacaggatggtgcacccaattcatgcaactatgtgtagggctggctgcaatatttgctaaatgacagatttactaaatcttaaaccctacctaaatgagaacatggtttcttaagaaaagacattatacccaacatgtagcacattggtcattggtctaagaaggctagtgattctataagatatggaaaaataatcaacatcattacatggagagcaaccttcttagcagagtgggtgataacctayattgacaaagggctggatgttgggtagctgacttggggatgtacatcagtgtctcttcttgacctagcagccagaataatcctttttttttttttttttttggaaacagagtctcactcttgtcacccaggctggagtgcagtggcataatcttggctcactgcaacctccgcctcccaggttcaagcaattctcctgcctcagcctccagagtagctgggattacaggcacacaccaccacacctggctaatttttgtatttttagtagagacggggtttcaccatattgctcaggctg

SEQ ID NO: 125698 - DNA, 601 bp, Human
cagagcatggtgcaaggggaaaagggataaaagataagcctagatggataagcaaggcttttatcacccaagccagggagattgaactttatccagaggccagtggggggtattcaggaggatttgaagcactgagccagtgtagggaatcccagaaggccttttggaagagagagtagatatgcttaacttggaggattagtaagagacaacaagcagatggctaagcacactagactaactcttccatgttcaaaaattactggcttctggaatgttattaaaccctctgcctccccctgccccccgctttggaatgtagccctgactttttccttatggatgaagtaggcactcattttagcttggtcctatgatggaatccagcccttctatcccaaaaacttatcagcatcattatcaatgttattaccaccaccatcatcatcattacctcactgtcaaaaccatcaccaccatcaccactagcatcatcatttattgagcccatattttatgccatgcattattctaatgctttacttgcatttcatactttacccaacatacttctgtgtggtaggactgttagtacctcctt

SEQ ID NO: 125699 - DNA, 601 bp, Human
cctgacagcccactgattcatctctttgcatcttagtttcttttaagatgtaaaatggggatagtaagaatagttacctcttagcattgctgggcagagtgagtaagataatgatgcacattgagtttagctcagtgccaggcacataataaggataaaggttattggtgattaaaaagacaaagcagcagtcagccttttcaggttgtgaagaaaataccttttttttcccccttctttttactctcacttgctgaaaagctctcaagtgtttgaagtggggtttggaatcctgcatcascaactcactgactggtactgaggcctgagacaggttagttttgctttaaacattctgaagcctctattttctcatctgcaagatggggagctaataatgatagtctcccaaggtggtgcagagtcagagagctagcatatagaaatcatctggcatgtggaaggccctttggaatcactagtgtgtgtacaatggtattcaccgcttgagcctgcatgaacaggtgtccccaagtcctttccaggttagacctagcaatacctgaaaatctccacccttttcttctcagctttatatctg

SEQ ID NO: 125700 - DNA, 601 bp, Human
agtttcctccagtgtttatttcggaagtgctgaaactgcccagactggcctggggaaggaagaaaaaggtgacaccaccccagcatagccagagtgccaagaccggcctgagaagctaactggtggcaaggccttaccagccaacaattttggagaagctgattgaactggggaggacaggaaggggagcattcaagacagggtctgtgaagaaattctatgtttcaagttcctttctggccaggtctttgccttctacctttctcagactgagaaggattttcagccagatgagaagttrgaagctatgaaaatcaactcttattataggcagggaaacaagctcagagaagggaagtaacttgtccaaagtcacccagcaactgactgtaaaagtggaggctccctgacttgtattctgcctgcatattcatgcattcatttgttcattcattcatgggtcattgaatgcataaagactgagttcaataacagtcatggtccctgcccagagtgagctgacatcgaagtaaagaagtaattcagtatcagaagggtgcaaaaataagatgctgtgatatggtatgaaggtgatggtgct

SEQ ID NO: 125701 - DNA, 601 bp, Human
gaactggggaggacaggaaggggagcattcaagacagggtctgtgaagaaattctatgtttcaagttcctttctggccaggtctttgccttctacctttctcagactgagaaggattttcagccagatgagaagttagaagctatgaaaatcaactcttattataggcagggaaacaagctcagagaagggaagtaacttgtccaaagtcacccagcaactgactgtaaaagtggaggctccctgacttgtattctgcctgcatattcatgcattcatttgttcattcattcatgggtcaytgaatgcataaagactgagttcaataacagtcatggtccctgcccagagtgagctgacatcgaagtaaagaagtaattcagtatcagaagggtgcaaaaataagatgctgtgatatggtatgaaggtgatggtgctattaggttggtgcaaaagtaattgccgtttttaccattactttcaatggcaaaaaccacaattatttttgcaccaacctaatatctttggtcagactactgagggaggtagtgatacttgcgaaaagacctggacaatgaaaaagagctggccagggaagagca

SEQ ID NO: 125702 - DNA, 601 bp, Human
gacatcgaagtaaagaagtaattcagtatcagaagggtgcaaaaataagatgctgtgatatggtatgaaggtgatggtgctattaggttggtgcaaaagtaattgccgtttttaccattactttcaatggcaaaaaccacaattatttttgcaccaacctaatatctttggtcagactactgagggaggtagtgatacttgcgaaaagacctggacaatgaaaaagagctggccagggaagagcagtcagagtggagggccattagtggctaaggacacaaaagtaggaaaacagagtatmtggggaaccaataaataaagaagccactgagagtgaggaggagaaggaaaccatgtaagatctgagacttatgtagaaatcagatcatgcaaggccttgaacttgtggtaaggactttggattttattctaagacatataattttttgaatgtttgccttgagtgaggtgcagcagaaagcacaaaagataaagcagacagacatgaaaccatccctcatgggtgtttgagctcaatgggaaagtgttacagacagaatattagagaagacattagaggtaactggatcgtgctaatgat

SEQ ID NO: 125703 - DNA, 601 bp, Human
caaacaaggatcccaacccaaaccttttggctttcatgatagtactttccacactctaccccagtggttggattttgacttggctttgccctcagtttccctgtttggactggggggttttctctctatgccacttccagttctaatattctgtgcttctcttcaaggtaaaatgaataggggcaaatattctagattctagatggaatatcctagatgtattccacaaagtcacagaggatggaaagtaaatgtcctaaacagagaacagcaagtagctgtgagcaagaagagaggtgcwgcttggaaaaggggacggtggaaatgcttaccacagcatcaagcacttatgaatttaaattgaaaagagaaacaaagacttgtggtagccataagtacaaagagtcagagagagatggatcaatgaatacaaatttattcattctgtggcttagggcctgtgaaaacaggaataaacaagattgacctggtccctgccttatgggccacagaattggtgggaggatagaccaaaaaaataaaggagagggagcgggagagagaaagagacagaataattgagcacttagcatatgtcaag

SEQ ID NO: 125704 - DNA, 601 bp, Human
agcaagtagctgtgagcaagaagagaggtgctgcttggaaaaggggacggtggaaatgcttaccacagcatcaagcacttatgaatttaaattgaaaagagaaacaaagacttgtggtagccataagtacaaagagtcagagagagatggatcaatgaatacaaatttattcattctgtggcttagggcctgtgaaaacaggaataaacaagattgacctggtccctgccttatgggccacagaattggtgggaggatagaccaaaaaaataaaggagagggagcgggagagagaaagagmcagaataattgagcacttagcatatgtcaagcactgtgtgaggtgttttcatgagttatttcatgtattccttatcacaacctcaggaggtctacacttttatttttcccattaaatgaatgagttcattgagactcagagaaattgtcacatgttcaaggtcacatctcaagtagatgagagagctggggcatatacttaaatctttctgatgttccattctacattttaaattattgcaaactttcaggatggagagaggttgggagggagggaaagaggtcaaagaggcagagaaaa

SEQ ID NO: 125705 - DNA, 601 bp, Human
gttgggctcttcctatcagtttgcagaaaggaaagctggccaaggtcacagagcacatgaaggaacgaactggcaactgtattgaactcagttctctcacttgttcgtatgctaaaatctgcttcccaggtccttcaaatttggtgcaaaaccaccatgcgatctattccctactcaggattccaagcctcccagaaggtggtctagcttccctgagacatgctttttgttttcatcattgcctactaaagtcaaagtgaccagtatgtgcagagacttatgttttctcaaaagacacttmcacatcctttctttcacttgatcacttatacatcagatattccattacacagttctattaatcaactttgctatagtgcacgacaattttccacccatgattttactcagctcctatagtttaaaatacaaagtgggtcttattatatcagctctacatagggacctgaggctctgagataagtaagtagcttgttttactttaaataccagacttgacacttattattacttttggcaaattcttattcctttctgagcttcagtttccccatcaataaaagggtgattgttgcagcat

SEQ ID NO: 125706 - DNA, 601 bp, Human
aaagtgttttcttgtttggaaatcactgagtacattgccttaccccatagcaaatgcctgacccatagcaagtgcctctgcaaatgaaaactgctgtgattatgatcatggtgtgctcgataaaagttatcaccaggatagcaagaagcagagccataacttgaacttgaaccttctgctcctcaaatccagtgattgtatccctgcgctgcactgcctttctgatcattactgcttcagaccaaatcacctgattcacttcttctttctgcaggtcaccccattccctatgtcctgtgayctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtc

SEQ ID NO: 125707 - DNA, 601 bp, Human
aatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaaaagagaccaaaaataacyttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactat

SEQ ID NO: 125708 - DNA, 601 bp, Human
ttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacragctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagac

SEQ ID NO: 125709 - DNA, 601 bp, Human
atcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccct

SEQ ID NO: 125710 - DNA, 601 bp, Human
gctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcarcggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactcc

SEQ ID NO: 125711 - DNA, 601 bp, Human
cccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctrtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatg

SEQ ID NO: 125712 - DNA, 601 bp, Human
tgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcrgcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttga

SEQ ID NO: 125713 - DNA, 601 bp, Human
aattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctycccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaa

SEQ ID NO: 125714 - DNA, 601 bp, Human
attgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattractttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcc

SEQ ID NO: 125715 - DNA, 601 bp, Human
taatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatrtatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttgg

SEQ ID NO: 125716 - DNA, 601 bp, Human
tcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtataygttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccc

SEQ ID NO: 125717 - DNA, 601 bp, Human
catatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaagrtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttt

SEQ ID NO: 125718 - DNA, 601 bp, Human
attatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcrtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaa

SEQ ID NO: 125719 - DNA, 601 bp, Human
ttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcrtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagc

SEQ ID NO: 125720 - DNA, 601 bp, Human
tttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttamagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcata

SEQ ID NO: 125721 - DNA, 601 bp, Human
cgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtatgtggctggagtcagctcctctgaactttccctcacttctgcccagaacttctcactgtgtgccctggtttgtttatttttgcaaaaaaaaaaagagttaaattaccttaaagactcaagaagccacagagatcaaataattcattgttacagggcactagaggcagccattgggggtttgttccatttggaaattttgagtgctaacaggggcatgagataacatagatctgcttaaggtccctgctctgctaccttgtggctctgtgaagaaattatcaaacctgtctgagactagttttcgcatctgtaagagaattataataccttcttcactagagagtaagcagactgcttcagtgtcatttcttcccactggtggtctttacactca

SEQ ID NO: 125722 - DNA, 601 bp, Human
atattgtaaatgtaattcaggctggattaagaaagaacttatttgtacattgtaactgacaagcacctgcaatgctgaaaggaatttttcattggcttgctgtttgctggctgcatcaaagccctgtctctaggacatgtctctgaacattgtgtgtagcatggctttcatttcttttaggataaaattcaaaaccctttatctggttggtaaacctctgcctaattgggaaccttctttctccacaactccatattgtacactccaatttcatctctgttctccaaccatggaagctatktgtcatgattcctccttgtgtcattttttttctgtcaaccttggggcttttgtgtttgctgttcacttcacctccttttattgttaacttctactcatctttcaattttcaacttaagtgttctcagagaaacctactttgattttcttggtccacaacggttctctggatgtgaactcttatagcacataattttcacttttttccacaaaactcgctcctatcacctgttacaagcatttacctctgataacaagaactttcaaatatctagctgtcatgtaagcacttttcataaac

SEQ ID NO: 125723 - DNA, 601 bp, Human
ctgtcaaccttggggcttttgtgtttgctgttcacttcacctccttttattgttaacttctactcatctttcaattttcaacttaagtgttctcagagaaacctactttgattttcttggtccacaacggttctctggatgtgaactcttatagcacataattttcacttttttccacaaaactcgctcctatcacctgttacaagcatttacctctgataacaagaactttcaaatatctagctgtcatgtaagcacttttcataaacattaagagtatctgtgacacttatgtgtaatktttcgtatctctgaaattgatatttaccagtcatttatcttggctaccaactaacaactatccatattatctgtaccaatcagatgtataatcacaattttgtgtgacagaaaatggctaaacttgatccaaggctattacatgctttatcaactgcacaatctttatatatgtcaattattgatctttaactgatttccttcttatggattttctcctctgcttatcatgtatgcctaacatgacaaaaaagagcctatcattgcagccagtatgataatactcagtctgtggggcttc

SEQ ID NO: 125724 - DNA, 601 bp, Human
tctactcatctttcaattttcaacttaagtgttctcagagaaacctactttgattttcttggtccacaacggttctctggatgtgaactcttatagcacataattttcacttttttccacaaaactcgctcctatcacctgttacaagcatttacctctgataacaagaactttcaaatatctagctgtcatgtaagcacttttcataaacattaagagtatctgtgacacttatgtgtaatgtttcgtatctctgaaattgatatttaccagtcatttatcttggctaccaactaacaaytatccatattatctgtaccaatcagatgtataatcacaattttgtgtgacagaaaatggctaaacttgatccaaggctattacatgctttatcaactgcacaatctttatatatgtcaattattgatctttaactgatttccttcttatggattttctcctctgcttatcatgtatgcctaacatgacaaaaaagagcctatcattgcagccagtatgataatactcagtctgtggggcttcttatttgcttattccatcatcatctgtcctgcttgatgtctttgcctatgcacaatca

SEQ ID NO: 125725 - DNA, 601 bp, Human
gacggcgccgcgcgggtcgagggcttctcggggtgccaccgcgaggcctgcagctccgtggcctgccctggaagcggcctaggcttcctggcgttcctgcgggccgcggatggcggtggattgagtgagaggccccagccaggagggcgctgtgtggccgggttccaagtgaagcgcagagagatgggcaccaggcgccccttctgtcccggagaaggcgtttgtgagcatttgtcggtcaacggaattagtaaacgtggtattttgagggcgtgtgtcatttccctcatgtcttatcccrtggttttgggaagagaaggcagcagtgtattcttgccttaactggtcgtttctgggtacagtccgctggccccaggacctcaacttgaagggttgctgacggttgcttgctccgtctggggaccccgggaggaagctgcctcggatttaacgccttgtcattacatgggatagaactgtgtaaaaatcattagctttaaaaatagacagtttgtcatttcgtatatacacttcgatgtcaaaattaaatccacaacttctcgagagttaggatttgccagctctgttggtaccgtaaagc

SEQ ID NO: 125726 - DNA, 601 bp, Human
ctgttggtcttcttgagaaggctttacaaagagccctgttgcggggggcggggcagtgggcaatgaggaataattaggcctgttactgggtgtgttacgtatccctaggtagaagtgccttagtactagttaggataccatgaaactttagtagcaatcattcaaatctgcttagtgtgttcactcttaagatggtattgtgaagagataagatagacctgatgcaaaatagcttaaaatctagacacttaacctctgagttgcatgcagatagtagtaatgtgagggtctactggtaagrtttcaacaggaagttctttgtgcagtttgactgtatgtaaaggcactgaaatgccttgcctagaggaatgacaggaaagctgtgctgtaggaaggttgactggtagggatgggtagtgtaggcaaggctctaggtaaggacatagaaaagacggcttacctggtttgagtgccagctaggctgcttagaacaatggttctcaagattaatgccagccccagacccaccaaatgggaaactggatgtgtgactcagcaatctgtcttaataacccctccacatgctgtttgcacacattga

SEQ ID NO: 125727 - DNA, 601 bp, Human
ttacatagataatttcttaaaataagacaatgggctgggcacagtggctcatgcctgtaatcccagaactttgcgaggccaaagtgggaggattgcttgagctcaggagttcaagactggcctgggcaacatagcaagaccttatctctaataaaaataaaaaacattgggtgggtttagtggcacacatctgtagtggcagctactcgggaggctgagggggaggattgcttgagcccagaagttcaaggctccagtgagctgcgattgtgccactgccctcccgcctgggggacagagyaataccctgtctacccccaacaagaaataagacaacaatgaagtttgctgaaacagttgacacttcctttcacaaaagatttctctgtagcatgcaatgctacagaatttgatagcatttttcccatagtagaacttataaatgaatcctctcaaaccctgctgctgctttatcaactaagttgatgtaatattttaaatcctttgttgccattttgacaatgtttacagcatcttcaccagaagtagatcccatctcaaaaaactactttatttgctcatctataagaagcaactcatt

SEQ ID NO: 125728 - DNA, 601 bp, Human
agagttagaactttgccctggtttaggctttgtcttaagggaatgctatggctggtctgatcttttatccagacctctaaagctttctccctatcagcaataaggctgttttgctttcttatcattcctgtattcactggagtagcacttttaatttccttcaagaacttttcagcctggtgtggtggctcacgcctgtaatcccagcactttgggaggccaaggtaggcggatcacgaggtcaggagttcgagaccagcctgaccaacatgctgaaatcccgtctctactaaaaataccaaaaaaaaaaaaaaaaaaaaaaaattagccgggcatggtggtgcatgcctgtaatcccagctactcaggaggctgaggcaggagaatcgcttgaacacaggaggcgggggttgcagtgagcagagatcgagccactgcactccagcctgggtgacaaagggagactctgtttcaaaaaaaaaaagaactttttctttgcatttacagcttggctgtttggcacaagaggcctagctatcggcctgtcttggctttcaacatgccttcctcgtaagtttaatcatttctagctttgatttaa

SEQ ID NO: 125729 - DNA, 601 bp, Human
tccctgtctttgcttttgataacattggctcacatttctcttggtgaagttttttactttgtgggattttcagttcctgctctttcaccttatcttctcatgagtctttctcatggcctcccaggaccagacttctgcatgtataactagcctccacagaggcccagccctacagcccagtagtacttgggattctagctctttcctttcttctaggacaagcattgcctgtggtcatcgtcatgttgcactgtttttgatcacagacagtaggctgttaagcattttttttaatcctatyttttagagacaacttctatgttgcctaggctggtcttgaactcctggctcaagcaattttcctatctcagcctcctgagtagctacgactacaggtgtacaccactgtgcccagccttttaaattttaactgtctgtttgtctgtctgtctgtctagagacgagccctctctgcgttgcccaggcgggagtgcagtggctattcacaggcttgatcattgcatactatagcctcaaactcctggcctcaagcaatcttctcacctaagcctcctgagtagccgccactacaggcaggtgc

SEQ ID NO: 125730 - DNA, 601 bp, Human
agtgtttgtctttttgtgatggcttatttcacttatataatgtcctcaagtttcatccatgttgtagcatgtatcagaatttccttcctatttaaggctgaataatatatcattgtatgtatataccatattttgtttatacattttttttttttttgaggcagggtctcactttgttgcccaggctggagtgcagtggcatgatcatggctctgcaacctcgaactcctgggctcaagcaatcctctgcctcctgagtagctgggactacaagtgtgtgccaccatacccagctaatttttttatttatttatttatttatttatttatttatttatttattgtagaaatggggtttcagtatgttgcccgggctccattcatctcttgatggatactttggttgcttttgcctgttgggtattgtgaataacattgctatgaataagggtgtgaaaatatctctttgggaccttgcttttaattcttttggacataaacacagaagtggaattgctggatcacttggtaattttatatgtaatgagaaactggcatgccattttccatagtggctacaccattttatattcctaccaac

SEQ ID NO: 125731 - DNA, 601 bp, Human
acttgtggactcatatatagaactcacaactaatattccaagaaatagaatgtcgtcagcatctgagaagcttctcttatggccccaccctccttcccaaaggagaagttgattatattaagttgatttatagccctagagtttagttttgcttatttttaatctacgtattcttttggtctggcttttgttcagtattcttgagatttatccaaattgttgtgtgtaaccctaatttgtttttcattgttacatagtattctatcgtatgaacataccacaattaagtgatccattttaytgttgttggatacttgggttagttattataagtatagattatactgctgtgaatattcttatacatgtttttggtactgcgggcatacattttgttgggtatgtagctaggagtggaattactggctcatgtggtatgtgtatgttctacctcaatagataatgtcaaccagttttctagagtgatggttttaagggttgttctgcctcagttccatccttattccttggatttggccctttaaggttccatctcaaattacatgacagtttaccaggccttcaagttttgtccttctgc

SEQ ID NO: 125732 - DNA, 601 bp, Human
gggagattagacctttctttatttgcaatatgtctgattaggcattatctcattgtatccttataataactcctctgtgaggatgttattaaattttccatttaactgataaagaaattgaggtaaagtaagattaagtaacttgcccatagtcacaaaataagtgatgaaagcatggtttgaactaggtgtctctgaatctatgcttgagctttcaacaaaagttatgaattgccttcccagtgtagtacaggagggaaaaaaatttgtcttaaatttccttttatttgcttaaaatttstgtatttgtttgccttgcttttcttttcttccttttcttttttctttctttcctttcctttcttttttttttctttctttctttctttgtaaaaatatttagcacctattatgtaccaggggctggagaatcaatattagtaaccaatagtataagccctgaaaaggctcatagtctagaaaaggaagacagtcataaaaagttacaatgttatacaataaatgtattaggggaggagagtgagtttcatggaaggctttataaaggaggtgacttttgagttgggtatggaggatgatt

SEQ ID NO: 125733 - DNA, 601 bp, Human; identical to SEQ ID NO: 25136

SEQ ID NO: 125734 - DNA, 601 bp, Human; identical to SEQ ID NO: 25137

SEQ ID NO: 125735 - DNA, 601 bp, Human; identical to SEQ ID NO: 25138

SEQ ID NO: 125736 - DNA, 601 bp, Human; identical to SEQ ID NO: 25139

SEQ ID NO: 125737 - DNA, 601 bp, Human; identical to SEQ ID NO: 25140

SEQ ID NO: 125738 - DNA, 601 bp, Human; identical to SEQ ID NO: 25141

SEQ ID NO: 125739 - DNA, 601 bp, Human; identical to SEQ ID NO: 25142

SEQ ID NO: 125740 - DNA, 601 bp, Human; identical to SEQ ID NO: 25143

SEQ ID NO: 125741 - DNA, 601 bp, Human; identical to SEQ ID NO: 25144

SEQ ID NO: 125742 - DNA, 601 bp, Human; identical to SEQ ID NO: 25145

SEQ ID NO: 125743 - DNA, 601 bp, Human; identical to SEQ ID NO: 25146

SEQ ID NO: 125744 - DNA, 601 bp, Human; identical to SEQ ID NO: 25147

SEQ ID NO: 125745 - DNA, 601 bp, Human; identical to SEQ ID NO: 25148

SEQ ID NO: 125746 - DNA, 601 bp, Human; identical to SEQ ID NO: 25149

SEQ ID NO: 125747 - DNA, 601 bp, Human; identical to SEQ ID NO: 25150

SEQ ID NO: 125748 - DNA, 601 bp, Human; identical to SEQ ID NO: 25151

SEQ ID NO: 125749 - DNA, 601 bp, Human; identical to SEQ ID NO: 25152

SEQ ID NO: 125750 - DNA, 601 bp, Human; identical to SEQ ID NO: 25153

SEQ ID NO: 125751 - DNA, 601 bp, Human; identical to SEQ ID NO: 25154

SEQ ID NO: 125752 - DNA, 601 bp, Human; identical to SEQ ID NO: 25155

SEQ ID NO: 125753 - DNA, 601 bp, Human; identical to SEQ ID NO: 25156

SEQ ID NO: 125754 - DNA, 601 bp, Human; identical to SEQ ID NO: 25157

SEQ ID NO: 125755 - DNA, 601 bp, Human
tatggaaagtctcatttatttgctcctgtgacaagtatgtttccttaaatgaaaagaggggttcttgcatatcttagagttgccagaggatgtctccaaggacagaaaaaaaaaaaaaagcaaaagcattatagctttcagttatgttactggttattttttatttttattttttggttgctgtaatgacttacaaactgtgactccatctctgggcacctaagccctatgtggaaactagagctgatttcccaggctcctggaaccaagtagagaaatactaagagacagaagagaaagmcaatgtgaaagcctgcacatgatcactaaacagctgtggcaactatttatcatctgtagtgacacagctgagtgggtcaacacagagaaaagacattcatgcactgatttttttgttttgttttgtgttactccctgaagccacataaccgtgcaagggaacactgggggaagaaagaagcagttaaggatggaggagtcagaatgagaacacttctcatttgttcatcatctctcagcagtcattccagcctgggaaaaaagcctgcccactcctattgtcctcaaagccaggcatctc

SEQ ID NO: 125756 - DNA, 601 bp, Human
caaaataaaacttcatgtaacttgtattttgtaggtttatatttatctcaactatttcaaatatgatctttggaatcaattatgaatgacaaattcagtacttctaggaaatgcccctgtctcaattcaggaagtgcaaaaagcaattataaagactcaatgaaacaggaaacctgataatagattaccttaaagaaaaaataaagaaaaaagcctcagtagagaatgaaagtaattattaacatcaatccatactgtcttttcataagatacaaagtttataatttccaaggataaacartaaggcttcacttttaaattcaaaactaaaatagtaattaagacttgctctgttgtaggcaggggtagttctgaagtttgctagactgatacacttgggaaaatactttagctctctttgttgggggaaagaaaatccaaaacaaaaaaaacatgtctttatatctccaaagttatgcagtctacactgatgaggcattctccagctttaattccaaagatctctcatctctccaaaggagagatcaaacccaggccatcttacgtttgaggccactctgattggagcagcaaggcaaag

SEQ ID NO: 125757 - DNA, 601 bp, Human
tgctgctgtctcaatccagttctgtacttaccactctgagacgtgatataacaggtcttttcaaatcacatgatgaatttgggcttgtttctttgtttaccttgctctctacagttttgcgaatcaaacttaagcatttttccataaaatccccctctttaccataatggttgtctctacctcatgagcaggaccacttctctacaatgcctgattttagcagaattgagagaaggaatctaaacaaaataaaacttcatgtaacttgtattttgtaggtttatatttatctcaactatttcaaatatgatctttggaatcaattatgaatgacaaattcagtacttctaggaaatgcccctgtctcaattcaggaagtgcaaaaagcaattataaagactcaatgaaacaggaaacctgataatagattaccttaaagaaaaaataaagaaaaaagcctcagtagagaatgaaagtaattattaacatcaatccatactgtcttttcataagatacaaagtttataatttccaaggataaacaataaggcttcacttttaaattcaaaactaaaatagtaattaagacttgctctgttgt

SEQ ID NO: 125758 - DNA, 601 bp, Human
gaaatacttttcagaagactaaacctttcttccttattcaacttttcaggaaactcgcaagataaggagtggttataagtctatacaattctgtaatcattaaaatcgagaaacactgaaggaaaaaaagaatgttcaagatgaatgttccaagttttaacctagacaaattttataagttcaaaataggagctacaataaaagagtgaaagaccttaacacatcactttcatacttggaaatattaggcaaactttaatgagaaacaaggtggctccttgttaacaggcaatctacaaaracgtaaagcaacttgtccagtcgccaagtgggagctcatcagaggagtcaagaataattatagaactgctgctgtctcaatccagttctgtacttaccactctgagacgtgatataacaggtcttttcaaatcacatgatgaatttgggcttgtttctttgtttaccttgctctctacagttttgcgaatcaaacttaagcatttttccataaaatccccctctttaccataatggttgtctctacctcatgagcaggaccacttctctacaatgcctgattttagcagaattgagagaa

SEQ ID NO: 125759 - DNA, 601 bp, Human
gactccgtttctccatctgtgaaattatggatatggtctcatttatcctaaggcccttcccatttctgattttatctccccctccttttcttccttaatgactagattttatgaaataagttatttattagtgtcctggaaatgtattttaagtaatatttaacaaccagtagcttagaaatgagaatatttacagtgcttagaaacctaaaaaatttatataagccattaatgaaggctaagggatttataactcctggtgccacaatgtaagtataaacttaaaacatgcaaatatacrcacacacataccgatttataaatccatatccatttctgacgttgaaccatttgacagtgccaaggactttggtggctaaaataggattaagcagataaattagtatctgacctacagagagatatagctcatatcactaagatcttgataacattagacaaagcctaaacatacctaaagaaaccattaaaagcttaattccaaaatactttagaaaaagaaaatggagcaagccaagatctcataaggaaatacttttcagaagactaaacctttcttccttattcaacttttcaggaa

SEQ ID NO: 125760 - DNA, 601 bp, Human
gcagagaagctccatatcttacccatttcctctatttcctgcaaatctaagggaatttgcagcttttgacctggacacgtcctaacatgcctcatttaacaagagtgagggctaccctgggaactggaagttttctcatcttactatctgcttctctgcgctatttacttcaattgagagctgctctgacagaggagctttaaccaatacctacccaggcagaagccagattggctccaggcaaacactaaggaggaaccacatcaggagaacaggatgctaaaagggaaacagacttttyttttttttgctaaggactcaaaggctttaaaaattagaaagtggtctaaccaaatatcactttatacaactgcaaaaataaaactatttgaaaacagttaatatgatggggtagaagaacttatttgccaatcttaaaatgtggaactgaactcctgttgcaaaataaatcacagaaagagtttagattaaaataataatccataggacttacttttgggaaagggctgacagaagattacacaccctctcctcacatagcaaatgtagtatttataatccctcttacctgatgtacaaa

SEQ ID NO: 125761 - DNA, 601 bp, Human
gagaacgcatatttcagacaattcactgaaaactaaataaacaaaaagaacactaaggatagtattccttctcttaacctattttataaaggaagtctaggacatattaataacagaataaataacatcctaggctaataaagcaaagaaaaactgaggcacctatagcagagaagctccatatcttacccatttcctctatttcctgcaaatctaagggaatttgcagcttttgacctggacacgtcctaacatgcctcatttaacaagagtgagggctaccctgggaactggaagtttyctcatcttactatctgcttctctgcgctatttacttcaattgagagctgctctgacagaggagctttaaccaatacctacccaggcagaagccagattggctccaggcaaacactaaggaggaaccacatcaggagaacaggatgctaaaagggaaacagacttttcttttttttgctaaggactcaaaggctttaaaaattagaaagtggtctaaccaaatatcactttatacaactgcaaaaataaaactatttgaaaacagttaatatgatggggtagaagaacttatttgccaatc

SEQ ID NO: 125762 - DNA, 601 bp, Human
gataaagaaaaacaaattaaaatgccaaggggataaatatttctgacgagtaaacaaaattatctcaagaatcagaacgtattagtaataatctggcctcccccctctcctcccattttgcagatgagttaacacgaggctaacagttaaagtgatttatctgaagtcacaaccgtaacagccccagggatgatgggggaagtggaggagggggaattcatatccctgtactctacctatatgatatttattcaacttttctcccatcacacaattcatgtcaacaaatcctacattcccygataatacattaaaaggttagtgaagatgctattcttcattaaacatctacacctaaatatctgcttatgaataggtgctgctctctcttgttccatcaatgaaggcagaaaataattcctgccatgcatttccatttctttggctggtatctctaaacagttaaaggggcttgcgtttctatggaactaggtcaaccttattttataaagcgattaagcatgtgtaatccagcccgtcccctaactctgagtaggagggaaaagaaatagtgagccaacagagcagagacctcacccat

SEQ ID NO: 125763 - DNA, 601 bp, Human
ataacagtattaaaaacttctgtagctagtcttcaggaaaatcccttaacttcttggattcagttcacccggacgaagctatcttagggtctatcagggtaccttcagcttcccaaaatccaagccaaacagaaaacaaaatgattaatattcaatttcgatctccttttattgggattaaaatattctttaccatgtattatttgtaggtagaagtgcttacaagtcagcctgaaaactttactttgataaaagaaatcttttgccccaaagcagtttttcttttctttttttttttttwaaaaacggaatcttgctctgtcccccaggctggagtgcaatgtctcagttcactgcaaactccacctcccaggttcaaacgattctcctgcctcagcctcctgagtagccggaattacaggagtgcgaccacactcagatatttttgtaattttagtagagacgggtttcaccatgttggccaggctggtcttgaactcctgacctcaggagatccgcctgcctcagcctcccaaagtactgggattacaggtgtgggccaccacgcccagctgcaaagcacttttaatatattgttaat

SEQ ID NO: 125764 - DNA, 601 bp, Human
acatcctgatttaaacatatatggcttgtttgctcatacaacctgagttttgctttcttgtctagtaatgtcaatcgcaaaagcaatgtgtaacctctttaaagaacataaattagcaaatatacaactgtcaaagtagaagcaatgctagaccaggaagaatattcctcaatgggaaagacttgagatactgttattttcctagaatgtgttgaaacctatgttagtctaggaggtaccaagaggacaatccctattcatgggctcatatgattctctgtccagcacaaaggtactgagygaaacttctcctattttggcagcaacaagaagaaagggtctttgatgaataatattctccacacatgtagtccttctttagcctttcctattatccttgaaacagatttagaattcttattctcatatggacaaatggaaaatgtttcaaaaatgttaaaaaaatgtagaccaagaagatttcagagagtgtatttcacaccctacatcactttgtaaaaccctgagttctgaaaacatacagaagaaaaatcaacccaaaacaattttttaaaaattggatgggatatcagagatcctc

SEQ ID NO: 125765 - DNA, 601 bp, Human
cctctaaagaaaaaataaaaatcacttaaatcatttgtctccaggagaagacaaggcatttatctgctccaagtacatacacttaattccatgcatgaacaatttctcaatcactggttaagtaacagagacaacgtacattccggggagggccacggcgccttccatagtagccacgtctgtaacggcgccgatctgcagcgtaacgactcccttccacaggaactccatccgggccagtcacattggcagcttctgcaccctgagaagaaaataaaaagatggcctcaaaattaaaaasaatatacactaactcaaaaaacagccttggactgctagagtataagactggcagaacatactaagaattcccactgtgattttaaaaacagatctaggttttaaacaaagtgagcaaggtacttcacatcctgatttaaacatatatggcttgtttgctcatacaacctgagttttgctttcttgtctagtaatgtcaatcgcaaaagcaatgtgtaacctctttaaagaacataaattagcaaatatacaactgtcaaagtagaagcaatgctagaccaggaagaatattcctcaatgg

SEQ ID NO: 125766 - DNA, 601 bp, Human
aaatgctatgctaaataaaacagcctcttaaccaaggcaaattcgttaatagttctgtggcctgtacttttattgcctgttcacaagttatttctcactctttcaccaaccaaattttgattttcttagaggtcaacagtgtcggcaccaaagaatgaacaacaaggttaagtcaatgatggaaatccattcccctttgccagtgaatgtctgtgactaggttctggccagaaaaaagagccaaatgaagagaaaccttgttaaaaaaaacctcagcactgtctcccttaagtcttcctgytaaaagataattaaatgtctattacttgtagccaaatatatcctaactgatacaacttctgaatggcaagtgtctaatgagaccagcggctctggaaaagttctgagcgctaaaatttccccttaagagtaccgtgtatactgctccagtgatgggtgcaccaaaatctcagaaatcaccactaaagaacttattcatgtaactaatcaccaccggtttcccaaaaacctatggaaatcaataatacacattttaaaaaataagataaaaatttcctctaaagaaaaaataaaaatcact

SEQ ID NO: 125767 - DNA, 601 bp, Human
tccgttttgggtgccttgagaatactcctataaactgagcctcccaagaaagctccagccagatttgtgacaaactctttcccctgcattgaaaccaacctaaagaactaaaaatccacagaatcacttattgcttctttactttgaaataatggaaaaatgctatgctaaataaaacagcctcttaaccaaggcaaattcgttaatagttctgtggcctgtacttttattgcctgttcacaagttatttctcactctttcaccaaccaaattttgattttcttagaggtcaacagtgtcrgcaccaaagaatgaacaacaaggttaagtcaatgatggaaatccattcccctttgccagtgaatgtctgtgactaggttctggccagaaaaaagagccaaatgaagagaaaccttgttaaaaaaaacctcagcactgtctcccttaagtcttcctgttaaaagataattaaatgtctattacttgtagccaaatatatcctaactgatacaacttctgaatggcaagtgtctaatgagaccagcggctctggaaaagttctgagcgctaaaatttccccttaagagtaccgtgtatactg

SEQ ID NO: 125768 - DNA, 601 bp, Human
aaaaaagcaaaataatgacccattacttttttttacaggagtgtatttaagctttggacccttccagaacaagtccacatgtgcaaccaaactccccctccaaaaaagcctcaactagtctaacttcaaaaaaaatcaagtcattctactcttcataaaacctctaccaaagatgagattcacaattatgtaaacgtttatttgcacagaaaatgcttaccaaaatattaagtgtgagacaacataaactgtttttcttcttgggcttatcttcctcttttgcatttcacacaatcaaatytttaagagttttacaaagcataataatggcaccagcaatgctgaacacactcttttgagagatactgaacaagttgttgggacttagatattacaacaaaaaagctcatttatgtatactttaagagttttaacaattttgtttcttaagcgttttaacaattttgtttctaaatatcttttatatgcatgactttggaattttcaggttttggacaggaaaagtctttaagaaaaatttttcactgaatgtttttctaccacttttgcttttgaattaacctgggagtcaaaataatca

SEQ ID NO: 125769 - DNA, 601 bp, Human
gaagtaactagtttttaaaaatgaataaataaaaaaagcaaaataatgacccattacttttttttacaggagtgtatttaagctttggacccttccagaacaagtccacatgtgcaaccaaactccccctccaaaaaagcctcaactagtctaacttcaaaaaaaatcaagtcattctactcttcataaaacctctaccaaagatgagattcacaattatgtaaacgtttatttgcacagaaaatgcttaccaaaatattaagtgtgagacaacataaactgtttttcttcttgggcttaycttcctcttttgcatttcacacaatcaaatctttaagagttttacaaagcataataatggcaccagcaatgctgaacacactcttttgagagatactgaacaagttgttgggacttagatattacaacaaaaaagctcatttatgtatactttaagagttttaacaattttgtttcttaagcgttttaacaattttgtttctaaatatcttttatatgcatgactttggaattttcaggttttggacaggaaaagtctttaagaaaaatttttcactgaatgtttttctaccacttttgc

SEQ ID NO: 125770 - DNA, 601 bp, Human
aaaagcaagagcaatcaatctacaatcaatttaatagtcatctcattagaactcgtatcagctaaccaaccacccgaagagtatctgcaaggtttataatttttgctccatcaaatgcgtgtctcccagcatttaccatccactgaggcaatgtcagggaaaagccaaaaaagaatacattttatgatgttaccaacatatttgacccaagtggtattcttcctacaagtctgtaaagtgtggatgggatttctgaaaacttccagggggtcagcgaggtcaaactattgccataatattwctaagatgctatttgcctttcccaggcattctctcagaagtatatggtggggtctcccaaaggctacaatgacatgtggtctctcagcagactgaatgcagaaacagatgtgagaatccagctatcttctattaaaccatacatcagagatctgcaaaagtataaagcaataccactcttttcaatttaaatattttttttccataaaaactgttattttcatgaacatatagttatttttaatcaattaacattttaagtttattttactttctaatataatattaatataaataaaca

SEQ ID NO: 125771 - DNA, 601 bp, Human
agaaggaaaaaaacaagaaagaacacagtcatgcatgatgggacaggagaagggtagcaaagaacagactgaacataatgttcggtcaaaacatctagcggtgaggggaaaaaaaagaaaccccaacgacactgaggagaaaaaagttgtggctactgataacaaaaatgatgatctatccctagttttccaagttccctaggaactgcaaaattgatgtaaggtttattaagcacaaaacaaactcaaaacagctgtactaatattctgcagtgaaaaaggagaatcaataatcaacaayctccattctggtaggttgcctttaaaaatcagcactgtctcatttaaaaccaatactttataaatgttatttatgctgcaggcatctcttttgctaaatcctttatatttaatcatcataaccctatggtgcaggcatttaatgcccccacttaatggatgaacttaatctaaaacttggttttctcaaaacctcacaaataagtagcagaaacaggattcaaatccagcctgacttcagagtccaagctcttacacattccacctgtcttgttaccttaattcttttgttcttctatca

SEQ ID NO: 125772 - DNA, 601 bp, Human
tgtataagccaaacactaaggaggagtatttcaggaaagcactattaagacgctaaaaataagtgcatattacaatctcactgacttttcctgtccttgtttcctagaagcccagagtgctgccctaaagctactatgtctcatgtacccaatctctccatatatgtaagtctacttgttatttttagcacatttgtcaggggcagctgttgaagagtagaaggaaaaaaacaagaaagaacacagtcatgcatgatgggacaggagaagggtagcaaagaacagactgaacataatgttyggtcaaaacatctagcggtgaggggaaaaaaaagaaaccccaacgacactgaggagaaaaaagttgtggctactgataacaaaaatgatgatctatccctagttttccaagttccctaggaactgcaaaattgatgtaaggtttattaagcacaaaacaaactcaaaacagctgtactaatattctgcagtgaaaaaggagaatcaataatcaacaacctccattctggtaggttgcctttaaaaatcagcactgtctcatttaaaaccaatactttataaatgttatttatgctgcagg

SEQ ID NO: 125773 - DNA, 601 bp, Human
ttactatcctagagatccatctatatatttttaagagaacacactgacaaccttgaagtagcttagttatatggatgagagctttaggaattttcttttgatgctcttgactggcttaaccagactacttagtcagagagctagtagatattataaagattattaaaaaatatggtttaaaggatcaagacaacttttacttctgacatggaataggtaggaaagtcagccattcagtcaattaactaaatgcagttaagttacaggaataagcgtacatgttcaaaagcagctttcgatyagcttctgcatatgatgttttacgtggcactaaggaacgactttgctctgaaacttcaattcctaaggtgaaatacattttatttcaaaagatatgaaaaagaatcatcatgctttcagcaaacgtgatatatgttgtataagccaaacactaaggaggagtatttcaggaaagcactattaagacgctaaaaataagtgcatattacaatctcactgacttttcctgtccttgtttcctagaagcccagagtgctgccctaaagctactatgtctcatgtacccaatctctccatatat

SEQ ID NO: 125774 - DNA, 601 bp, Human
catcctgttttataactccaaatcagccaggagcggtggctcacgcctgtaatcccagcactttgggaggccaaggcaggtggatcacaaagtcaggagattgagaccatcctggctaacacagtgaaacctcgtttctactaaaaatacaaaaaattagccaggcgtggtggcgggtgcctgtagtcccagctactcaggaggctgaggcaggagaatggcatgaacccaggagatggagcttgcagtgagccgagatcgtgtcactgcactccagcctgggtgacagagtgagactccrtctcaaaaaataaataaataaataaataaataaataattccaaataattatttgcagttccatttctccccttcagactcccattcacgcctttcctgggacctgatggacttgatcccttgctccatttaggtctcttctcaaatacaacttaatgaactcccaaaaatgttgtcaaccactgtatctaagactacaccttccatcctccagccactttctacctcttccctctgctttatttcttctgcctacttaacacctccacttgtacgtgaatttaatatgagaaaaagacct

SEQ ID NO: 125775 - DNA, 601 bp, Human
aggctcatattatactttctctgtcccagctctgaaatcagccatttctccaaagggaattctttttgtttgagaatgttatttaaaaacaaaaaattgggggacaggtatgctcaatgctgttactaagatatcacggctttcaggacctttcagtagacagaaccatggaacacacacacacaatgttacacatatatgtgtgtctatgtatgtgtgtatatatatatgtgggtttatggcaaacacacgtgcctaccttgatctgcccatttaatggctttagaagttgttggtgagrtaacgggtaagggagagaccaggggtaactctgcattgtaaaaagcaaatcaaatcaagcaaaaatcttgctctgatcccttatcttcttccagctactaccccatttctttacagacatacatactaaagaaaaaccaaacaccatgaccaccactacagaaacctcaatggggaatatgtctcctcttcccgccctttgctgtttcttaagttcattctatttaaacttttgtcttcaccaaaccactgacctccaagttaccaaatctaataatcaattctcagcttaatctctact

SEQ ID NO: 125776 - DNA, 601 bp, Human
atctacccacctcagacttccaaagtgctgggattacaggcatgagccaccacgttggttttcatgaccctgatacttctttaaagattacaaaccagttattttgtaaaatatccctcaacttgggttattggtgttcactaatgattagatattgtttttgcatccccagggggatgtcacaaaagtgacactgcattctcctcactgcatcctgtcaggtggcatatagtttcaatttgtgccattactgataatgttcactttgataagtggttaaggtggtatctgccaccagagycctccactgtaagttgactctttccttctttgtaattaatgagtactttgtgaggaagtacttacaaagtgcataaatatactattccttatcaaatttttcaatatattggtttatttatttatatttgtatggactcatggttttctatttttttcaatgagttgtaatctgttactatcattactggccaatgggaaccccttcaagctggctcatatcctattgatgtgtttccaacattctttgagtacttcttcgctttctggcacaacaagatgttccaggctcatattatac

SEQ ID NO: 125777 - DNA, 601 bp, Human
ctccctggttcaagcgattctcctgcctcagcctcgcaagtagctgggactacaggcatgtgccaccactcccagctaatgttttgtatttttagtacagacggggtttcatcatgttggccaggatggtctcaatctcttgacctcgtgatctacccacctcagacttccaaagtgctgggattacaggcatgagccaccacgttggttttcatgaccctgatacttctttaaagattacaaaccagttattttgtaaaatatccctcaacttgggttattggtgttcactaatgattasatattgtttttgcatccccagggggatgtcacaaaagtgacactgcattctcctcactgcatcctgtcaggtggcatatagtttcaatttgtgccattactgataatgttcactttgataagtggttaaggtggtatctgccaccagagtcctccactgtaagttgactctttccttctttgtaattaatgagtactttgtgaggaagtacttacaaagtgcataaatatactattccttatcaaatttttcaatatattggtttatttatttatatttgtatggactcatggttttcta

SEQ ID NO: 125778 - DNA, 601 bp, Human
tcattagcaaatctacccagctccctgtatttacattagaattttcttctctcccattaccctgggtaagtggtccaagttcatatctgaaaccaacagcctctctattctcatcaactagacacagcatgttaacgctatcccttcactatgttttcaccttttctatcatttccatccaagcatatatacccagtgaaatagcacccatccttttcaattttttaaaattttgaaataagcacaaagttacagaaaagttaaatgtaattctcagatcccattcaagtttcaccatttrtcccaatgatgccctttatagcaaaaacaccgtttagaattatgcactaaagtaagttatatctttttgtttggagcagttttttttaatttatttatttgagatggagtctcactctgtcgccaggctggagtgcagtggcgcgatctcagctcactgcaacctctgcctccctggttcaagcgattctcctgcctcagcctcgcaagtagctgggactacaggcatgtgccaccactcccagctaatgttttgtatttttagtacagacggggtttcatcatgttggccaggatggtc

SEQ ID NO: 125779 - DNA, 601 bp, Human
attttgaaatcggatacatttcattcatctctttaaataaaatactcttttatttttctttacaacaaacttactttaagccagtggaataaaattaacttattgtacaacttccaggggaaagaaagaacaacttaaaaaaacaaaaaaacccaccaacaatgtctgcaattcttgaccatacagccataactcaactttcttttcttttctcaaaacatcccttcctccccctaagagccaaatactgtccttcattatttcatcaagaaagagaaacagtcagaagacaatttccacrttctcattagcaaatctacccagctccctgtatttacattagaattttcttctctcccattaccctgggtaagtggtccaagttcatatctgaaaccaacagcctctctattctcatcaactagacacagcatgttaacgctatcccttcactatgttttcaccttttctatcatttccatccaagcatatatacccagtgaaatagcacccatccttttcaattttttaaaattttgaaataagcacaaagttacagaaaagttaaatgtaattctcagatcccattcaagtttcacca

SEQ ID NO: 125780 - DNA, 601 bp, Human
tctgactagaatactcatttgcttagtcccagagcacctaactttattttcgcctatcaatttaacattttgaaatcggatacatttcattcatctctttaaataaaatactcttttatttttctttacaacaaacttactttaagccagtggaataaaattaacttattgtacaacttccaggggaaagaaagaacaacttaaaaaaacaaaaaaacccaccaacaatgtctgcaattcttgaccatacagccataactcaactttcttttcttttctcaaaacatcccttcctccccctaagagccaaatactgtccttcattatttcatcaagaaagagaaacagtcagaagacaatttccacgttctcattagcaaatctacccagctccctgtatttacattagaattttcttctctcccattaccctgggtaagtggtccaagttcatatctgaaaccaacagcctctctattctcatcaactagacacagcatgttaacgctatcccttcactatgttttcaccttttctatcatttccatccaagcatatatacccagtgaaatagcacccatccttttcaattttttaaaat

SEQ ID NO: 125781 - DNA, 601 bp, Human
tcacaccaccacctgaaaactctggcatgtagtcaaagcattcacatcttctagatatataataaatccacaaaacggaaccacacagtcctcattctaccattgtgcacacaagtcctttaactggccattagtggaaaatgcgacatacctacggtaccttgggcggtaagttggatttcgatgaaccggtccctgaagttgtgctccctctgggactccatccttcatctctccaatctcaccagcctggagaggcaatgagagctgacagtgagtgtcacagcacaggggataagayacagtgcatacagctatgttcagaattttttttagaagtaaaaaacaaaatgcttcattacaaaattaggcactctcagttgcaacacaaactatttatgagtaaatcttcgtgaacgactgaaaaggaagacaaacctagtctgactagaatactcatttgcttagtcccagagcacctaactttattttcgcctatcaatttaacattttgaaatcggatacatttcattcatctctttaaataaaatactcttttatttttctttacaacaaacttactttaagccagtggaataaa

SEQ ID NO: 125782 - DNA, 601 bp, Human
tcttatggaaggagtctagcctaattcagtcttccaaaggaataaagcacaaatagaataacccagcgttcactaatattaacctcaatggtggtaataatatctaatacatagtgaggcctttactttatcaggtaccacactaattatcttagctgcattagtacctttaatccccaactatagaatatctctttgttttcagacagggtctcactctgttgcgcaggctggaatgcagtccaagaacatacatctaatgaactgtagagtaggaagataaattcaggcgatttgatcrtaccctgatttaacccctctactggactgcctcagtgattaacagtcactatcccaaatatcctctgacactcaattcttcctccatctgcagcattaccacagaattgcccaccaataatttatctgatttattttgataaaaattaagtattaatttacatcttattataattccagaatacaaaatgacgctttggcgcagagataactaaaaattctagtattaagtaggtgggaaatgtcacaccaccacctgaaaactctggcatgtagtcaaagcattcacatcttctagata

SEQ ID NO: 125783 - DNA, 601 bp, Human
aatcattagtgattatgcctaaagctggagggaaccttgtgaagaaaaaggatacgatccttttacaattatattggtggaatcctttcccaatataatatactttttatccttcaataaagccatactgacaaatttcaaggtagcataaacatcattcaggaagaagttgtagcttttccacttaccacaaagggtaagataaaagaatgggcaggcttatattataaaatgcttcaaagggatcttatggaaggagtctagcctaattcagtcttccaaaggaataaagcacaaatasaataacccagcgttcactaatattaacctcaatggtggtaataatatctaatacatagtgaggcctttactttatcaggtaccacactaattatcttagctgcattagtacctttaatccccaactatagaatatctctttgttttcagacagggtctcactctgttgcgcaggctggaatgcagtccaagaacatacatctaatgaactgtagagtaggaagataaattcaggcgatttgatcataccctgatttaacccctctactggactgcctcagtgattaacagtcactatccc

SEQ ID NO: 125784 - DNA, 601 bp, Human
ggagcgttaggaggacgcgggcgacgccggtaattgtagggacgccggtatccacggcgaacagacggctggtttggaccactggtggcttgctgattttctttatcttcagcctctccaactgctggggcaggtcgtgggcgaggaggtcccctgctgtagggaacacagaagaaaatagaacaggtgccaacaggacagggcttctccagaaaataaggttttatttatttttaaaaattaaaaagtcaagtgatcagggccaggcatgatggctcacccctgtaatcccagcacttcrggaggctgaggcaggcggatcacttgaggtcaggagtttgagaccagcctggccaacatggtgaaactccatctctactaaaaatacaaaaattagccgggcgtggtggcacatgcctgtaatcccagctacctgggaggctgaggcataagaattgcttgaatccatgaggcagaggttgcagcaacccgagattggcacactccagcctgggtgacagagggagactccatctcaaaattaaaaaaaaaaaaaagtcaagtgatgagtacttattgctagaattattcgcaggtcaat

SEQ ID NO: 125785 - DNA, 601 bp, Human
ataaagtctgatatacaactgctttcaactcatgcttagaggcagcttcctcttgataaatgcctctcttctttgaagaaccccaaatgttttagctctgaatccccattaatatgggtcattctttcagagaatgttaactggattcaaatatgtggtctgtgttatgtacaaggcataccctatatatatggatcttgagcaaaatgtttttatatttgttaagtgtcaggtttcatgtgataaaaccacttttagaatgctaaagtctgacatgattaaagactatctggcaacatcygccctgactggttggatttacctctttgccatcttgtgaaggagcgttaggaggacgcgggcgacgccggtaattgtagggacgccggtatccacggcgaacagacggctggtttggaccactggtggcttgctgattttctttatcttcagcctctccaactgctggggcaggtcgtgggcgaggaggtcccctgctgtagggaacacagaagaaaatagaacaggtgccaacaggacagggcttctccagaaaataaggttttatttatttttaaaaattaaaaagtcaagtgatcag

SEQ ID NO: 125786 - DNA, 601 bp, Human
ctcacaaaaacaaaaaacaaaacaaaacaaaattagtaccatataagaacagcttacaaaacggcaactaaataccactactctccataaagtctgatatacaactgctttcaactcatgcttagaggcagcttcctcttgataaatgcctctcttctttgaagaaccccaaatgttttagctctgaatccccattaatatgggtcattctttcagagaatgttaactggattcaaatatgtggtctgtgttatgtacaaggcataccctatatatatggatcttgagcaaaatgtttttrtatttgttaagtgtcaggtttcatgtgataaaaccacttttagaatgctaaagtctgacatgattaaagactatctggcaacatccgccctgactggttggatttacctctttgccatcttgtgaaggagcgttaggaggacgcgggcgacgccggtaattgtagggacgccggtatccacggcgaacagacggctggtttggaccactggtggcttgctgattttctttatcttcagcctctccaactgctggggcaggtcgtgggcgaggaggtcccctgctgtagggaacacagaag

SEQ ID NO: 125787 - DNA, 601 bp, Human
gggtggagcagggttctcagttggtgcttcacctgccttggcctaaaatgcaaaacaaagccataaatcagataaagtcagatgacagtggaaagttcaagactgaaagttcttaaaagtttgaattttcctgtgaaggaaaattagcatgcaaaaatttaactactcttaagtatgagtcacaaattagtaccatattcagtccctggcatctctaccaaaacaaaacgaaaccaaaacctcacaaaaacaaaaaacaaaacaaaacaaaattagtaccatataagaacagcttacaaaacggcaactaaataccactactctccataaagtctgatatacaactgctttcaactcatgcttagaggcagcttcctcttgataaatgcctctcttctttgaagaaccccaaatgttttagctctgaatccccattaatatgggtcattctttcagagaatgttaactggattcaaatatgtggtctgtgttatgtacaaggcataccctatatatatggatcttgagcaaaatgtttttatatttgttaagtgtcaggtttcatgtgataaaaccacttttagaatgctaaagtctgaca

SEQ ID NO: 125788 - DNA, 601 bp, Human
gagcctgcaatgggtagataaaccttggctcttatacactatgctgcaccgcctcaaaataaataaagttgattatcaaagaaaaagggaaggaaaaaaaatcctttagtttattctactgtttctgattactaaacaggttctgaaactgtttctgattactaaaaccaggcctttgttagggacttttagcatcagttttcctaagtggtactagtagttaaaaaactgcctgtctagaaaaaagaagttgagtatcatcaactctgtctgaatgcttataccctcaccaaagcttatyaaaatgaggtcaatcccagaaatatttaaccaccaaatcactttttccacagagtcccaatagagacaaggggttggcacagatgaactgcagaactagtttagactaatttgtactcttgttgagaaaccagtgatactaaaaagaaaataccaactcaagactgggctgccccagctcttacctgccgatggtgaaggtgcctgaggagcctggtgttactcagcactgctctgctgggtgggtggagcagggttctcagttggtgcttcacctgccttggcctaaaatgcaaaacaa

SEQ ID NO: 125789 - DNA, 601 bp, Human
taaaaagacacacactacatgttctccatatattaaacactaaacatactgttataagcaccacatcacaacctgtaacatttctaaattcagacaaaactcatgggcagctgtttgacacaagtacaccaagtcactccaacagtgcaggatgcaaacaatgacttctaattgagttgctgtatctatacctacccgccccttacacacacacacacacacacacacacacacacacacacacacactagaagtatggaccagtagataaatgggacaatgagcaagggtccaaaaaaayagactggtacttataactaccctctagtagacatgtgccagcaatcactggctcctgaagtaatttaaagtaatacctttgagttttgtttcttcaccagtttcctcttcttctacttcttcaacatcatccaaatcttgatcaagttcagactgttctttgctataatatcatagtatcacaccaaggttcaaatgtaccaattaccaaaaaaagttacagaaaaacttaaaattcattttcaaaattagtatctctttcaaagacatgaaataggaaattcaaaaggtaattccgttt

SEQ ID NO: 125790 - DNA, 601 bp, Human
ccccaccaccactccttttaaaaatatctgctaaaataaattgtgaatattacctacatttaataaatggctcttctgcttgaaggagtggatctttaaaaagacacacactacatgttctccatatattaaacactaaacatactgttataagcaccacatcacaacctgtaacatttctaaattcagacaaaactcatgggcagctgtttgacacaagtacaccaagtcactccaacagtgcaggatgcaaacaatgacttctaattgagttgctgtatctatacctacccgccccttacacacacacacacacacacacacacacacacacacacacacactagaagtatggaccagtagataaatgggacaatgagcaagggtccaaaaaaatagactggtacttataactaccctctagtagacatgtgccagcaatcactggctcctgaagtaatttaaagtaatacctttgagttttgtttcttcaccagtttcctcttcttctacttcttcaacatcatccaaatcttgatcaagttcagactgttctttgctataatatcatagtatcacaccaaggttcaaatgtaccaat

SEQ ID NO: 125791 - DNA, 601 bp, Human
taaataaactttaaaagaccaatgcaaacaggtggtactaagcacaattttaaacttctaataatcctatactggatactaacagacaataggtttccactattgcatatctaaatcctagatggtcttaaaaatagatacgcctgcaacgttgattatagaaagataaataaggactatggaaaagttgtacctttcaatgtatcctgttggtgtttctaccagaccatcaagtctttcttgaagggctgcaagaatctgaggattttgcatcatctgaacagttagctgacgtgctttaaaaaaaaaagggcatcgaaagaaggattttatgaaaatgtattatgcttttttaataggacaatccaatctcatgaagttttcctaactggcccataaattgctggtatatctaatgagtagagacgggcagggaaagctaaagagaatacactaaaggaaaacccaatgttcaggaataattcagattcctaatctatctctagtcaagacagttctcaaggccactgccacaactatatgaacaatatcctttctcttcctggtatcctgtgtttcacccaccttgcattttaagaag

SEQ ID NO: 125792 - DNA, 601 bp, Human
ttatgtcatcagtgaaataagaaatctgtatttcttctaattctgtgcatttctaacatacctctaaacaaatctctgaaatgctcaagatcagtacacttcctataaacttgaaccacaataaataaactttaaaagaccaatgcaaacaggtggtactaagcacaattttaaacttctaataatcctatactggatactaacagacaataggtttccactattgcatatctaaatcctagatggtcttaaaaatagatacgcctgcaacgttgattatagaaagataaataaggactayggaaaagttgtacctttcaatgtatcctgttggtgtttctaccagaccatcaagtctttcttgaagggctgcaagaatctgaggattttgcatcatctgaacagttagctgacgtgctttaaaaaaaaaagggcatcgaaagaaggattttatgaaaatgtattatgcttttttaataggacaatccaatctcatgaagttttcctaactggcccataaattgctggtatatctaatgagtagagacgggcagggaaagctaaagagaatacactaaaggaaaacccaatgttcaggaat

SEQ ID NO: 125793 - DNA, 601 bp, Human
catatagacagtaactgaatggatcttaaaatcacaaaaaagttttttaaatgtgtaagctgagtaagatattcatgctattaataatgatttatgtcatcagtgaaataagaaatctgtatttcttctaattctgtgcatttctaacatacctctaaacaaatctctgaaatgctcaagatcagtacacttcctataaacttgaaccacaataaataaactttaaaagaccaatgcaaacaggtggtactaagcacaattttaaacttctaataatcctatactggatactaacagacartaggtttccactattgcatatctaaatcctagatggtcttaaaaatagatacgcctgcaacgttgattatagaaagataaataaggactatggaaaagttgtacctttcaatgtatcctgttggtgtttctaccagaccatcaagtctttcttgaagggctgcaagaatctgaggattttgcatcatctgaacagttagctgacgtgctttaaaaaaaaaagggcatcgaaagaaggattttatgaaaatgtattatgcttttttaataggacaatccaatctcatgaagttttcctaac

SEQ ID NO: 125794 - DNA, 601 bp, Human
aatagaatttgtgttgataaataagtccatcataggaaaagcagataataaaacacagcgaacacataccacagagaactaggcaacatttagaagctactaactataattaacatatagacagtaactgaatggatcttaaaatcacaaaaaagttttttaaatgtgtaagctgagtaagatattcatgctattaataatgatttatgtcatcagtgaaataagaaatctgtatttcttctaattctgtgcatttctaacatacctctaaacaaatctctgaaatgctcaagatcagtayacttcctataaacttgaaccacaataaataaactttaaaagaccaatgcaaacaggtggtactaagcacaattttaaacttctaataatcctatactggatactaacagacaataggtttccactattgcatatctaaatcctagatggtcttaaaaatagatacgcctgcaacgttgattatagaaagataaataaggactatggaaaagttgtacctttcaatgtatcctgttggtgtttctaccagaccatcaagtctttcttgaagggctgcaagaatctgaggattttgcatcat

SEQ ID NO: 125795 - DNA, 601 bp, Human
ataattcacttacttagccaccagtttacttaagattattagaaataaaaaacaaacacttgaagatatcaactttctatttctgttaattttaagtgaaaagcactattctgccaaggtggtgaactggcatgggcttctggcttttcttgctcccccaaaaagctaatcccagaaactttagaacaagaatgaagcaactactgaggcacacacacaccataagcaatttcaggtaagactggaggttgtgtttaactgtacagggtaaccaacaacttagggagggaatggccacagyaggtagcagtgcggacaaactggaagatagcagttccgcaagaaagctttttaagttctgctcctgccttgcaacaatcgttgtctgtcatcttcacccttcacaagagcccaatgcgagggttgatgaaagctgcacggttcaaagccttcaaacatgtatttgatccaatctaggaatgatgaattgacaaccaaaggagactagtcccccaccctacaaagcacaccataaaaattgcctggactggcagcaaactttcagtgtaaggcaactagtgctctactacttaggctcacc

SEQ ID NO: 125796 - DNA, 601 bp, Human
gtgaatgacaggttttttatctgaagcaaaaggtagattcaaagtaaataaaaatcaaatagatataaatacattgatccactggctatatttcaaaagtagaaatgtaactgggtaaattgataaacaaaatgtaaatcatattgtcaaccctaaatctttacccaagttaagtgttggacttgtcattgctgaagtcatggacagaccatcttaattctgagaacaatgattacttggatttttcttttacatatatctcacccatacaagttattaggaaaaaggaggggagcatagrcatatcaggaaaaaggacaagattccacacaccattatttttttagtctccatatttaattaggaattagtaattacattattaaatacaagtgtaacatactataaagaggagacatgtatttttaaaataacagctttagggccaggtgctatggctcacaactgtagtcccagcaccttgggaagccgaggcaggtggattcctttagcccaaaaactcaagaccagcctgggcaacatgacaaaaccctgtccttacaaaaaatacaaaaattagctgggtgtggtggtgcatgcc

SEQ ID NO: 125797 - DNA, 601 bp, Human
ctaaccgaaatctcatcttcttcatctggtttccattcacattcttcttccgtaggttcataaattgcattaataatttcaaatcgctaaaatgatttaaaaaaaaaaggctgtataaaaacactggcatccaagctaaaaccagtggtttctcactaagaagtcttacaaatttaacaaatgcataccacaactttaactgctattattgatagttcctccaagtgctgcctctaataacaatttcaatgagagttctaaagattaacctcttccaagtctgcttatatttctagaattygtcttctagaatgttaaattaaacaaagtaggagaaagcattaccttatcaaatagaggctgatagagaacagcatacttcctttcaagatcatgaacttcctcatagaatttggcttctatctgtgcacatttaacttgcaggtttttgagagcattcactcgtcttttaactaccctaggcaggctgaaaggttagaaatcagttatatagcatcagagtaaaatggaagtcacacttcttttgtcatactgaaactgaagcattggagttagtgaatgacaggttttttatctgaag

SEQ ID NO: 125798 - DNA, 601 bp, Human
ccgagtaggtgggattagaggcacccgcctccacacccagctaatattttgtatttttagtagagatgggatttcaccatgttggccaggctggtctcgaactcctgacctagtgattggcccacctaggcctcccaaagtgctgggattacaggcatgagccactgcgcctggcctttctctttctctctttttattttttgaaaaacccggtagactttgcggtgaccatttttgttgattattttactgatctaaagctgagtgattttttaaaagaatttgaatttggcttcctcascaataatatgtctccttgcttctctgatgtgatagttttgagatgggtgagaatctaatatatctgtggttgaatttgctttgctgttatcaagtccaccctatgggcacaataacatactgttggtaggagttgttggagctattctggagattatttggtaaagtatactaaaagccttaaaaccacgtatgtgcactgtttgaaccagtaagccacttctttgaaattagaagacattagaagaaacaataagccttgcaataaaacttatggatgaaagtattcatcacaatatga

SEQ ID NO: 125799 - DNA, 601 bp, Human
tacctactttgagtcctttattgtggagtctgttcattaccaatagagtactgtgaatatatgcctgatgttgctaaatgtagacaatgattagagaagaattttccaaatgaatatgcaaaacttactgtggaaaattcacccaaacaagaagctggaatctgtcaaggtcaaggaacagcaggggaagaagaggagaagaaaaaacagaagagaggtggaaggggtcaaataaaacaaaaaaacaaagacggtaccacaaaaggttactatagccaaaattcccagagcaaagaaataygtgacaagggttgtggccttgtaacttttgaaattgatcttaaatcacacaaagattttttgctcaaaaattctcctgtggtgcctcagtaacagaggaggatgaaattatcattcaaggagactttacagatgacataattgaggtcattcaggaaaaacagacagaagtagatgatgacagcatcgaagatcttggagaagaagtgaatttgaaaatttgtctgtagttaatggcctgaactgacagtagatatggccaaagggagagaggcctacatatatatatatatatatatat

SEQ ID NO: 125800 - DNA, 601 bp, Human
atcaagtataacaaaaacagaaaaaacattttgttaaggtagtaaaattaaactcaccctgtacaacccataatttctggtccatcaaaagaaaagggatcagaatcatctggttctgacctcatcctgtatgtctttgtcagcacttcatttgtaaaatattcattgggttcaaagtgaaattctaagacaaaactctggggagaggaagcataaaaatcagttaaatacctacctcacatatttcagtactttagtaaacacagcttcatctgtttttataaatattctaaatgataatttttttttctactctgaaatacaatcttctttttgagactgagtcttgcattgttgcccaggccggagtgcaggggcacaatttcagctcactgcaacctttgcctcccagattcaagtgattctggtgcgccagcctgccaattatctgggattataggtgtgtgccaccacacccagttaatttttgtatttttagtacagacagtgtttcaccacgttggacaggctggtattgacctccggacctcaagtgatccacccacctcggcctcccaaagtgctgggattacaggtgtga

SEQ ID NO: 125801 - DNA, 601 bp, Human
tcaaagtgacattctttccttttttccaatctatctggcaccttgcaaaacaaagaagaaaaatctattacaattgacaatctttcaactgctaaacttttagaagtaaatgttctatttagatttcaaattttagaagggtgaattgcttcaaatgttttctatagcagtataaagggaaaaattttatttctaagcaaatatttaaaataaacacatttacaattagcacaaacacatagtataatttaaagaagcattcctctgcaaaaatatatgtgagacagtcatgggtccaagsagaattacaggaaacttgataagcacttttcagaaaacatattaccaaaatgttcagagacagactatgtacatatgtaactgaaaataaccgagtatacaaatcaagtataacaaaaacagaaaaaacattttgttaaggtagtaaaattaaactcaccctgtacaacccataatttctggtccatcaaaagaaaagggatcagaatcatctggttctgacctcatcctgtatgtctttgtcagcacttcatttgtaaaatattcattgggttcaaagtgaaattctaagacaaaactc

SEQ ID NO: 125802 - DNA, 601 bp, Human
tgtcatcatcaatatttagtaacaaacaaacaaacaaacaaaaaaaaaccccaaacttgaacacaaactccaacccatccactgatacgaaaatagtgtgatgctctatcttaatacttaaagtagtttttctcacctgaaattcacactgctttatgttctctttttttgtcctataagccaagccagaaatacttacttttgccttttacaaatttgttctaagtcttagccaagagtattccaattcaaaagtattcagtttaggttaatttctaattccatatatgtacaaactatktaaactatctcagttaatttaaattcaaaaacatgcccaaaagaaaaccaaattcaaaacatacctgccctaccttgtgtgtatagactttctttaaggttgttcctcagttcagtctatatggcaggaacatttcatgttctttgccatatgccatatatgtgaacatacttagtcacaatatgaaaccatatttacattggagtaacaaattcaggaatgaatttgaaccataatgtagttaggaatgtaacagtataagtgacttaatatattctggttttactaaggaagacaaca

SEQ ID NO: 125803 - DNA, 601 bp, Human
aaaaaaaaataataataataaaataaaataatcccacttctatgatactaaacaatgatacaagttctatgatactaaacaatgagcacaccctctgtgaattccatgaatgtttgagtcaacaacataatctaataaatagaaaaatccaaaagggggtggggaggaattcaaaccacaggtggaggttttctatccttaactagactgttttgtcatcatcaatatttagtaacaaacaaacaaacaaacaaaaaaaaaccccaaacttgaacacaaactccaacccatccactgataygaaaatagtgtgatgctctatcttaatacttaaagtagtttttctcacctgaaattcacactgctttatgttctctttttttgtcctataagccaagccagaaatacttacttttgccttttacaaatttgttctaagtcttagccaagagtattccaattcaaaagtattcagtttaggttaatttctaattccatatatgtacaaactatttaaactatctcagttaatttaaattcaaaaacatgcccaaaagaaaaccaaattcaaaacatacctgccctaccttgtgtgtataga

SEQ ID NO: 125804 - DNA, 601 bp, Human
taatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatgacaaggccaaattatcgtagaggatgtttgyggtcttgtgacttggaggctgaaagaatttcagaagctcttttaaatggcagtgtatggcagtgtatctaccagaggtttgctgtcatctgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggcc

SEQ ID NO: 125805 - DNA, 601 bp, Human
tctgctccttggtcatgccaaggttgtgtgctctttagacccttggtactaactgttccctctgcccagaatgttcctcgcccagtcctttgtgttgcctcctatttgtcaaccaggtttcagcctaaacctatctccttaggaagactttccctaactatcccatctaaattagtcaccctccatcacattatcctcttttttcatcaaagtccttacacctgtctggcaatttcttattaattgatttgtttttggtaaactccacgaaaggtgggagtcatttctcttgtttccattytttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacgg

SEQ ID NO: 125806 - DNA, 601 bp, Human
taggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgttatcaccaagcaccagggcaggcaccacaacaaaaagataagatccctaacccttcttttacctcgaaataattcctcctagaccctatcatcgcattccttctcttccccttttgtcaaacttccactcacatgtagatattctsagggttatcatgcctaggcctttttaatagggccacttaccctagcatgcttctacaactggaccctcaaaggtcttttagggctgagtgtggtggctcacacctgtaatgccagcattttgggaggccgaagccagaggactgcttgagcccagaggttcaagaccagcctgggcaccatagccagaccctgtctctacaaaaaatagtttcaacaaattagccaggcatggtgatgtgcgcctgtcatcccaagtacttgggaggctgaggtgggaggattgcggattgcctgagccc

SEQ ID NO: 125807 - DNA, 601 bp, Human
gaggatttaatggctgcacctccgagcaagttggtaatttacatatcggaatgctatccatcaaggaaaatgggcagactacagttacatgcatcaacacagacaagcttcaaacaatattgagtgtaaaaagcaagacatagaaatatatatttagtaagagtaaaaatacagtaaaggtaaaaaagaggcaaaactaaacaatatattgcttaagcaataaggatacacaaactaatgaaaatcaaaggatttactaatacaaacttcagtatagtaattaattggaatgggagagaargatgcaaagtttctatttctttttttgttttgttttgagacagtgtctcattctgttgccaaggcaggagtgcagtggcaggatctcagatcactgcaagctcagcctcctgggttcaagtggttcttctgcctcagcctcccaagtagctgggattacaagcatgcaccaccacacccagctaatttttgtaattttagtagagatggagtttcaccatgttggccaggctggtctcgaactcctggtcttaagtaatccgcccacctctgccatcaaagtttctgtttcttaagttgg

SEQ ID NO: 125808 - DNA, 601 bp, Human
ctcctttatgtatataaattagagcagataaatgtccagaagattataggccatctttctataaacagccaatcttggacctggtgtctgaatgggggatgccctgctgcattaaagatgctcatgtgaacattttgttgtttcccagaaaaaaagtttccacattttagattattttcacagggtgagaacaattttacacctcccttacttgctgcagaatcttttttttttttttttttttttttttgagacaggtcttgctctatcactcaagctggagtgcagtggcacgatctcrgctcactgcaacctccgcctcccaggttcaagcaattcttctgcctcagcctctcgagtagctgggattacaggtgcgcaccaccatgcccagctaattttttgtatttttagtagagatggggtttcaccatgatggccaagctggtttcaaactcctgaccacaagtgatccgcccacttcggcctcccaaagggctaggattacaggtgtgagccaccacgcctggctgctgtggaatcatttttaaagtgattgtatcaatttacagtgttccgaacagtaaatggctactagtct

SEQ ID NO: 125809 - DNA, 601 bp, Human
gttaattggaagcatatgtattatataaatatacatgtattatacatatatgtatatatgtatatatatagaaaaaagcaaatatatgtatatatacatatatatctatatatgtaaaatttttatttataaaatgtttttgagcatgaaatgatatatcattgtggtgttaatatgcatcttagctgggcatagtaggtcacacctgtaatcccaacattttgggaggctgaggcaggaggatttcttgagctcaggagttcaagaccagcctggacagcatagtgagaccccatctctaaaaaaaaaaataaaaattatctggcgtggtggctgatgtctgtagttccagctactcaggaggctgaggtgggaggatcacctgagcactggaggtcaaggctgcagtgagctatgatcatgccactgcactccagcctggatgacagagccagatcctgtttcaaataaataaattaaattaagttaaaaagtatctccctgattagtggggaagttacccaactttttttttttttttttagacagagtctcagtctgtctcccaggctggcatgcagtggcacgatcttgtctcacc

SEQ ID NO: 125810 - DNA, 601 bp, Human
taaaacacctccctctccataaagtatttccagatctcctctatcaagcagataggatttcctttggacttctataatcctttctttctacatcttgggtttcactcacttcttatttcatcttgcattacagtcacttgtgtacttgtctaaagggcagtgactatgtttaactcaactttatgcccttgttcatactagtacaaaagtaaacatttcataaatctttgttgaatcaaatcctactcctcccctgcttataaaatcttaaatcatttcctattgtctacagacgaaagtrgaatctcgtttaatgtagaatttaagacccttccacgggctctagcatcaaccttcctttcttgctcttctcctgggaggaccttgctttccgccccagatactagattcttcatccacagtaaggtcccagtccactaatgtttggcttttctctctgtagctgggatggcaggttggtcccacccattttagttgcctataaaattcttttttttttttttttgagatggagtcttgctctgttgcccaggctggtatgcagtggcatgatcttggctcactgcaacctccgcctcct

SEQ ID NO: 125811 - DNA, 601 bp, Human
tcttctcctgggaggaccttgctttccgccccagatactagattcttcatccacagtaaggtcccagtccactaatgtttggcttttctctctgtagctgggatggcaggttggtcccacccattttagttgcctataaaattcttttttttttttttttgagatggagtcttgctctgttgcccaggctggtatgcagtggcatgatcttggctcactgcaacctccgcctcctgtattcaggcaattctcctgcctcagcctcccgagtagctgggattataggcaactgccaccatgyccggctaatttttgtatttttagaagagacggggtttcaccatgttggccaggctggtctcgaactcctgacctcagatgatccgccctcctcggcctcccaaagtgctgggattacaggcgtgagccaccgcgcccggtctgagccaccgcgcccggtctgagccaccacacccggtctaatttttgtatttttagtagaggtggggtttcaccattttggccaggctggttttgaactcctgacctcgtgatctgcccgcctcggcctcccaaagtgctgggattacaggcttgagcc

SEQ ID NO: 125812 - DNA, 601 bp, Human
aaaattcttttttttttttttttgagatggagtcttgctctgttgcccaggctggtatgcagtggcatgatcttggctcactgcaacctccgcctcctgtattcaggcaattctcctgcctcagcctcccgagtagctgggattataggcaactgccaccatgcccggctaatttttgtatttttagaagagacggggtttcaccatgttggccaggctggtctcgaactcctgacctcagatgatccgccctcctcggcctcccaaagtgctgggattacaggcgtgagccaccgcgccyggtctgagccaccgcgcccggtctgagccaccacacccggtctaatttttgtatttttagtagaggtggggtttcaccattttggccaggctggttttgaactcctgacctcgtgatctgcccgcctcggcctcccaaagtgctgggattacaggcttgagccactgcgtccagcccaaactctttaagagaaaatctcttgggatcttgaagccagaagcttgcttttattactgagtttgccctgaatctgtcacttatgtactaaaaatacataaatttccttatccaggtgacttg

SEQ ID NO: 125813 - DNA, 601 bp, Human
tggtctcgaactcctgacctcagatgatccgccctcctcggcctcccaaagtgctgggattacaggcgtgagccaccgcgcccggtctgagccaccgcgcccggtctgagccaccacacccggtctaatttttgtatttttagtagaggtggggtttcaccattttggccaggctggttttgaactcctgacctcgtgatctgcccgcctcggcctcccaaagtgctgggattacaggcttgagccactgcgtccagcccaaactctttaagagaaaatctcttgggatcttgaagccagragcttgcttttattactgagtttgccctgaatctgtcacttatgtactaaaaatacataaatttccttatccaggtgacttgggctcaactgaaggaaacctgaagcatctaaatgttagcacctaagcctgagtctaggtgccagcatagcctgtcttccctctccagagtcagaggcatgttacaaacagaatatatggacacacgtcgaaccccacattgtatctctctaatttattcaatttaattcagtaaacactcattacctcttatatccaggcctagttgagggtgctggg

SEQ ID NO: 125814 - DNA, 601 bp, Human
ctgtcttccctctccagagtcagaggcatgttacaaacagaatatatggacacacgtcgaaccccacattgtatctctctaatttattcaatttaattcagtaaacactcattacctcttatatccaggcctagttgagggtgctggggatacaggtataaacatgacagttctcttgaggagcacagagtggttgtgggaaacagacatacagacacacagtttctttctttcttttttctttttttttttttttttgagacagagtctcactctgtccttcaggccggaatgcagtgargtgatctcagctcaccacaacctccacctcctgggttcaagcgattctcctgcctctgactccccagtagctgggattacagtaatgcgccaccacacccacctaatttttgtatttttagtagagacaggcttttgccatgttggccaggctggtctcaaactcctgaactcaggtgatccgcctgcctcggcctcccaaagtgctgggattacaggtgtgagccaccatgcccggcccagacacatagtttcaatacaagaagtatatgtcagccagagaagggctatcttgagagtc

SEQ ID NO: 125815 - DNA, 601 bp, Human
cagacatacagacacacagtttctttctttcttttttctttttttttttttttttgagacagagtctcactctgtccttcaggccggaatgcagtgaggtgatctcagctcaccacaacctccacctcctgggttcaagcgattctcctgcctctgactccccagtagctgggattacagtaatgcgccaccacacccacctaatttttgtatttttagtagagacaggcttttgccatgttggccaggctggtctcaaactcctgaactcaggtgatccgcctgcctcggcctcccaaartgctgggattacaggtgtgagccaccatgcccggcccagacacatagtttcaatacaagaagtatatgtcagccagagaagggctatcttgagagtcaaggaaggctccctggaggaggtatcacttatgccagttggtacatgaatgagtaaatgcaaacaagccatgatactgaaataaagctttgtttaattaaccttcacatgtaaattcagccacagaagacattctgatacatgggggcattgccagtgattccacgaaactggataatgtcattgatgcttgtggttgagaga

SEQ ID NO: 125816 - DNA, 601 bp, Human
atgtcactaactagttgtgtaatttttggaacattgttaacctttctgatttcagtttccttatccttaaattgaaaattctagtagttcctacctcataggattgttgtgaaggtcaaatgagatcaaatacttacaactggacctaaggggcactcattatgagttagctgttgttactagtaacccattgtcatccctgtagatgtttcaggggtttgccgtggggaaccctgccatgcaggcttgtctcaggttctgaccctgtgatggggtctggtgttccctgcctcgtttaccrctctttccccatactttggtctgactctccaatgagctcatgattcctatgagcgatttctgtctcttgatgaatctttagatttgtcctttgtcttaggccttgagactgcagtagaaccttgtggcctattctaaccccagcccggaaaccaatgccccaactccattctgggctgacttcctggcttcctcccacaacttccgggtctctgtttttatatattgttcctagactaggatatgggtgttcacaaatgtttgttgaaaggttttcagaggcaattaggcatatttaaga

SEQ ID NO: 125817 - DNA, 601 bp, Human
aagcttgactgggttctttgctcagagtcttacaaggtcaagattaaaatatccactagattaaggacttatcttgagactgtgaggagaatctgcttccaagctcatttaggctataggtagaatcaagttccttgcagttataggtctgaggtccctgtttccttgctgactatcagtcaggggccactcttagcttctcgaggctgctctcaagtcctttccatgtggacccctccatattcaataccagcaatggcccattgaaccatcccatgctttgagtctctgacttcttttrccagctaaaggaatctctctacttataaatggctcatgtgatgaccaggataatttccccatcttaagatcaactgtttagtgccttaattgcatctgcaaaatcccttcaaaatagtgcctagattagtgtttgattgaatagccaaggattgggaatcttgggcagtcatctcagaattctgcctacacagcatggttacaatttcctgaaaagctatcctgtgaggcctgacagttatagtacaagcattggataaacattcccatttcagaatggagaaatcagccaacaagaaag

SEQ ID NO: 125818 - DNA, 601 bp, Human
aatcccttcaaaatagtgcctagattagtgtttgattgaatagccaaggattgggaatcttgggcagtcatctcagaattctgcctacacagcatggttacaatttcctgaaaagctatcctgtgaggcctgacagttatagtacaagcattggataaacattcccatttcagaatggagaaatcagccaacaagaaaggtgctacaggccccatgcaagtttgaaagctggaagggcagtcattagatcttaaagctctaacataatctttgactccatgtcccatatgctgggcatacyggtgcagtgggtgggctcccaaggcatggagcagctctgtccctgtggctttgcaggattcatcacccatgactgctctcatgggctcgagttgagtgcctgtggctttgccaggcacagggtgcaagctgctgttggatctaccattcttggatctggaggatggtggccctcttctcacagctccactaggcagtgtgccccattgggaactctgtgtggggaatgtgtattaatctgttctcacactgctaataaagacatacccgagactgggtaatttataaaggaaaggggttt

SEQ ID NO: 125819 - DNA, 601 bp, Human
aaccatggcagaaggcaaatgaggggcaaagtcaaatcttatatggcagcagacaagagagcttgtgcagtgcaactcccatttataaaaccatcagatctcagggaacttattcactaccactagaatagtatgagggaaaccactgccacgatttaattatctccacctggccccacctttgacacgtggagattgttacaaatcaaggtgagatttgtgtggggacacagccaaaccatatcagtgtgccaaccttacaattccccttggcattgacctagtagaggttctctgtgarggctccacccctgcagcagtcttctgcctggacacccagacttgtccatacatcctctgaaatcaaggtggagggtggcaaacctcaagtcttgtgctctgtacaccgcaggcttaacactacatggaagccaccaaggcttttggcttccaccatctggaactgcagcccaagctgtacttgggcccctttgagctgtgggtagaggtggagcagcctggatgtgggaagaagtgtcccaaggctgtgcagggcagcagggccctgggcttggtccaggaaaccattcttccctcctag

SEQ ID NO: 125820 - DNA, 601 bp, Human
ttataaaaccatcagatctcagggaacttattcactaccactagaatagtatgagggaaaccactgccacgatttaattatctccacctggccccacctttgacacgtggagattgttacaaatcaaggtgagatttgtgtggggacacagccaaaccatatcagtgtgccaaccttacaattccccttggcattgacctagtagaggttctctgtgaaggctccacccctgcagcagtcttctgcctggacacccagacttgtccatacatcctctgaaatcaaggtggagggtggcaarcctcaagtcttgtgctctgtacaccgcaggcttaacactacatggaagccaccaaggcttttggcttccaccatctggaactgcagcccaagctgtacttgggcccctttgagctgtgggtagaggtggagcagcctggatgtgggaagaagtgtcccaaggctgtgcagggcagcagggccctgggcttggtccaggaaaccattcttccctcctaggccactgggcatataatgggagaggctgccatgaaggtctctaaaatgcctttgaggtctttttcccattgtctttggaatt

SEQ ID NO: 125821 - DNA, 601 bp, Human
gaagtttctcacttccatctgagaccttgtcagcctggccttcattgtccatatcactatcagcattttggttgaaactatttaaccagtctctaagaagttccaaactttccctcaccttcctatcttcttctgagccctccaaactcttccaacctatacttgttacccagttgcaaagtcggttccacattttcaggtatctttatggcagtgccctactccttggtaccaattttctgtgttggtccatttttgcattgctagaaagaaatacctgagactgggtaattccttttcytttttctgagacagagtcttgctctgttacccaggctggagtgcagtggtgcaatcttggctcactgcaacttccacttcctgggttcaagtgatcctcctgcctcagcctccggagtagctgggattataggcacacaccatcacaccttgctatttttttttctttttttagtagagatggggtttcattgtgttgatcaggctggtcttgaactcctgacctcaagtgatccacccacctctgcctcccaaagtgctgggattataggtgtgagccactgtgcctggctgagactgg

SEQ ID NO: 125822 - DNA, 601 bp, Human
tcaccttcctatcttcttctgagccctccaaactcttccaacctatacttgttacccagttgcaaagtcggttccacattttcaggtatctttatggcagtgccctactccttggtaccaattttctgtgttggtccatttttgcattgctagaaagaaatacctgagactgggtaattccttttcctttttctgagacagagtcttgctctgttacccaggctggagtgcagtggtgcaatcttggctcactgcaacttccacttcctgggttcaagtgatcctcctgcctcagcctccsgagtagctgggattataggcacacaccatcacaccttgctatttttttttctttttttagtagagatggggtttcattgtgttgatcaggctggtcttgaactcctgacctcaagtgatccacccacctctgcctcccaaagtgctgggattataggtgtgagccactgtgcctggctgagactgggtaatttataagaaaagaaatttaattggctcacggttctgaagactgtacaggaagcatagtggcatctgcttctggggaggcctcaggaagcttccaatcatggtggaaggt

SEQ ID NO: 125823 - DNA, 601 bp, Human
aagcatagtggcatctgcttctggggaggcctcaggaagcttccaatcatggtggaaggtgaatggggaggaggcgcatcacatggtgaaatcaagagtgagagacagagtgccacacactcttaaatgaccagatctcatgaaaactcactccctatcacaagaacagcagcaagggaatggtgctaaaccattcaagagaaaaccgcccccatgatccaatcacctcccaccaggccccatctccaacactggggattatagttcaacatgagatttggatggggaccaatatccaaaytatgtcaacaattgtgttacttctccatctacttttctcctggtagctggctagtttctcttaacactgattgtaagacctatcctgatttcagaggcatttaaatataaaaaaaattgggacttatttcttgaaaatgttgtacttactagacagtaagacttatttctgaagatacctggtttctaaaagtactactgggaaatataataaatgaggaagtgattaattttgcctggggagtaggtgacatttgaattgggtctgggaggttcagtaggagtttcccaggcagataat

SEQ ID NO: 125824 - DNA, 601 bp, Human
tgactcctcctggcttgtaaattctttgtggtcattaaccaattttgactcccaaaatgaccatttacctcattattttgccgtttattcatttcatatttactaattttattcatatttatatttgctgacaaaatagtatttccagcagctcattttaaatacagacaagcaagcaagcaaaccccacacaaatccagtgtaatagcactgcctggagaagccactgttaatatattggtgtatatacttcaaggctttatctattcatatgcacatatccatcaatgtatctatctakctagctacatttaaaacaaaatggtatcatatttattagtcataatttgatatattaacttaaccacaatattaaaatattgtactgccagcctgtacattttttgcctgcccagcctcccactgaaggaaattatgcccagctcatagttctctatgcttaattatctgtatctcctgatcatagttgattgaagtaaaggatcagcatccaatctaagggcagcctgcctgtgggtggtcagagatttacccacagggtggaaagctgagctgggtcaatcatatgccactctatggg

SEQ ID NO: 125825 - DNA, 601 bp, Human
aaatgaccatttacctcattattttgccgtttattcatttcatatttactaattttattcatatttatatttgctgacaaaatagtatttccagcagctcattttaaatacagacaagcaagcaagcaaaccccacacaaatccagtgtaatagcactgcctggagaagccactgttaatatattggtgtatatacttcaaggctttatctattcatatgcacatatccatcaatgtatctatctatctagctacatttaaaacaaaatggtatcatatttattagtcataatttgatatwttaacttaaccacaatattaaaatattgtactgccagcctgtacattttttgcctgcccagcctcccactgaaggaaattatgcccagctcatagttctctatgcttaattatctgtatctcctgatcatagttgattgaagtaaaggatcagcatccaatctaagggcagcctgcctgtgggtggtcagagatttacccacagggtggaaagctgagctgggtcaatcatatgccactctatgggttatggagttaggcaattgagatgatcctcaatggagctgatgatgtaaggata

SEQ ID NO: 125826 - DNA, 601 bp, Human
agcaagcaagcaaaccccacacaaatccagtgtaatagcactgcctggagaagccactgttaatatattggtgtatatacttcaaggctttatctattcatatgcacatatccatcaatgtatctatctatctagctacatttaaaacaaaatggtatcatatttattagtcataatttgatatattaacttaaccacaatattaaaatattgtactgccagcctgtacattttttgcctgcccagcctcccactgaaggaaattatgcccagctcatagttctctatgcttaattatctrtatctcctgatcatagttgattgaagtaaaggatcagcatccaatctaagggcagcctgcctgtgggtggtcagagatttacccacagggtggaaagctgagctgggtcaatcatatgccactctatgggttatggagttaggcaattgagatgatcctcaatggagctgatgatgtaaggataccatgaccttcagtcaaagccatggcaaggcaagcagaaacaagagttgtgagggaacagaaaaaattaaatggagtaagctggttagcaaagagtggagagtagagccagcctgt

SEQ ID NO: 125827 - DNA, 601 bp, Human
tctatctagctacatttaaaacaaaatggtatcatatttattagtcataatttgatatattaacttaaccacaatattaaaatattgtactgccagcctgtacattttttgcctgcccagcctcccactgaaggaaattatgcccagctcatagttctctatgcttaattatctgtatctcctgatcatagttgattgaagtaaaggatcagcatccaatctaagggcagcctgcctgtgggtggtcagagatttacccacagggtggaaagctgagctgggtcaatcatatgccactctrtgggttatggagttaggcaattgagatgatcctcaatggagctgatgatgtaaggataccatgaccttcagtcaaagccatggcaaggcaagcagaaacaagagttgtgagggaacagaaaaaattaaatggagtaagctggttagcaaagagtggagagtagagccagcctgtggaaaagcagagatgcccagagaatgaaaccatgacttcaagctttcattagtcctgttttttttttgtttagtgtagttttgtttttggtgcagttccagtccatataggtctgtataagaaagg

SEQ ID NO: 125828 - DNA, 601 bp, Human
ttcattagtcctgttttttttttgtttagtgtagttttgtttttggtgcagttccagtccatataggtctgtataagaaaggcctcccttccagccttttttcctctagaagtaaaactgtgcatgtctgtttcctgtagccagtcaagcctgaccagaccacagatcatcactgttcatggctatatggcattctattgtgtatagctgccatcactgatttaaacacctactgatggacatttgagtaatttccaaggagcatcttcatggataacttttgcacatttaataaaagcaygatatccttatgatacattccaagaagtgaagttttttggttgaagaatagatgcataatgataagctggtctttagaaagactatattaatttattgcctactaacattgcataagagtggttgctttttcacccccttgccaataatatcaattaaaaagacaaaccaaaatgttgctacatatgataggcaagaagtgatatgtggcatgttatcttttctattttttttttttttggtgatgggtctcactctgtctacctgggcaggagcacagtggcgggatcacagctcactg

SEQ ID NO: 125829 - DNA, 601 bp, Human
gttaagaagaaatatttcggctgggcatggtggctcatgcctataaccccagcacattgggaggccaaggtgggcagatcacttgaggtcaagagttcgagaccagcctggccaacatggcaaaacctcacctccagtaaaaatacaaaaattagccgggtgtggtcgtgtgcgcctgtaagcccagctactcaggaggctgaggcaggataatcacttgaacttgggaggctgaggttgcagtgagccgaaatcacgccactgcactccagcctgggtgacagagtgaaactctgtctcaaaaaaaaaaaaaaaaaaagaagaagaagaagaaatatttcacattttatgtattcgcaatgtttaagaaaatttggccgacttgaatgacagcttttttgtaaatcattttaaatgtgtaattgagttagttttagacttaggtttttgagttgaaagcttactaagtttacacatggaatcaggccatctaagagaatgttagctttgttatgcttgtatgtttatttataggaattactaagttttgaaaaagttttaaacaattgaatgaattaaaaagaaaatctaggccgggcac

SEQ ID NO: 125830 - DNA, 601 bp, Human
aagcatggagtggttgaagaaactgcaagcacttccattgacatggagaagaccatgtcccctgtggcccccaataaaaatgtgacccccccgcctccgaaataaataaatcattcagtttctgaaaagtgtttggtaaaatgtgctagacttataaatagaataatacaatttgtaaagtgaacttaaaagcttaagaatgaaataactttttactttgtaggcttaataaatgaaacccttgcccacttttctacaggggtgttttgttcttacaggttttcaagtatctttaatagtytgaaggaagagtgaatacattgaaaatagctggagcaaaacatctggagtcaggctatgatttggcatgctaaatcatgctgaacttggcccattatcttgaagggaggaatagaaaaaaaaatttaaaaagagaaacacaattgcatttgcactttagagagaacaccctgataactgtgaggatctagttggcagaagggcgactacagtgtaatcacaacagggatggagacaaaagtagacatctcagaaataaacacagattggatgtagggtgcgaggcaaggagcctggggtg

SEQ ID NO: 125831 - DNA, 601 bp, Human
tcgggaggctgaggcaggagaatggcgcgaacccgggaggcggagcttgcagtgagcccggatcgcgccactgcactccagcctgggcgacagagcgagactccgtctcaaaaaaaaaagaaaataaaaaaaaagaaagaaagaaaagaaaaaagaataaacagaagagggctgcggacagaataccgttgaataccaatatctgaagggcaagccacaaggtgcagggggcagaggcatccctgatacgggaaaagagttattttaaaaagaacttgcaaagaacaatgtcaagggatcyaaaggtagggaatttggacagagttcggctttagcatccgcatctcaaatacctgggtacctgggtaatctggtgactgctgccgaatctaagaggactgaggccaggttgccaaactgcggagagtggggttggagggctttcatggcagtttggggcctgcttgtgtccaacaagacaacctgggtcacctcaaagggtgtcttctccaaatattggtgcagaggttagctgggccggcaagagaagggagatgacccactattttgatttcaggcagcagacaccggcagcctttcg

SEQ ID NO: 125832 - DNA, 601 bp, Human
aactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatkcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaatt

SEQ ID NO: 125833 - DNA, 601 bp, Human
tagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcrgagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataa

SEQ ID NO: 125834 - DNA, 601 bp, Human
gaacagtacaacaaacatcattgtattccagaactaacaaatgttaacatttgagatatttccctttcctctaaaaacaaaacaaaacaaaaccaacatcgctacatttaaagtcttttttgtgcccctctggtcccattcttccttctcctggggcaaacactaacctgtattttgcatgccctcttgtgtctaggcttcttttctgagcttaaaacttccaggaaactggagcttgggtttcagtgatgacttaagtgaggaggataacacttgtctttctaaataatagaagatgacrtagcaaggcatgctatatcactagaaaagggggcattttctcatatgaagtttataagaaaacaaaaactgtaagatctctgccatttaaattgtggatttcaaggtttggaaggtcaaagaatttggaagctgcagctgttctgagagaccatcttgtgctctgtggagctttggtgattccactgaggtgacctgggggtgagagggaagagcttcaacacaccttccttcccccatccaaagtagctctgcttttgttttactgttgaatttcttgaataaaattcacttgttacag

SEQ ID NO: 125835 - DNA, 601 bp, Human
gggagatccagacacatagtagtcccttggtatctgtgggggtttggttccaggacacctgcagatatcagaatccacagttgctcaacttccttatataaaatggcatagtatttgcatataaccttagcacattgcataatatatacttgaaaacatctctagattacttatcatacctctagattactctagatatatctctagattacttatcatacctgatccaatgtaaatgctacataaatagttgttacactgtattgttttatttatatctttctttatttttttctgactrtttttgatccatagtttgttgaatccatggatgcagaacccatggataaggagggccgactgtattttaaatgtctctagtgattccgatgctccttccttggcccccactcctccccctgttgagaaacaagatttaaaactctgccttatgctgggatatcatgacctcagtagaatgttacacttcatcctatttcttcatcaggttctgcattagccaggcattttattttcagctactctagagcgtctttttttctgtcaggtgtttttttccagtataggaaagtagcccatt

SEQ ID NO: 125836 - DNA, 601 bp, Human
taaggagggccgactgtattttaaatgtctctagtgattccgatgctccttccttggcccccactcctccccctgttgagaaacaagatttaaaactctgccttatgctgggatatcatgacctcagtagaatgttacacttcatcctatttcttcatcaggttctgcattagccaggcattttattttcagctactctagagcgtctttttttctgtcaggtgtttttttccagtataggaaagtagcccatttcctttaaagaccacccagcaggcatgatcccctgaggtgttttttwgttgagtgcttttgcatacttaaggagtaactgacctggcccggtggctcacgcctgtaatcccagcactttggaaagctgaggtgggcggatcacctggcggtcgggagttcgagaccagcctgaccaacatggagaaacccccgtctctactaaaaatacaaaattagtcgggcgtggtggcgggtgcctgtaatcccagctactcgggaggctgaggcaggagaattgcttgaacccgggaggcagagcttgcggtaagctgagacagtgccattgcactccagcctgggcatcaag

SEQ ID NO: 125837 - DNA, 601 bp, Human
tttggaaagctgaggtgggcggatcacctggcggtcgggagttcgagaccagcctgaccaacatggagaaacccccgtctctactaaaaatacaaaattagtcgggcgtggtggcgggtgcctgtaatcccagctactcgggaggctgaggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctagcacaccctgcccattggcctggcatcatggaaaggtgcctggtctattttatggaggcaatcataaaactgggtgtggtgatttttgttgttgtttaaggctttgattttaaaaaatcaaggttggaagcacctatttagattgtaaactagagaggacaaaggaaagaagcctgggaatgttatggtgagaaaagaggactagaatccctgtcagccacctatgtggctgctgccacccctaaaaagtgt

SEQ ID NO: 125838 - DNA, 601 bp, Human
acaaatggcatgctcttcgttattagtgagctattaacctcttccagttctttctcctaccttggtgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtgggtttgtgtttccctgaaaggttaactgggaaaatttaggggtaattcctataaatgagcactgggagtggttgagaaatagaaaatgtagagatttctgcttttc

SEQ ID NO: 125839 - DNA, 601 bp, Human
cccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtrggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggc

SEQ ID NO: 125840 - DNA, 601 bp, Human
agcattctctgagtttcagacaattcctggtgtgcgctttcaagtctgtcatgggccacctttctgctgctgagtgcccgtaccctagctcaaggaatagggcacacccctcttgtagaagggaaggtaggaacgctggctggttggagactgtcagcaactccacggtgataagtcgagcttagcactaagtagaagtatgtcactttctgtaatttagaggaattgaaaaggtatcttggaaagaaattagttcttgggaacaaagtcttttttgtgcatatgtctttactgttggcayagagcattttctgggatgggctcttcagatctcctctccctgtaagtgatttcagaattccatgaatgttgggatatgtccaggctggcaccctgggatcatgaaaatagaagttaagacatttaagaagcaagaaaacaaaatgggtaggtgaggtgactaggaagaatatcatgcccagcacttctagaattctcaaaatgaggagcatcacttaaattttgagggggatcatttttaggatggtgacccaagctctctttgtacagatgagaagtctagttatctcatgagacccag

SEQ ID NO: 125841 - DNA, 601 bp, Human
aggtaggaacgctggctggttggagactgtcagcaactccacggtgataagtcgagcttagcactaagtagaagtatgtcactttctgtaatttagaggaattgaaaaggtatcttggaaagaaattagttcttgggaacaaagtcttttttgtgcatatgtctttactgttggcatagagcattttctgggatgggctcttcagatctcctctccctgtaagtgatttcagaattccatgaatgttgggatatgtccaggctggcaccctgggatcatgaaaatagaagttaagacattyaagaagcaagaaaacaaaatgggtaggtgaggtgactaggaagaatatcatgcccagcacttctagaattctcaaaatgaggagcatcacttaaattttgagggggatcatttttaggatggtgacccaagctctctttgtacagatgagaagtctagttatctcatgagacccagtgtgactaaaggaccatagcatgtagctgcgtaatggcacggtggcactaggagctgatccattcatttatttataattaccaaggggaagtatggggtgagatttattcttaactcttaaaat

SEQ ID NO: 125842 - DNA, 601 bp, Human
caaactaacataatttattctttgtgtaaaggagagtgcaaatttggagtttgaaaaactgtgtggctgactttctagatcagtattttttgaggtatattgtgctgtgacattaaagaaagggtttagtggtgaaataagcttcagaaatactgagttaaaccaagccaaatattattcaagtggcaaattatttggaatctttgtcatagacttgtaaattctgagtctccaaggcaaaggatagtgtatgcaatattcctcaaacctactttatcaatagtgttccaggttttttttttttttctggtttgcgaacacttttttttctatcagttacggatttgagggactattttttctttcttttactttattttttatttttggactctaagactttcttcagagactatttcaaataagaatttgggagatgttcatggtcacttctcagctattttgtgttttatgatagttagtttacattctccgttgagttatcctgttcttggcttatagagcttaaattaaagccataattgtactaattggataggtataattgctcagtgatctttaaggcattgcaaaggacggg

SEQ ID NO: 125843 - DNA, 601 bp, Human
ttggaatctttgtcatagacttgtaaattctgagtctccaaggcaaaggatagtgtatgcaatattcctcaaacctactttatcaatagtgttccaggttttttttttttttctggtttgcgaacacttttttttctatcagttacggatttgagggactattttttctttcttttactttattttttatttttggactctaagactttcttcagagactatttcaaataagaatttgggagatgttcatggtcacttctcagctattttgtgttttatgatagttagtttacattctccrttgagttatcctgttcttggcttatagagcttaaattaaagccataattgtactaattggataggtataattgctcagtgatctttaaggcattgcaaaggacgggagtgtggtttttaaaaatgaggggtgcaaatgtactaattattaaaaaggaaaagataaatatgacaaattctggtctagtaaactagtttctggccaaacattggaccagaaaaattccagagcacattgtcagatgcataacttatgaacacttagcgagaaaagtgatgcttgggagccaacatgggctcc

SEQ ID NO: 125844 - DNA, 601 bp, Human
tatgaagaataattgggaatactgaggctatataaaatggaaacaagatttagaagaaatataaaatcagaatctcagaagctcaacctttcatctagtttaggaattcagtcaactgttatattaacattttacctactttactaaaaaattcctgagagatgggaggggagttcattttgtcagatgtggtgccaggggaacagaactagacaatggaaatctgcttaataggaggatagtttcttatataacaataagaaatttccaaacggtgtctgagctgctttgggaaaacccrtgttgcagattttcaggtttagactgtgtaacagtttaatggaagattgttatgttctaacctaagtattttctcgttatttaaaaacaatttttatttcatttcctgtgttattaaaaactatttttattttgaatgacttgatactattccattgctcattttttctaacatggctaagaagttgggaaaattcctccaataaaataattactttaaagcaagtaaaacacgtttttagctcctccattgttcaggacactctgggagaactgaagaagatgcgaaagtataaaacag

SEQ ID NO: 125845 - DNA, 601 bp, Human
gcttgatgacatctattttctctcaaaacttcttcacattttggccctaacaaatttaccccatctcatttaacatgctatcacttaaaaaattaattaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacrtatttttctcctaacacttaaccttctatgtgtgatctagatcctatcccttcttgtcttctagggttcttattccaatattattttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcac

SEQ ID NO: 125846 - DNA, 601 bp, Human
cttaaaaaattaattaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacgtatttttctcctaacacttaaccttctatgtgtgatctagatcctatcccttcttgtcttctagggttcttattccaatattrttttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttcaagcgattctcctgcctcagcctcctgagtagctgagattatgggtg

SEQ ID NO: 125847 - DNA, 601 bp, Human
attaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacgtatttttctcctaacacttaaccttctatgtgtgatctagatcctatcccttcttgtcttctagggttcttattccaatattattttcccaactrtaacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttcaagcgattctcctgcctcagcctcctgagtagctgagattatgggtgcccgccacaaca

SEQ ID NO: 125848 - DNA, 601 bp, Human
tgcatgccaccatgctggcttaacatgccatcttgacctctttccctgtagcagtgggaaaaacgtatttttctcctaacacttaaccttctatgtgtgatctagatcctatcccttcttgtcttctagggttcttattccaatattattttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttcaagcgattctcctgcctcagcctcctgagtagctgagattatgggtgcccgccacaacagccagctaatttttgtatttttagtagagatggggtcttaccatgttggccaggctggtctcgaactcctgacctcaaatgatccacccgccttggcctcccaaagtgctgggattacagacgtgagccactgcgccaggc

SEQ ID NO: 125849 - DNA, 601 bp, Human
tgatctagatcctatcccttcttgtcttctagggttcttattccaatattattttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggsttcaagcgattctcctgcctcagcctcctgagtagctgagattatgggtgcccgccacaacagccagctaatttttgtatttttagtagagatggggtcttaccatgttggccaggctggtctcgaactcctgacctcaaatgatccacccgccttggcctcccaaagtgctgggattacagacgtgagccactgcgccaggccttaatttttacatttttttgtagaaacgggtttcactgggttgcccagcctggcctcgaacttacgaactcaagtgttctactcaccttggcttcc

SEQ ID NO: 125850 - DNA, 601 bp, Human
gcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttccttagggtatttatggaacttaaagcaggagcttaagggtagtttggaccatattagccaataggtcatgataaatgattacatttttagacgtaatgtcagcaagggttgcacagkgagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgt

SEQ ID NO: 125851 - DNA, 601 bp, Human
atcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaamaaaataaaaagacactttcccaggacatgtcaccatctcagactaactccttctccgttccccctagtttttcctcttcctttcttacacttctagaaaaagaagttggctgggtgcagtgactcatgcctgtaatcccagtactttgggagatggagaagggggcggggagggagttgggggttggaagtcaagaatctcttgagttcaggagttccataccagcctggacaacatagtgaaaccttgtctccattataaaaaaagtaataataataaaataaaaattagaaaaagaag

SEQ ID NO: 125852 - DNA, 601 bp, Human
cacctttttttttttgaggaattgacttaaaatacttaggaaaaaaactttaaaaaatagaataaatatgaaaaggtataagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatccyaggaggttgaggccacagtgagccgtgtgattgggccactgaactccagactgggtggcagagcgagacactgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaac

SEQ ID NO: 125853 - DNA, 601 bp, Human
aaaaggtataagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatcccaggaggttgaggccacagtgagccgtgtgattgggccactgaactccagactgggtggcagagcgagacrctgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaactgttgttattgttgaaggaggaagtatcctgtagcaattaagagtatcagcttcatactggttcgtggct

SEQ ID NO: 125854 - DNA, 601 bp, Human
taagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatcccaggaggttgaggccacagtgagccgtgtgattgggccactgaactccagactgggtggcagagcgagacactgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaactgttgttattgttgaaggaggaagtatcctgtagcaattaagagtatcagcttcatactggttcgtggctcacgcctg

SEQ ID NO: 125855 - DNA, 601 bp, Human
ctgctcactgcatcctcaaactctcagactcaggcaaccctcccacctcagccatagttttatttttaaatgtctttataggccgggcacagtggctcacgcctataatcccagcactttgggaggccaaggtgggcggatcacttgaggtcaggagttcaaggccagcccggccaacatggcgaaaccccgtctctactaagatgtacaaaaactagccgggtgtgctgatcccagctacccagaggagacgggagaattgcttgaacccggaagccagaggttgcaatgagctgagatygtgccattgcactctagcctgggcgacaaagcgagactccatctcaaagaaaaattttttttaataaagtcttcataaagctaaatttataaaaaagctagaggctgggcgtggtggctcatgcctataatcccagcactttgggaggccgaggctggtggatcacctgaggtcaggagttcaggaccaacctggccaacatggtgaaaccccatctctactaaaaatataaaaattagccggttgtggtggcacaagcctgtaatcccagccacttgggaggctgaggcaggagaattg

SEQ ID NO: 125856 - DNA, 601 bp, Human
agtgagctgacatcatgccactgcacttcagcctgggcaacagagcgagactccgtttcaaaaaaaaaaaaaaagctagagatatggtttagcagctctatatttggggaaaaaaggagtctctgttgattgaaaaagtgtaataaaataatttaagctgaggctttgtggttatggagtgtcataatgaagaaggtgatagtcctgttccatttcaggctggtcagaccatacttggaacacagtattcagtaggagaatgaattcagccaggtttgtttgtttgtcttttaagacagasacttgctctgctgttgcccaggctggagtgcagtgatgcaatctcagctcatgcctcagttttccaagtagtggctgggattgcaggcatactccaccacacttggctaatttttgtattttttgtagagacggggtctcaccctgttggccaggtttttctccaattcctgacctcaagtgatccacccgcgttggcctcccaaagtgctgggattacaggcgtgaaccactgcaccggttctaaatatttaagttttataagaaaggttttgtgtctaagttgagaatcactggtgga

SEQ ID NO: 125857 - DNA, 601 bp, Human; identical to SEQ ID NO: 28910

SEQ ID NO: 125858 - DNA, 601 bp, Human; identical to SEQ ID NO: 28911

SEQ ID NO: 125859 - DNA, 601 bp, Human; identical to SEQ ID NO: 28912

SEQ ID NO: 125860 - DNA, 601 bp, Human; identical to SEQ ID NO: 28913

SEQ ID NO: 125861 - DNA, 601 bp, Human; identical to SEQ ID NO: 28914

SEQ ID NO: 125862 - DNA, 601 bp, Human; identical to SEQ ID NO: 28915

SEQ ID NO: 125863 - DNA, 601 bp, Human; identical to SEQ ID NO: 28916

SEQ ID NO: 125864 - DNA, 601 bp, Human; identical to SEQ ID NO: 28917

SEQ ID NO: 125865 - DNA, 601 bp, Human; identical to SEQ ID NO: 28918

SEQ ID NO: 125866 - DNA, 601 bp, Human; identical to SEQ ID NO: 28919

SEQ ID NO: 125867 - DNA, 601 bp, Human; identical to SEQ ID NO: 28920

SEQ ID NO: 125868 - DNA, 601 bp, Human; identical to SEQ ID NO: 28921

SEQ ID NO: 125869 - DNA, 601 bp, Human; identical to SEQ ID NO: 28922

SEQ ID NO: 125870 - DNA, 601 bp, Human; identical to SEQ ID NO: 28923

SEQ ID NO: 125871 - DNA, 601 bp, Human; identical to SEQ ID NO: 28924

SEQ ID NO: 125872 - DNA, 601 bp, Human; identical to SEQ ID NO: 28925

SEQ ID NO: 125873 - DNA, 601 bp, Human; identical to SEQ ID NO: 28926

SEQ ID NO: 125874 - DNA, 601 bp, Human; identical to SEQ ID NO: 28927

SEQ ID NO: 125875 - DNA, 601 bp, Human; identical to SEQ ID NO: 28928

SEQ ID NO: 125876 - DNA, 601 bp, Human; identical to SEQ ID NO: 28929

SEQ ID NO: 125877 - DNA, 601 bp, Human; identical to SEQ ID NO: 28930

SEQ ID NO: 125878 - DNA, 601 bp, Human; identical to SEQ ID NO: 28931

SEQ ID NO: 125879 - DNA, 601 bp, Human; identical to SEQ ID NO: 28932

SEQ ID NO: 125880 - DNA, 601 bp, Human; identical to SEQ ID NO: 28933

SEQ ID NO: 125881 - DNA, 601 bp, Human; identical to SEQ ID NO: 28934

SEQ ID NO: 125882 - DNA, 601 bp, Human; identical to SEQ ID NO: 28935

SEQ ID NO: 125883 - DNA, 601 bp, Human; identical to SEQ ID NO: 28936

SEQ ID NO: 125884 - DNA, 601 bp, Human; identical to SEQ ID NO: 28937

SEQ ID NO: 125885 - DNA, 601 bp, Human; identical to SEQ ID NO: 28938

SEQ ID NO: 125886 - DNA, 601 bp, Human; identical to SEQ ID NO: 28939

SEQ ID NO: 125887 - DNA, 601 bp, Human; identical to SEQ ID NO: 28940

SEQ ID NO: 125888 - DNA, 601 bp, Human; identical to SEQ ID NO: 28941

SEQ ID NO: 125889 - DNA, 601 bp, Human; identical to SEQ ID NO: 28942

SEQ ID NO: 125890 - DNA, 601 bp, Human; identical to SEQ ID NO: 28943

SEQ ID NO: 125891 - DNA, 601 bp, Human; identical to SEQ ID NO: 28944

SEQ ID NO: 125892 - DNA, 601 bp, Human; identical to SEQ ID NO: 28945

SEQ ID NO: 125893 - DNA, 601 bp, Human; identical to SEQ ID NO: 28946

SEQ ID NO: 125894 - DNA, 601 bp, Human; identical to SEQ ID NO: 28947

SEQ ID NO: 125895 - DNA, 601 bp, Human; identical to SEQ ID NO: 28948

SEQ ID NO: 125896 - DNA, 601 bp, Human; identical to SEQ ID NO: 28949

SEQ ID NO: 125897 - DNA, 601 bp, Human; identical to SEQ ID NO: 28950

SEQ ID NO: 125898 - DNA, 601 bp, Human; identical to SEQ ID NO: 28951

SEQ ID NO: 125899 - DNA, 601 bp, Human; identical to SEQ ID NO: 28952

SEQ ID NO: 125900 - DNA, 601 bp, Human; identical to SEQ ID NO: 28953

SEQ ID NO: 125901 - DNA, 601 bp, Human; identical to SEQ ID NO: 28954

SEQ ID NO: 125902 - DNA, 601 bp, Human; identical to SEQ ID NO: 28955

SEQ ID NO: 125903 - DNA, 601 bp, Human; identical to SEQ ID NO: 28956

SEQ ID NO: 125904 - DNA, 601 bp, Human; identical to SEQ ID NO: 28957

SEQ ID NO: 125905 - DNA, 601 bp, Human; identical to SEQ ID NO: 28958

SEQ ID NO: 125906 - DNA, 601 bp, Human; identical to SEQ ID NO: 28959

SEQ ID NO: 125907 - DNA, 601 bp, Human; identical to SEQ ID NO: 28960

SEQ ID NO: 125908 - DNA, 601 bp, Human; identical to SEQ ID NO: 28961

SEQ ID NO: 125909 - DNA, 601 bp, Human; identical to SEQ ID NO: 28962

SEQ ID NO: 125910 - DNA, 601 bp, Human; identical to SEQ ID NO: 28963

SEQ ID NO: 125911 - DNA, 601 bp, Human; identical to SEQ ID NO: 28964

SEQ ID NO: 125912 - DNA, 601 bp, Human; identical to SEQ ID NO: 28965

SEQ ID NO: 125913 - DNA, 601 bp, Human; identical to SEQ ID NO: 28966

SEQ ID NO: 125914 - DNA, 601 bp, Human
cctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatkctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccat

SEQ ID NO: 125915 - DNA, 601 bp, Human
gggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgarcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcaga

SEQ ID NO: 125916 - DNA, 601 bp, Human
ggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacrtgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactg

SEQ ID NO: 125917 - DNA, 601 bp, Human
tatgacgtgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccrgcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaacc

SEQ ID NO: 125918 - DNA, 601 bp, Human
cccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctgsaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggct

SEQ ID NO: 125919 - DNA, 601 bp, Human
aaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcagggscgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggaacaagggagatc

SEQ ID NO: 125920 - DNA, 601 bp, Human
ggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggarcaagggagatcagtttcttgcacaactcccagactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaataga

SEQ ID NO: 125921 - DNA, 601 bp, Human
actttagggaacaagggagatcagtttcttgcacaactcccagactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacrtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtg

SEQ ID NO: 125922 - DNA, 601 bp, Human
ggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggyagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaa

SEQ ID NO: 125923 - DNA, 601 bp, Human
tgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcaggragacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgc

SEQ ID NO: 125924 - DNA, 601 bp, Human
atttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtaygccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaa

SEQ ID NO: 125925 - DNA, 601 bp, Human
aggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctstttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggc

SEQ ID NO: 125926 - DNA, 601 bp, Human
aaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaamcaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatt

SEQ ID NO: 125927 - DNA, 601 bp, Human
cctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttattttgagacagagtttttctcttgttgcctaggctggagtgcagtggtgcggtctcrctcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtattta

SEQ ID NO: 125928 - DNA, 601 bp, Human
cataaccatagcacaattaacaaagccaggaagtgaacattgacacaatactacttactaatctataggctttacctaaatttcctcagttttcccattaccgtttttttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaa

SEQ ID NO: 125929 - DNA, 601 bp, Human
tcaagcaattctcctgcctcagcctcctgagtatctgggactacaggtgtgcgccaacacacccaactaatttttgtatttttagtagagacggagttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgccyggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctct

SEQ ID NO: 125930 - DNA, 601 bp, Human
agggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccacggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctg

SEQ ID NO: 125931 - DNA, 601 bp, Human
tccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatrcctgtataatcccagctactcgggaggctgaggcaggagaatcacttcaacccgagaggtggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgcc

SEQ ID NO: 125932 - DNA, 601 bp, Human
acttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagyttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagacca

SEQ ID NO: 125933 - DNA, 601 bp, Human
ttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctccttygtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaa

SEQ ID NO: 125934 - DNA, 601 bp, Human; identical to SEQ ID NO: 37695

SEQ ID NO: 125935 - DNA, 601 bp, Human
agtcacattagtctcctcttagctttacctgccaatctcaacccaacttcctcccactgacattcagaatcacctttatcatatacctttctagaaggtcacatttttagtctgctcaaagttaaagcatgtcatttttttttctgactctaaagttaatacatgatcattgtagagaagttagaaaagaaattagatgcctaaaatacatcatcggtaacctagagatccagaagtaagctcttctaatacctgggcatattttcttgctacattattattattattattattattatttttttgaggtggagtcttgctctgttgcccaggctggagtgtagtggtgcatgatcttggctcactgtaaactctgcctcccgggttcatgcccttctcccacctcagcttcccgagtagctgggactacaggcgcctgccaccacgcttggctaactttttgtatttttagtagagacggggtttcaccgcgttagccaggatggtctcaatctcctgacctcgtgatccgcccgcctcggcctcccaaagtgctgggattataggcatgagccaccgcgcctggccattattattatta

SEQ ID NO: 125936 - DNA, 601 bp, Human
cccacagcctgtactcatttacgtctaacttgtttcactcaatgctgtgtttgtaagattcttccatattgttgtatgaaacagtggtttattctttcttatttctgtatagtaagctcattgtatgaatgtatgacaatttatttatccattttcttgttgatggacatttgggttgtttccagttggagttatttgaaatagagttgctgtgaacatttatgtcttctggtgagcatgttttcataggagtcaggattgatgggtcattgaccaaggacacgtgcagtcttttgtagayactgccaagaattttccgaagtgattgtaccaatttgtgttcctataagcaatgtgcctaagttcccattgcttcacattgtccctccttgatattgtcagtctttttgatttgagtcatgctcattgctgtgttatattaaattgtgactttaatttacactttttttcctgactaggagagttgagcacctaagtgtttatttggcattttgacactcttgtttgtgaagtgcttgttcatgtctttcattcattttcttttcttacaagactatttccctttttctttttgacttca

SEQ ID NO: 125937 - DNA, 601 bp, Human
attgtctgcttttgccatatccacacatcaattataagctcaaaatgattcatttatcttattcactgctgtatatctggctttaaaaacatacctgaccatacagttggtgctctgtaaatattgctaaataaataaattagtaaatgtatgaaagaataaatttctgtatcatccacagatttcagcaaaatattctctctgcatccctttccacatcagggagctactgaggcacagctttgctccctgtatacttcgccatatggatactagattaaattacatgacaatgttggtraaacattcaatgggcttcttggaaagagaagtatgaaaataagaagttatcattatgccattagtgttattaccactatttgagctgttactgctatgactactaatagcctctgatcattctcatgatgctttctttctcatttctaatctcctccaatcctgttctttctttttttttttctattttgctttacgtttgccttgttttaataaacatttcatgaaacatcacaaggtgaaagtcattagagtgccattgatattgttctcaatccaccaaagtagccttctgcagaat

SEQ ID NO: 125938 - DNA, 601 bp, Human
aaggtcagagaagcaaaagaagccaggaggcttctcagaagaggtggcatttggagaattcaatggtatgacccttcctggaagatgtaacatccaaagcaatagcaaaaacacatgcccttttgaagaatgctgtgcatgcaatgtagcacagagaatggcatacagtaggccctcaggaaatggtcattaggttgaactgaatccagtatcatgtgggataagaagtgtaagggttcaaagaagaaaacagagttcactatgggctgagtgattcattcatgtattcattcacacagtygtacagcaactatcttttgagcagtgtctatatatcagtctctgtgtattgtgccagagagagagatggttcttatcaaacaagaatctaggacaattggagagtcagattaataaaaggatgatgatactattgtgtggcaactcctagagaagaagttgtgcagaccatctaatggcctggggaggggagtttagagaagcttacctgagagagatgaaaagttcaggaattggagaaaggctgtgtaaaagtgcagggcaataaaaaaataaaaataatagttttcaaaagatgcct

SEQ ID NO: 125939 - DNA, 601 bp, Human
aatgagatcgacaaggaatctaatgggacatggttgttaaatagaccaaattgccacatcaaccatttatctctcacgatttccatgctgcgtacttggccacaagtttatttgaatggtatagccccacatggctacataccaagaagtaactccctgatactccttctctcagcatcagtttataccccatcagtttgtgcttgcttagaattctttactccttcctgcccaagtctgagtctttaagttccctccagattccaggtttctgtaggtcagaagcagctctttttacagkcatatactcctgggttgctgcaaagcctagtatcatctattctagggtttttttttgtcttctccggttatagatccatttcagaatatgagaataattatggaaatcggtcacacctacacaagttggcaagtaattttaggaaaatcacagactgtctaaagtaaatagcagaacctagaaaggttatggtgctggcacatggaaagggctatataaattcctgatctagtaaaaaccatgactattatatatatgccccaggttgggaagcaaaattatgtagagtttaagaatacc

SEQ ID NO: 125940 - DNA, 601 bp, Human
atgctttgttgacagtgcaaaaggagagcttaattctaaggtaagttgttaggaagaagataagaagtggcccaatcatcttaaaaaataaacaggcaccatatctccatggagtcaataaactaattatcatgggtaacttatttaggttttggccatcctgatgcctcatttctgcacaatcaatgagatcgacaaggaatctaatgggacatggttgttaaatagaccaaattgccacatcaaccatttatctctcacgatttccatgctgcgtacttggccacaagtttatttgaawggtatagccccacatggctacataccaagaagtaactccctgatactccttctctcagcatcagtttataccccatcagtttgtgcttgcttagaattctttactccttcctgcccaagtctgagtctttaagttccctccagattccaggtttctgtaggtcagaagcagctctttttacagtcatatactcctgggttgctgcaaagcctagtatcatctattctagggtttttttttgtcttctccggttatagatccatttcagaatatgagaataattatggaaatcggtcacac

SEQ ID NO: 125941 - DNA, 601 bp, Human
aggatatttgcacaacattgtgaatgtactgttgctaaatttaacacttaaaaatgattaaagtgttaaattttatgttgtgtatattttgcaacaataaacaaataagattcaaaacaaatcgattcgacagttcaaataactttaaaccgtaaacatttattgagcatctactataagctaaacactatgagaaagagaagcaaataatgaacaaatgaaaaagcatatggtttctcctctcagcgatctcagttacaatttagtggcagacgtgtacaattgtacacataagacaagwcagaatgtatctggaatataatagaggcacattaaaaatgctttgttgacagtgcaaaaggagagcttaattctaaggtaagttgttaggaagaagataagaagtggcccaatcatcttaaaaaataaacaggcaccatatctccatggagtcaataaactaattatcatgggtaacttatttaggttttggccatcctgatgcctcatttctgcacaatcaatgagatcgacaaggaatctaatgggacatggttgttaaatagaccaaattgccacatcaaccatttatctctcacga

SEQ ID NO: 125942 - DNA, 601 bp, Human
cacttatttttacaccaaatctttttttaatttaattaccatatgattcagcaattttactcttaagtatatattcaaaagaactgtagacaagcattcaaatgaaaacttgtaaatgaatgttcatagcagcactattcatagtagtcaaaggtggaaacaaccctaaatgtccattgaccaataaatgaaaaactaaaatgtagtatatgtatacaatgaagtattaattctgccataaaacggaatgaagtactgatacatgctacaacatagatgaaccttgaaaatgtaaaatggrggaagccagacacaaaataccacatattgtatgattccattgatttgaaatacagttatcccttggtatctgcaggggattggtcctagaatcccaccctcccaccaccctctgataccaaaatccatgaatgctcaagtcccttatataaaatagcatagtatttgcatatacgctccacatatccttttttatactttaaataatccctagattacttatgatacttaatacaatgtaaatgctatgtaactgctgttacactgtactaactttttgtactttttattgttgtattat

SEQ ID NO: 125943 - DNA, 601 bp, Human
aaaatggaaagtcacagagcctcccacagtgcagtgctgccagtcacatggaaatgcactgtatgtatataatcctcttagaggaaacgaacaataatgtaataatgaaatctgccacaaaatacacttatttttacaccaaatctttttttaatttaattaccatatgattcagcaattttactcttaagtatatattcaaaagaactgtagacaagcattcaaatgaaaacttgtaaatgaatgttcatagcagcactattcatagtagtcaaaggtggaaacaaccctaaatgtccaytgaccaataaatgaaaaactaaaatgtagtatatgtatacaatgaagtattaattctgccataaaacggaatgaagtactgatacatgctacaacatagatgaaccttgaaaatgtaaaatggaggaagccagacacaaaataccacatattgtatgattccattgatttgaaatacagttatcccttggtatctgcaggggattggtcctagaatcccaccctcccaccaccctctgataccaaaatccatgaatgctcaagtcccttatataaaatagcatagtatttgcatatacgc

SEQ ID NO: 125944 - DNA, 601 bp, Human
tgtccaaagcaaatcacatggacaaggccaatgtcactaaaatggaaagtcacagagcctcccacagtgcagtgctgccagtcacatggaaatgcactgtatgtatataatcctcttagaggaaacgaacaataatgtaataatgaaatctgccacaaaatacacttatttttacaccaaatctttttttaatttaattaccatatgattcagcaattttactcttaagtatatattcaaaagaactgtagacaagcattcaaatgaaaacttgtaaatgaatgttcatagcagcactatwcatagtagtcaaaggtggaaacaaccctaaatgtccattgaccaataaatgaaaaactaaaatgtagtatatgtatacaatgaagtattaattctgccataaaacggaatgaagtactgatacatgctacaacatagatgaaccttgaaaatgtaaaatggaggaagccagacacaaaataccacatattgtatgattccattgatttgaaatacagttatcccttggtatctgcaggggattggtcctagaatcccaccctcccaccaccctctgataccaaaatccatgaatgctcaa

SEQ ID NO: 125945 - DNA, 601 bp, Human
tgcagtaaataaatgtggtttatgttatttaatccagtgttttaatattagggcacttttgctaaattactgtgtggtaacgaataacctcaaaatcccagtggcttataaccacaaaggttgatttgttgctcatatttcgtgtcagctgtgctttggctctgctccagatgtcttcttcatttcagatgtaggctaaaggtgcagccttttttcaggaatatgccattcttatgataaagggaaaagagcaaaagccatgccagacaatgtctcctaaagtgtcttgcccaaatgtgtsatgtaccatgtctctcacattccattgtccaaagcaaatcacatggacaaggccaatgtcactaaaatggaaagtcacagagcctcccacagtgcagtgctgccagtcacatggaaatgcactgtatgtatataatcctcttagaggaaacgaacaataatgtaataatgaaatctgccacaaaatacacttatttttacaccaaatctttttttaatttaattaccatatgattcagcaattttactcttaagtatatattcaaaagaactgtagacaagcattcaaatgaaaacttgt

SEQ ID NO: 125946 - DNA, 601 bp, Human
atatgtgtgctcatgttcatgtctctcctactctataagcttcctgaatgcaaaacacagctcattcatctaccatttccctgtcatctagcacagtattgagtacccagagtacgtgtttgaatgaaggcaattttagacagaatgtgtttcagagaggactgtggttctgtcttctatgtttagcatgccccatctctacagccatccctcattagcaaaacctgtatcttctttcacaatattacagcttgagacacgaggctttttaaatttcatctcagtagttacagacatgtgytcagaaagatctgagtaaaaaaatacataggcacaaagatattcttaagagaacaatggtgctaaaagacttggccactaacttcagcaaataatttgttatggatccattgctatagattatgattcttgaggacaataactttatctcttttttttgcattctttccaaggtaacaagcccagtgctagatcatagtaggtatgcaaaaattaaagtactcaattgaacatctattaagaaagtcctttcatttaccactttattaagccagttctatactggatgctagagatacaa

SEQ ID NO: 125947 - DNA, 601 bp, Human
gacctgaagattatagcccaatcttcatcgctgactttgattctgctcttttgctgacaggaactcagcttgtttctccttttaacaagtagtacattaggaattgttggaggaaataagaggtttaatgcatgcttcccacctcctaaagaaacagagaggttactcagatattgaaaactaaagcaaaaaaaaaattcaagaacgggaaagaaagtccttgattgatgattaaaacattaaaagtagtattgtgtctggcacatagtaggtttttataaatgtatttcaagtattgaayaagtcagtgatctattatgaagacgaaagaaaataggcctggaaataatgaatatggaagactttgtaatggctgtgggatgtgggctgaatcttgaaacatgagcatggtctgaataggtagataaagaaagtgaactcagtatgccatagcagagggcataatttgggtcaatctaagcctttcttatgcaaggcaaagaccatgcattgtcataggttgtttttggtaagctttattttgttttattctatatcctaattacctaatacagtggtatttttgatggatttgctcttt

SEQ ID NO: 125948 - DNA, 601 bp, Human
gcatggactggattaggggtgttaaaagcactctccactctcctagggggtagcatttaagctgagacctaatggatacaagggcactaggggatgagggatccacagaaagagtagtctagacagcgggaagagcatggaaaaggccacgggcatagaactccttccagctgagaatcaacttggccctcacatttctttctgactaaggttcgtcttcttttgtttgtttgcttacaagttccctagaaaagaaaagaaagagtacttgcacacaagagatcaaaattttgaagggaarggtgacacaaagcagaaatctgtgagctccttagaggaaatagcatttcttatagtacaagaaagatctttattcattataagatgggattctgagactcaggaaaaaaatggggctcactgtgttattgagtttcaaccactgggagtactcaagtaacagaagaactttaggggaccctcaagttggatctctggagaccttcaacaacattgatgatattgctagcaggcacttggatcaactgaccatgctctgtgaggctggggaaagaagaatatctggaaaagataactggga

SEQ ID NO: 125949 - DNA, 601 bp, Human
aattttccttccttccttcctgttttccttctttcctcattttcttccctccttccttcttcccatttatctttcctttctttcttcccatctttctgcttcccttctttcacacatattcctgaagccctactatgtgccaggcagctgtgctgtggatactagggtgaatgaggcagacaactccctcttgttgtaggtcttactgtttactgagagagagagagagagagagagagagagagagagagagagagagaaagagatgtaaactagttgcttggatgcaatgaaaccagtrttctatgagaagtacaagtttttcagggaacacagggaaagaacaatgaactcagcatggactggattaggggtgttaaaagcactctccactctcctagggggtagcatttaagctgagacctaatggatacaagggcactaggggatgagggatccacagaaagagtagtctagacagcgggaagagcatggaaaaggccacgggcatagaactccttccagctgagaatcaacttggccctcacatttctttctgactaaggttcgtcttcttttgtttgtttgcttacaagttccc

SEQ ID NO: 125950 - DNA, 601 bp, Human
ttattggtcttcgtttttaatcactccatcatttttcttctattaattttccttccttccttcctgttttccttctttcctcattttcttccctccttccttcttcccatttatctttcctttctttcttcccatctttctgcttcccttctttcacacatattcctgaagccctactatgtgccaggcagctgtgctgtggatactagggtgaatgaggcagacaactccctcttgttgtaggtcttactgtttactgagagagagagagagagagagagagagagagagagagagagagagaaagagatgtaaactagttgcttggatgcaatgaaaccagtattctatgagaagtacaagtttttcagggaacacagggaaagaacaatgaactcagcatggactggattaggggtgttaaaagcactctccactctcctagggggtagcatttaagctgagacctaatggatacaagggcactaggggatgagggatccacagaaagagtagtctagacagcgggaagagcatggaaaaggccacgggcatagaactccttccagctgagaatcaacttggccctcacatttctttc

SEQ ID NO: 125951 - DNA, 601 bp, Human
tattattggtcttcgtttttaatcactccatcatttttcttctattaattttccttccttccttcctgttttccttctttcctcattttcttccctccttccttcttcccatttatctttcctttctttcttcccatctttctgcttcccttctttcacacatattcctgaagccctactatgtgccaggcagctgtgctgtggatactagggtgaatgaggcagacaactccctcttgttgtaggtcttactgtttactgagagagagagagagagagagagagagagagagagagagagagagaaagagatgtaaactagttgcttggatgcaatgaaaccagtattctatgagaagtacaagtttttcagggaacacagggaaagaacaatgaactcagcatggactggattaggggtgttaaaagcactctccactctcctagggggtagcatttaagctgagacctaatggatacaagggcactaggggatgagggatccacagaaagagtagtctagacagcgggaagagcatggaaaaggccacgggcatagaactccttccagctgagaatcaacttggccctcacatttctt

SEQ ID NO: 125952 - DNA, 601 bp, Human
tggagggggatttggcttgtgaaaccactgtttgaaagatatacagctgccggctggggtgaaatattctgtccccacagttcccaaagacacaacacacagacacacagacacacacacacacacacggagagaaagagagagagagaaaagaaaactgagaaaatgagagagaaaagggctactgttattgccaagcatataaattttgccttagaaaacccaggcaggcaatagttgagagttttatttgaacatcaactcacccacactgaacatatggaatatttttctcccaatytttttatatattaaaataatcttgttataatttaaaatggaatgtttcactgttctgcagagcatgtgggcaatgtatatgtgggaacacccaagatgtcttccttctcttttcctgatttgtgcctcattctttttcctttcaattcaccttcgacaggtgcatctcacaatattttttgtagcttgtatacagtctttgtgtgctgagatattatttctctttctctgtgtcacatgatgggatatctctatttccttgcctccctccttcctcttatctcctaatattctcttctgt

SEQ ID NO: 125953 - DNA, 601 bp, Human
ttcacatatttgcagagctttgataagcaggagggtttagaattctgtgcctgttgaaccagcattggtgacagggctgttgagaaaggtgtatatgtcaatatgcatggaagggattctagcagattaagctatacagttgaacaacgggctgctgtgagactgagtgagctccacattgatgagcaatgagtccgtatgggtttgagtgactgtttgggagggctactgtacaagggcataacacacataccaaaacgtgaggtaaaacaaatcaagaataaagtcccttctgaactgmgtctacaattctttcagagtgtgcaattctttctgagtctacaattcttttagtcattttatctatatcaccattttctcttctagagccaaatttatttttagctgatcccaatcccccataggcaactgggtgtatggatcggggttaagtttctgttgcttaaaggaactctacagactatattctcagttctatttttctagcttgctcatcattttctttctcccttctgtaggggataaaatattctattcttggtcccagcccaaaaggaatttggggagagcatttatagaa

SEQ ID NO: 125954 - DNA, 601 bp, Human
tgaccagcccatggttacaggattagcactctggattacatctcatgatcctctctttatacttgaatattcaaagtcttaatacagagagccaatgatagagaaggatttatttggacatgagcactactctggtacctatgaaaagtcagcagagtggtctattgtctgtggtgcccagagagaaggacagatctgggctaacttaattcattagggcactttcgcttaggacatttctctccacctcatttggagctgcaaacagttttagcttccaatatgaggtaatggttctacyactcactgtgtaaaagagaactgtattcttatttggattattttttttctcatttatgcttcagggacactccttaatccaactcatcagggatttgctcaacaaggtcagcatttcttccattttctattcacagttgtttctagatttttatcttttttccattttcttcaggttttatatatacttaaataagccccatcctttcaacctgtcttcacatggcagctaaaagagaatattttcagagggacattgtgggaaagaagatgattcctccagcatgccttatggcaggac

SEQ ID NO: 125955 - DNA, 601 bp, Human
acttaaacttctcaggtcatgactttggccatctctgaaaggcatactctattctgttatagtaggactgaggctagagccacatatggtatataccttttccatttgtggagaaaactcttattgaaaatataacattattgtttattattctttatttcctcaagtgctttccttaagtatttatataaaccctatttatgaaacacaagttctgagctaggcactaggcctgtagagataaaaaaaaaaaaaagacacaatccttgcccttggggagtttacaatataatcagcaggygtagacatggacgcacatcatcataacatggctttatagacctatagcagagagagccatatgaggcaaatgaacagcagaagactgcaaataacattgtttagatagcagggaaaccttcatagaggagacagaatttgggctggttgaaaagcaagtaagagaacactaggttaaaagaagaacaggaaggacattcttaaaagaggaaaggcatcatgtgtctggaaattcctagtgaagaaatgaacttggatgaatggaggtgctcgtgctgtagaaaatagctgtagagaggga

SEQ ID NO: 125956 - DNA, 601 bp, Human; identical to SEQ ID NO: 37696

SEQ ID NO: 125957 - DNA, 601 bp, Human; identical to SEQ ID NO: 37697

SEQ ID NO: 125958 - DNA, 601 bp, Human; identical to SEQ ID NO: 37698

SEQ ID NO: 125959 - DNA, 601 bp, Human; identical to SEQ ID NO: 37699

SEQ ID NO: 125960 - DNA, 601 bp, Human; identical to SEQ ID NO: 37700

SEQ ID NO: 125961 - DNA, 601 bp, Human; identical to SEQ ID NO: 37701

SEQ ID NO: 125962 - DNA, 601 bp, Human; identical to SEQ ID NO: 37702

SEQ ID NO: 125963 - DNA, 601 bp, Human; identical to SEQ ID NO: 37703

SEQ ID NO: 125964 - DNA, 601 bp, Human; identical to SEQ ID NO: 37704

SEQ ID NO: 125965 - DNA, 601 bp, Human
agcagaatacccggtatatccaggacatggctggaactaggggaggcaagcaaggtagccaggcactgaaggtgacactctctcaggtgaggaccctgcactcaatgaccccgcaagtgtctcctgacattttgtattacattttgttatttgtgtcactcactcctggctctgctcaaaggacctcataaataaggtggcgaatgattaattagttaatccagttttttcaccattaagatggggatgctaaaattggctttgctcagtaattttaaaattaaatatgaaatatattttwaacagccaggataatgccacataactatcagggctagtgttcccctcctcaatcaggtgaatcagacagaacacagaggctgaaaattcatggtacattcaggaaacaatgtggaatctgaaacaatgtggagccagtaggtgaggacccagaggcaatccagaaaattgttggtctggaccatgcgaggtcctgtttgccaccccacaaatgcaccatctgcattgcatttcactctgcagcaagataatgtagctaacgccaggtaggtgcctgcagaggtggaggtggtggcaacac

SEQ ID NO: 125966 - DNA, 601 bp, Human
tccacagcactgttcgctgtgtgcatttctgaatttcccacagtgctcgatgcaggtctcatggcagatgtgtgatggatctaaaaggaagcttcttcagagacttgctcgtggtagcagtctgagcatctgttgtgctcgacaagaaagtaagtttgtgaccttttctagtccctgcttcagcagcattgcaacaagaaactggcaaaagaaattctatttgatccacaaaacaatataattatcacaagctagatgcaaagcagtgggctcaaatttggagggaatagggaaaacagaratgagtttgaatgtctgtacaaggaggaggtttcataaggggggaaagagagagaaatatgctaaggaaaggattttagattagtgggaatctagaataagaagctttctgtattggctagtacaatcaggaaagacttcatggagggaatagcagcattagctctgacgcaagaaaaacgagagaaaaaagggtgcacctcatcggggtaattaggtggatggactgtggtagaagactgccgttgttaaatgttgagtgccagtagaacagactagttaggaagataagattttgatt

SEQ ID NO: 125967 - DNA, 601 bp, Human
agactacgtggaaacacaggtagaaaaaaacaaccatccacaagccagaaaaaggggcctcagaagaaaccaagcctgctgacaccttgatcttggacttctggcctccagaactatgagaaaataaatttctattgtttaagcaactgagtccatggtacttagttatggcaaccatcataaactaatacatatggggtctgattgataaaagaacccctccccactcctgctctacaagacatcttccacagcactgttcgctgtgtgcatttctgaatttcccacagtgctcgatgcrggtctcatggcagatgtgtgatggatctaaaaggaagcttcttcagagacttgctcgtggtagcagtctgagcatctgttgtgctcgacaagaaagtaagtttgtgaccttttctagtccctgcttcagcagcattgcaacaagaaactggcaaaagaaattctatttgatccacaaaacaatataattatcacaagctagatgcaaagcagtgggctcaaatttggagggaatagggaaaacagagatgagtttgaatgtctgtacaaggaggaggtttcataaggggggaaagagaga

SEQ ID NO: 125968 - DNA, 601 bp, Human
ctagtggtaggacaaatccagactccttgacttttcccagtgttactcctattacccagctttgtccctccttcttcccttgtaatacctatccagctaccctccttctaaaatcctctcgagtcttcccttgaacttagcatatctgatgatgcttggtgttctggagatttcactcaactttaataaatatgcctgcctaatgtctttgggacctttggatcttactctccattttctgagatgacaatcaccgtaactgaaagaggttatttgtttgaattcttatcatggtcaaacrtggccctcctcaatcagatttgcatcgagcttcgttgctccttgggatgcacagctttttcacctaaagatctgatcaaaagctacctcctataatattctgggctgaattacatacccctccaaacttatatgttaaagtcctagcccccaggatctcaaactgtgactgtgtttggagacagggtctttaaagtggtaattaagttaacatgaggccatttaggtcagctctaatccaatataactggtatcctcttaagagaggatattagcacagggcatggtggctcatatctat

SEQ ID NO: 125969 - DNA, 601 bp, Human
gtgaagtgacttgcccaaggacacacagcttactagtggtaggacaaatccagactccttgacttttcccagtgttactcctattacccagctttgtccctccttcttcccttgtaatacctatccagctaccctccttctaaaatcctctcgagtcttcccttgaacttagcatatctgatgatgcttggtgttctggagatttcactcaactttaataaatatgcctgcctaatgtctttgggacctttggatcttactctccattttctgagatgacaatcaccgtaactgaaagagkttatttgtttgaattcttatcatggtcaaacatggccctcctcaatcagatttgcatcgagcttcgttgctccttgggatgcacagctttttcacctaaagatctgatcaaaagctacctcctataatattctgggctgaattacatacccctccaaacttatatgttaaagtcctagcccccaggatctcaaactgtgactgtgtttggagacagggtctttaaagtggtaattaagttaacatgaggccatttaggtcagctctaatccaatataactggtatcctcttaagagagga

SEQ ID NO: 125970 - DNA, 601 bp, Human
ctcctccttagtaggagagacggcaacactgtgagctctttctttgaaggtcccatgatggtagagcatttttagctatttacacctgacgacttgcagaaggagagcagagacttattcaaagatgcagacacctgcactgagcatggtgaagtgacttgcccaaggacacacagcttactagtggtaggacaaatccagactccttgacttttcccagtgttactcctattacccagctttgtccctccttcttcccttgtaatacctatccagctaccctccttctaaaatcctctcragtcttcccttgaacttagcatatctgatgatgcttggtgttctggagatttcactcaactttaataaatatgcctgcctaatgtctttgggacctttggatcttactctccattttctgagatgacaatcaccgtaactgaaagaggttatttgtttgaattcttatcatggtcaaacatggccctcctcaatcagatttgcatcgagcttcgttgctccttgggatgcacagctttttcacctaaagatctgatcaaaagctacctcctataatattctgggctgaattacatacccc

SEQ ID NO: 125971 - DNA, 601 bp, Human
aggtgagaagaatatgatgattagggcaggttttctcctccttagtaggagagacggcaacactgtgagctctttctttgaaggtcccatgatggtagagcatttttagctatttacacctgacgacttgcagaaggagagcagagacttattcaaagatgcagacacctgcactgagcatggtgaagtgacttgcccaaggacacacagcttactagtggtaggacaaatccagactccttgacttttcccagtgttactcctattacccagctttgtccctccttcttcccttgtaatrcctatccagctaccctccttctaaaatcctctcgagtcttcccttgaacttagcatatctgatgatgcttggtgttctggagatttcactcaactttaataaatatgcctgcctaatgtctttgggacctttggatcttactctccattttctgagatgacaatcaccgtaactgaaagaggttatttgtttgaattcttatcatggtcaaacatggccctcctcaatcagatttgcatcgagcttcgttgctccttgggatgcacagctttttcacctaaagatctgatcaaaagctac

SEQ ID NO: 125972 - DNA, 601 bp, Human
aacgccagacatcctctccaggtgagaagaatatgatgattagggcaggttttctcctccttagtaggagagacggcaacactgtgagctctttctttgaaggtcccatgatggtagagcatttttagctatttacacctgacgacttgcagaaggagagcagagacttattcaaagatgcagacacctgcactgagcatggtgaagtgacttgcccaaggacacacagcttactagtggtaggacaaatccagactccttgacttttcccagtgttactcctattacccagctttgtccmtccttcttcccttgtaatacctatccagctaccctccttctaaaatcctctcgagtcttcccttgaacttagcatatctgatgatgcttggtgttctggagatttcactcaactttaataaatatgcctgcctaatgtctttgggacctttggatcttactctccattttctgagatgacaatcaccgtaactgaaagaggttatttgtttgaattcttatcatggtcaaacatggccctcctcaatcagatttgcatcgagcttcgttgctccttgggatgcacagctttttcacctaa

SEQ ID NO: 125973 - DNA, 601 bp, Human
catgcaatcagttcatttgcaaataccagcttgctcagctagaggtggcccaaggttcccagtgttagcacctctgtccgacactgctccatgccagagaggtgccctgcggtgtgagaaatactcattaaagcctcagattcagatgtcaggaagcagcccacagcccgtccaaggaagttcatctctcctgggaaggcttcagaggaattagccacagagcctagtgtctgtgtgctcctacccctcggtacctagcactcaaaattcctcaaattaatataattgagtgacctgctamtggtggaacgccagacatcctctccaggtgagaagaatatgatgattagggcaggttttctcctccttagtaggagagacggcaacactgtgagctctttctttgaaggtcccatgatggtagagcatttttagctatttacacctgacgacttgcagaaggagagcagagacttattcaaagatgcagacacctgcactgagcatggtgaagtgacttgcccaaggacacacagcttactagtggtaggacaaatccagactccttgacttttcccagtgttactcctattacccagct

SEQ ID NO: 125974 - DNA, 601 bp, Human
tccctctttccctctcccaccttaccttaacaaagccacctgtttgtgagacaagtaaacatctctgtggcacctgctgcagtaatggcacctgctcagcacactcatcttccacagacttcagcaagcagacacattgaaaccatgcaatcagttcatttgcaaataccagcttgctcagctagaggtggcccaaggttcccagtgttagcacctctgtccgacactgctccatgccagagaggtgccctgcggtgtgagaaatactcattaaagcctcagattcagatgtcaggaagcrgcccacagcccgtccaaggaagttcatctctcctgggaaggcttcagaggaattagccacagagcctagtgtctgtgtgctcctacccctcggtacctagcactcaaaattcctcaaattaatataattgagtgacctgctaatggtggaacgccagacatcctctccaggtgagaagaatatgatgattagggcaggttttctcctccttagtaggagagacggcaacactgtgagctctttctttgaaggtcccatgatggtagagcatttttagctatttacacctgacgacttgca

SEQ ID NO: 125975 - DNA, 601 bp, Human
ggtgtggtccggaattatcttgttgctgtcctctcaacaagcactgggcgctggagtggaatgaatcttacttatgttcatgcttccaaagcctggcacatagtaagctttcaggaaatgtatgctgagttggactgcactgaaccaggcctcttctggttacctacagggaacatgtctttctgggtttctgcttgggcttgagagttaattcagggctccatgttcagggccatttcctgcatctcagcacactacagtatatatatttcaatgttggtctactaccctcaaccttgaygagcaaaccctgcctttggctttaccatacactaaaccagggcgtcccaaacccagtgcagtctcctatctgccactgcccactgcttagacagcatgcattcttgctgctctgcacagtgatcttgaccatcaagtccaacagtaaagtcagcaaaataaatctaatctgctccttacctgcccatgtgaccttggataaattaattacatctgccttatcagttccctaacccataaatgatccaagagcatctacttcacagagatggcatgagtattagataaaaaatatatgtca

SEQ ID NO: 125976 - DNA, 601 bp, Human
tgacactagggtcagctctcctgcgggctaacagaaatccatcacagtatccccagatcctcaaacagaacctaatatataatgactacccaataaatatctggtcgacccattactggtccccatcaacaggtgtggtccggaattatcttgttgctgtcctctcaacaagcactgggcgctggagtggaatgaatcttacttatgttcatgcttccaaagcctggcacatagtaagctttcaggaaatgtatgctgagttggactgcactgaaccaggcctcttctggttacctacagrgaacatgtctttctgggtttctgcttgggcttgagagttaattcagggctccatgttcagggccatttcctgcatctcagcacactacagtatatatatttcaatgttggtctactaccctcaaccttgacgagcaaaccctgcctttggctttaccatacactaaaccagggcgtcccaaacccagtgcagtctcctatctgccactgcccactgcttagacagcatgcattcttgctgctctgcacagtgatcttgaccatcaagtccaacagtaaagtcagcaaaataaatctaatc

SEQ ID NO: 125977 - DNA, 601 bp, Human
ctgagataggcaatcagaaattattatacccattttataagtgataaagccaaggcttaaaaagtctcagtgtccagtaatagctgagaccaaacttaaagtccatctttccctttttaactgcacagtgtaaggatctcctggtggcaagacaagccacaggaatcttactgtgggtccctgccttcccttgatatgtccagctgcagtctgacactagggtcagctctcctgcgggctaacagaaatccatcacagtatccccagatcctcaaacagaacctaatatataatgactacycaataaatatctggtcgacccattactggtccccatcaacaggtgtggtccggaattatcttgttgctgtcctctcaacaagcactgggcgctggagtggaatgaatcttacttatgttcatgcttccaaagcctggcacatagtaagctttcaggaaatgtatgctgagttggactgcactgaaccaggcctcttctggttacctacagggaacatgtctttctgggtttctgcttgggcttgagagttaattcagggctccatgttcagggccatttcctgcatctcagcacactaca

SEQ ID NO: 125978 - DNA, 601 bp, Human
gaaaaaaaaaaaaaagaaagaaaagaaaaaagatatactggtaaactggatggtaaactggaacttgggttcaattggaaaattagaatgagaaggaagcatataaaataagtcctgaaacagcctttcaatgcagggaccatgttcttgaggaaggaatctttgagcctgagatctgaagggcaggtagaagctaccatagtgaagaacaaaagaaaaaaaaggaagcacattcaagcagaaggagcagcccatgtgaatcctttgaaatgaagggctactgggagtgggtggaattagrcatttagttaactcaaagaaaattagcagaactgtcctgtcactgagagagacaagaaatggtgtggaacccagccaaggggtaggtgggaaccagatcatggcagatctgtcagccacctgaggattttgttctttctcctaaaagcagtaagtagtaaccaaaaagttttaaacagggatgtgacaagattgaatttgaattctgactgccatggaacatagattggaaagtgactagagtagattctgggagacttagttaaaaggccattgtaatttcaggcaaaagaagatttta

SEQ ID NO: 125979 - DNA, 601 bp, Human
tctctccatcacgccatgcagaaaattgaagcctgaatgccttaatactatgccaagtactatcaatagtaaatgacagtcacacactttggtctgtcagactagagagtctgaagtcctaaggttcttaagttctttttttctttattatatgattacattctgtttgataggctcgtgctttattttacccaacagaaacatccacttcttggaaatagaaagtgttgtcatcaattatttatgtcatcaaatatctagggtctactactgctgtgctcttgaaaatattaattttttwttttttttttgagacacagtcttgctctattgcccaggcttgagtgtagtagcgtgatcttggctcactgcaatctccgcctcccaggctcaagtgattcttgtgcctcagcctcccgagtagctgggattacaggtgtgcatcaccacgccaggctgatttttgtattttttagtagagatggggtttctccatgttggctaggctggtcttgaactcctggcctcaagtgatctgctagcctcggcctcccaaagtactgggattacaggcatgagccaccgtgcccagccttgaata

SEQ ID NO: 125980 - DNA, 601 bp, Human
tttaatccacagatcatatcagcacagagaagaaatactgaatcctcttacacccaaaagagagatcccatcgattctccaattcatctttctaatagctatcagagaacatttactaaaccacagcatcccttctattatttttccctctggcttcatatcaccttaatgataagatgcaaactccaccactagatatttaatccctccataatttcccaacataaaggtctaaccttattcaataacaataaggacaattgcactaagtgctaatatttattgaccacttactacatgstaggaacagtgaatatgtgtcttgggtgatcctctcaataaacctgtggaggagatattatccttattttacagatgaggacactcagggcagaggacactcagcacattgcttgccaatatttaacctcagtcctctggttccaaagcccaggtatttaattctgacttacatcctgtttctgatttctgatttgacatttctggataaaattaatcccacactctattcttcataggtacgtattgctttcttgaatggaaaatcattcttttcactgcaagtacaaagcataatcat

SEQ ID NO: 125981 - DNA, 601 bp, Human
agtctatcttctagatcttgagctgtctgtgaacaggggcactcattgtcttgctcacccccctaccacttgtatcccgcctggcacttagtgagtattcactaaatatttgttgaatgaataaatgaatgaatgaataaatgaagattcagtataaatattaatgtaaatattatttgacaagaaaagaggcctatgcctatgtaggatggcaacaggataatgagtattactttataatcttgggcaagtcattcatttctgtcagtctcagttttctcctttgtaaacggggaggccractgatcctcactctaactcatccactggttattccgatcacataacatcatcagtgtgaaagccctttgcaaactttaaagtaatctatacataaggtatttgtcttggtaatagtttactttttaaggttaggaatgtccctaagccacatggggtaaatttatttcctaattataccagaaatggagcaccttcctgctgttacttctgcagctgctggttagcagtcgtgccacctctcagcaggggtggtacctgcagggagacaaagccattagcatctgcttaagcagaaggt

SEQ ID NO: 125982 - DNA, 601 bp, Human
tacagactgagaaaaagtatttgcaaaccacatacaagagattaataatcaaaatttacaaagaactcttacaactcaatagcagaaaaacaaataacccaatttaaaaaatgaacaaaggacctgaacagacatttctccacagaagacataaaaatggctaacaggaatatgaaaaggtactcaacagcactaatcatcagagaagtgcaaattgaaaccactatacaatattgccctgctcccataaggatggctattataaaaaagacaagagatagcaaatgttggtgagggtgtraagaaaaggaaacctttctatactgttggtaggaatgtagattggtacagccattatagaaaacaatatagaggttcctaaagaaattaaaaatagaactaccatacaacacagaaatccctcttctgggtatattcccaaaggagatgaaatcagcacagataaagatatctgcactcccatattaactgcaatattattcacaatagccaagataagggaagaaactaaatacctatcaacaaataaatgtataaagaaaatgtggtacacagttgtttctcagtatctactgggaac

SEQ ID NO: 125983 - DNA, 601 bp, Human
aattatcacaggcttgtggtcagcaagatgactgactagaggtggctaacactcgttgcccaacacaaaaaaggaccaaaacaatgaacaaacaactaaattttgactaaagtgactaacggagagcactgaagtacagtaagggggtggtgaaaaccctgtgaggcacagaaaagcaggatgactctatagagaaggaaacaaaacatcttgtctctgctacctcctctccccggtcaggattagctcagaaccaggtgagccctctccctgaagggaaaagtcttcatgggccctgagsccagtttagggaactgcctggagtttgcacagctgtactactccagaaaagaagcccacgttgtatcccactcccgacccttttattcaacctgctactgcactgtgacattttgaaagcaaagccctgctagagtgtgtttttctctagtggccagtagccactgcgcttctccatccctgaggcactgacatcattgcactatgatcatacacagtagtgctccattccccagccaagctgctgcagttccttacccatggggaacaagctgcctgggaggcactccatctcccccat

SEQ ID NO: 125984 - DNA, 601 bp, Human
cctgctgattttaattggaggttttgcctaagatgggaatacagtgtggggccagtggcattttaggggagatcatacaaatcgagtgccaaggagagaggaagaaaaacagatctaggttaaaatagaaagctataatccataactcccatttgcctaccaggagtgtgtatttaaaagtacagaggaaatggaaaaaaatgaaattggagctctgcattattcttttatttatgccctttgctttttccttggcatttctttgacactgtaatgggtgcccaagtaattctgtgactcyacaaaatgtgtattccacagaccacagactaaactgagaagacaaacagttgtttttttaggtttctgatgatgcgctgttctttagttgtgctgtgtgtgactctctctgtgcatgtgtgtgtgtgtgtgtgtgtgtgtgtgtgtgtgtgttaaagaagtggtatttataagagatgaatacgtcaagtcagtggtgtcagaatacttgagattccgctgaaaacagcctcagaaatgctatggatgtgctagtatgaattataactggccatcagactcactctgttcactatttttc

SEQ ID NO: 125985 - DNA, 601 bp, Human
atgttgggcagttttcttcaccttcctaatcattcccaccacacagagctatgtgaggattatatgaatttttatgtgaaggcttaaccccaaacttggtacttattaagagctcaataaaagcggttgttattcctgcaaagggactgtcagcaatattttacagacatggcaatggaagctaagggtgaaaggactgctcagagtcaaacaaacaatcagagtagtctcctggctcacagctgtggctttttgcattgtctgtcaagcgagagtcaagagcacctttcctaaggctgtygtgctgtggagatggtgatggtgatgatgacgatgatgctctcagtggttcctgatcttcattttataaaactagaaacagaagctaatttgcattgtactctctgtggtaggaagtgttaacaatccatctattctatcacttccactgatgagccacaatccccaaaccacaaacaccaagagcctaattaggcagtagagcctaatgttgaaaagtatggttgttggcccaagcggagctgagttcaaagctgcattctataaccgggatcaagtcacttcatctctttttaagtct

SEQ ID NO: 125986 - DNA, 601 bp, Human
agcttgtagcccttgttgcaggagccgcagagggagatgttggccaggctgcacatggcgcagctgttgttcccgcctatcacgcaggggatggggcgctggcacagcgtggtgctgccgtggcacacgcagctccgctggctctccaggaaggttccccaaaacccattctcattacagtagaggagtgactggacccttgcaagccactgctgaattgtcctgggagataaaggaaaattggagaaggttagctaccatgagtgggtctgtgagttacagttatccaactgataatgcraactggagctgccaaaaagatgaaaggactggatggagcagtgacaatacaggaagggcatcgaatataaacgtaagaactacattgtagctcctcctaatgccacaaaccagctgcatgacatcgtactttaccttcctaatgttcaatgtcctcatctgcaaagtgaaggggttggagtaaatgttccttggggtccttccagctctttgattccattatacactagtcccagaaaagtgtgattcaggaaatgaaagtgtctagactcaaataccccttctggatgacaacatattg

SEQ ID NO: 125987 - DNA, 601 bp, Human
aatcgagtgcagaagcaattctgtagccctaaaacgctccagaaagtaaaggcgcgggaggcggggggtgccaccaaactaaaagcagcaagtcccgtgtgccccgatgatgggtgtccccaagtcctcccgggaagtctccgggtgcctcaaaagccgcgttcaaaagttaagccgcacaaagtctctctgctcgtacctgtgcctccaacttcatgaaaccacatggtgttcgcggattaggggttcgttggcacccagggaaaagccgctgcccctcccccttcgggcccctgaggcyattaaagtgggaaatactccacgggaatccccctacccccaggcccaggacggcggcccgcgggcatccaggttcctgcccgtccgcagcccattgattcgccccgaaccctcgccccgccgccgcggccccaggcaggggtccccagatgcccgcggttcctacccgagaggtgaagcccgagcccagaggactcctcgccgcctcggagactgcaacacccgacgcggggtcgacagaaggtggagaccccgcgcgccctaacgcccctcctcacgcgcgccggccggctgggccaag

SEQ ID NO: 125988 - DNA, 601 bp, Human
cactctgagaggccaaggtgggcggatcacttgaggtcaggagttgaggtcaggtctactaaaaatacaaaattagccgggcgtggtggcgcacgcctgaaatcccaggtactcaggaggctgaggcataagaatagcctcaactcaggaggcagaggttgcagtgagccaagattgcaccactgcactccagcctgggcaacagagcaagactccatcaaaaacaaaaacaaaaataaaacacaatttacaaggtagataagttctagcttaaaagaaatagagtgagactcgcagcttwaaaaaaaaaaaaaaaaaaaaaaaaaaaacgacttcttggtttggcgcggtggctcatgcttgtaatcccagcactttggaaggccgaggcgggcggatcacctgaggtcaggagtttggaaccagcctagccaatacggtgaaaccccatctctactaaaaatacaaaaaaaaaattggccaggcctggtagtgggcacctgtaatcccagatactcaggagactgaggcaggaaaatcgcttgaagtggaggttgcagtgagctgagctcaggccactgtacttcagcttgggcaacaa

SEQ ID NO: 125989 - DNA, 601 bp, Human
atcccagcactctgagaggccaaggtgggcggatcacttgaggtcaggagttgaggtcaggtctactaaaaatacaaaattagccgggcgtggtggcgcacgcctgaaatcccaggtactcaggaggctgaggcataagaatagcctcaactcaggaggcagaggttgcagtgagccaagattgcaccactgcactccagcctgggcaacagagcaagactccatcaaaaacaaaaacaaaaataaaacacaatttacaaggtagataagttctagcttaaaagaaatagagtgagactcscagcttaaaaaaaaaaaaaaaaaaaaaaaaaaaaacgacttcttggtttggcgcggtggctcatgcttgtaatcccagcactttggaaggccgaggcgggcggatcacctgaggtcaggagtttggaaccagcctagccaatacggtgaaaccccatctctactaaaaatacaaaaaaaaaattggccaggcctggtagtgggcacctgtaatcccagatactcaggagactgaggcaggaaaatcgcttgaagtggaggttgcagtgagctgagctcaggccactgtacttcagcttgg

SEQ ID NO: 125990 - DNA, 601 bp, Human
gagccgagattgcgccactgcactctagcctgggcaataagagcaaaactccacctcaaaacaaaacaaaaaaaccagatgaggtcttactatgttgtccagactggtcttccagccttggcctcccaaagtgctggattaccacgcccagcctatgattttctattttgtatgcagttttgctaaagaagttctccaaaaggattaccttttaaaattcccctgtatcctgaaggggcactagtgttcaaatatagaagatgccagtttataaattatttaacacaattcataagttcaygtagggtgatttcagcaaaattcttcaaataagagtatatggtatcttgctgggcacagtggctcacgcctgtaatcccagcactttgggaggatgaggcaggtggatcacctgaggtcaggagctcaagaccagtctgaccaatatggtgaaaccccatcttgctgacaatacaaaaattagctgggcgtggtggcgtgcgcccgtagtcccacctactcgggagactgagacaggagaatcgcttggtctcgggaggcagaagttgcagtgagtcgagattgcactactgcactccat

SEQ ID NO: 125991 - DNA, 601 bp, Human
tgaacctgggaggtggaggttatagtgagctgagatcacgccactgcactccagcctgggtgacagtgcgagactccaggtctcaaaaaaaaaaaaaaaaaacccaaattaataaaacatagtatgctcagatattaaataccatatagccgttaaaaaataagattttcatgtacagaaatgaaaatatctttaagatacagtagatacagtgttaggctaaaaacacaattttaaaactaagcagcagccaactcggtgcactgactatataagttagccatgctctgtaaggggcagttaaaaaaaaaaaaaagtacaccccaaggagcaaagcagcttattgtatgactacatttgtgtttttctattttttcttgcgatggagtttcgctgttgttgcccagggtggagtgcaatggcgcaatcttggctcactgcaacctctgcctcccgggtcaagcaattctcctgcctcagcctcccaagtagctgggattacaggcatgcgccatcatgcccagctaattttgtactgactccgtcaatacagaaaataaaataaaaacaacataaacaaataaaataaaaacaaaattag

SEQ ID NO: 125992 - DNA, 601 bp, Human
atcccaacactttgggaggccaaggtgggcggatcaccaggtcaacaggtcaaacccatcctggccaacatggtgaaaccctgtttctaccaaaaatacaaaaattagctgggtgtggttgcgcacgcctgtagtcccagctactcgggaggctgaggcaggagaatcacttgaacccgtgaagtggaggttacagtgagctgtgattgccccactgcactccagcctggcaacagagcaagactctgtctcaaaaaacaaaaacaaaaacaaaaaacaccaaaacaaaaaacccacggcrggcgtggtggctcacaaggtcagtcattcgagaccagcctggccaacatagtgaaaccccgtctctactaaaaatacaaaaaattagctgggcatggtggcaggtgcctgtaatcccagccactcaggaggctgaggcaggagaatcacttgaacctgggaggtggaggttatagtgagctgagatcacgccactgcactccagcctgggtgacagtgcgagactccaggtctcaaaaaaaaaaaaaaaaaacccaaattaataaaacatagtatgctcagatattaaataccatatagc

SEQ ID NO: 125993 - DNA, 601 bp, Human
aattttttgtatttttagtagagacggggtttcaccgtgttagccaggacagtctagatctcctgacctcatgatccaccctcctcggcctcccaaaatgctgggattataggcgtgaaccactgcacccggcctaaaaatattttttaaattagccgggcatggtggcatgtgcccgtaatcccagctattcgggaggctgaggcaggagaatcgcttgaacccaggaagcagaggttgtggtgagccaagattgtgccactggactccaacaccggtgacagagtgagacttggtctcaaaaaaaaaaaaaaaggtgggggggggcgggtgtggcagctcacacctgtaatctcaacactttgggaggccgaggcaggcagatcacctgaggtcgggagttcaagaccagcctggccaaaatggtgaaacccagtctctactaaaaatacaaaaaacaaaacaaaaaaattagctgggcgtggtggcgcacgcctgcacgcctgtaatcccagctacttgggaggctgaggcaggagaatcacttgaacccaggaggtggaggttgcagtgagccaagatcatgccattgcatgtgaca

SEQ ID NO: 125994 - DNA, 601 bp, Human; identical to SEQ ID NO: 29569

SEQ ID NO: 125995 - DNA, 601 bp, Human; identical to SEQ ID NO: 29570

SEQ ID NO: 125996 - DNA, 601 bp, Human; identical to SEQ ID NO: 29571

SEQ ID NO: 125997 - DNA, 601 bp, Human
taaaaattttttcactcatctttttctggcattttgtcttctatacctgtactgtccagtgtggtaaccactagccacatgtggctatttgaactcaattacaaaatattcagaatttacttagtcatactagatatatttcaagtgctgaataatcacatgtggctagtggctaccatattggacagcacatagaaaacattctatcactggagaaagttttagacagtgctgagccagacatttgttgaaatattactgtggcccttttttattttcagattggagttttaattatctktgaaggagttaagagttcttgcttgggtcaagtgtttgcaaagaagattctttaaattctgtagctctcaaattttgagttatctgcacattagtttacaatccatgtagttatatgcattatcatatatagaaattaggaatgtgggcactggagtcaaactgtttgcttaccctatttctacctcttattagttgtgtgaattagggcaaattacttaatctctgaggctctgatttttgccccataaagaggggattaaactattgtttatcttatttaaagttcacggctgggctt

SEQ ID NO: 125998 - DNA, 601 bp, Human
tgtagttatatgcattatcatatatagaaattaggaatgtgggcactggagtcaaactgtttgcttaccctatttctacctcttattagttgtgtgaattagggcaaattacttaatctctgaggctctgatttttgccccataaagaggggattaaactattgtttatcttatttaaagttcacggctgggcttgttggatcctgtttgtaatcccagcactttgagaggctgaggaaggaggatcacttgaactcaaaagttggagaccagtttaggcagcatagtgagactttgtctstaatttataaaaaataaaatttaaaaaaaatttgaggattgagatgcttcatgtaaagggcttaaaatattttctgagataatgagcactgaatatttgcttattgtaaccagcatgttttgtgtaacacaggatactatataaaaaaaacattaattacagtgatggagacatgggggtggacaagaaacaggaaagttttggcaattaggaagattaagaaaaaatgttagatagaaaactaaatagtggtatttgtatttgatctgaaacttggacttttctttttctttttttttt

SEQ ID NO: 125999 - DNA, 601 bp, Human
ggagaccagtttaggcagcatagtgagactttgtctctaatttataaaaaataaaatttaaaaaaaatttgaggattgagatgcttcatgtaaagggcttaaaatattttctgagataatgagcactgaatatttgcttattgtaaccagcatgttttgtgtaacacaggatactatataaaaaaaacattaattacagtgatggagacatgggggtggacaagaaacaggaaagttttggcaattaggaagattaagaaaaaatgttagatagaaaactaaatagtggtatttgtatttkatctgaaacttggacttttctttttctttttttttttttgagacagagtcttgctctgtcgcccaggctggagtgcagtggtgtgatcccggctcactgcaacctccacctcccaggctcaagtgtttctcctacctcagcctccggagtagctgggattacaggcgctagccaccactcccagctaatttttgtattttttttgtagagatggggtttcgccacattggccaggctggtctcgaactcctggcctcaagtgatccacctgcctcgagctcccaaagtgctgagattata

SEQ ID NO: 126000 - DNA, 601 bp, Human
ttcttttgagacagggcctcactctgtcacccaggctggagtacagttgtgtagtctcagctcactgcagcctctgcctccacctcctgggctcaaacgattctcccacctcagcatcctgaaaggcgtgcatgccaccacactcagctaattttaaaattttttgtagagatgaggtctcaccatattgcctcagctggtcttgaactcatgggctcaagcagtcctcccaccttggcctcccaaagtgttgggattacaggtgtgagctgccacacccggcctcacattttcttattcrtagttggaatggaatggttagtaggtagaaatacctagaggaaacaaaggaaccaaactattcataaaataggagataagactcgagagtaaatcttctagttggatatgcagacagatcatgtgctggtatattctgactacttacctgttccaatattttatatatttttctgccatatctaaagcgaggaggagtaataagtccaatttgatactacaggtgaaaaaaaattaaaccttgtggccgggtgcggtggcttacgcctgtaatcccagcactttgggaggccgagcaggc

SEQ ID NO: 126001 - DNA, 601 bp, Human
aggttacagttagctttctactgaaaaaaaaaatttttaactattctttctgtctggagatctctctataactattcactgaaaggaagaagaatacacaggaaaaatatgtctcttttgctatgctattgctgacagtcttgaaatttagttactaagaaatgtgggccaggatgcacctgtataacagttacagctcaacacaaagttttatgtaactgaagttaagctttttaaagataatgctggaagatttcaaagcatcaatttgcagctgtgtggatttgtggtggtatttgcragcaaatttttcaaatcctggtagacttttttttagtgtgtgtgtggtttgtttttttttaattgagatggagtctcactgttgcccaggctggagtgcagtagcacgatcttggctcactgcagcctccgtctcctgtgttctggcagttttctgcctctgcctcctgagtagctgggattataggtgcccgccaccatgccccgctaatttttgtatttttagtaaagatgggatttcaccatgttggccaggctggtggtcttgaactcctgaccttgtgatccacccacctcggcc

SEQ ID NO: 126002 - DNA, 601 bp, Human
tttttcaaatcctggtagacttttttttagtgtgtgtgtggtttgtttttttttaattgagatggagtctcactgttgcccaggctggagtgcagtagcacgatcttggctcactgcagcctccgtctcctgtgttctggcagttttctgcctctgcctcctgagtagctgggattataggtgcccgccaccatgccccgctaatttttgtatttttagtaaagatgggatttcaccatgttggccaggctggtggtcttgaactcctgaccttgtgatccacccacctcggcctcccaargtgctgggattacaggcatgagccactgcgcctggctgactttttttagttttaaataagttatcttgagtgatgatttacttcaggaatggctatatggttaaagatcagaatggtgtatgagttacctttcaaagattacttttctgtatgtagtcataatgtgtgggcaaacattaatgtgatgttaccccttttactctgcttaagtagctgcttgtttaagatcttgatgactgattggttatatatggtgcagttttgtgttttaaaatgagtattactttatgatgaatggag

SEQ ID NO: 126003 - DNA, 601 bp, Human
ggccaggctggtggtcttgaactcctgaccttgtgatccacccacctcggcctcccaaagtgctgggattacaggcatgagccactgcgcctggctgactttttttagttttaaataagttatcttgagtgatgatttacttcaggaatggctatatggttaaagatcagaatggtgtatgagttacctttcaaagattacttttctgtatgtagtcataatgtgtgggcaaacattaatgtgatgttaccccttttactctgcttaagtagctgcttgtttaagatcttgatgactgatkggttatatatggtgcagttttgtgttttaaaatgagtattactttatgatgaatggagaaaatgtttaacctttttttaaaatgggaaatatttaaaactacagaaatagaaaagttgcaccagttgtggtccgtggaccagcggtgttggcatcatttgggagcttattataactgtagaaccttgtgcctcgccccagacgtactgaatcagaatcttcattttaacaagattctaagtgattcttatgtattaagttcatatacatttatatgaagctattcatctggagtcatagc

SEQ ID NO: 126004 - DNA, 601 bp, Human
gcttattataactgtagaaccttgtgcctcgccccagacgtactgaatcagaatcttcattttaacaagattctaagtgattcttatgtattaagttcatatacatttatatgaagctattcatctggagtcatagcatcttgccactttgttattgatgttgttatacatggttttcattctctgcgaacctccaattaattgtgtcttgagcaggactagcaagaggctaggtaagtttcgtttctccggaagcagtaacaatggcaactgatgattgttgagctcttgctgtgccttracctagcatgatgcacatagggcattgtgcattacttgaattgtcacagttcatcctcacaaaacttctgtgatgtatacattgttatgattcccactttccagatggggaaacaagatttatagccattttatttatttttttattcttttttaaaaaactattacctaaactctatacttggatttcattgatttttccattaactccctcttttctgttgtaggattaaatccagagtgccacattgcatttagttgtcacgtctccccagtctcctttcatctgtgagagtttcta

SEQ ID NO: 126005 - DNA, 601 bp, Human
gccccagacgtactgaatcagaatcttcattttaacaagattctaagtgattcttatgtattaagttcatatacatttatatgaagctattcatctggagtcatagcatcttgccactttgttattgatgttgttatacatggttttcattctctgcgaacctccaattaattgtgtcttgagcaggactagcaagaggctaggtaagtttcgtttctccggaagcagtaacaatggcaactgatgattgttgagctcttgctgtgccttaacctagcatgatgcacatagggcattgtgyattacttgaattgtcacagttcatcctcacaaaacttctgtgatgtatacattgttatgattcccactttccagatggggaaacaagatttatagccattttatttatttttttattcttttttaaaaaactattacctaaactctatacttggatttcattgatttttccattaactccctcttttctgttgtaggattaaatccagagtgccacattgcatttagttgtcacgtctccccagtctcctttcatctgtgagagtttctaagtctttccttagttttcatggtctaaacc

SEQ ID NO: 126006 - DNA, 601 bp, Human
ctgtgatgtatacattgttatgattcccactttccagatggggaaacaagatttatagccattttatttatttttttattcttttttaaaaaactattacctaaactctatacttggatttcattgatttttccattaactccctcttttctgttgtaggattaaatccagagtgccacattgcatttagttgtcacgtctccccagtctcctttcatctgtgagagtttctaagtctttccttagttttcatggtctaaaccatcttgagaaatactggccaggtatcctgtagaatgtytttgaaatctagatttgtctttttttttttttttttgagacggcgtcttgctctgttgcccaggctggagtgcaatggcacgatctcacctcactgcaacctccgcctcctgggttcaaacgattctcctgccacagcctcccgagtgactgggactacaggtgtgcaccaccatgcctggctaatttttgtatttttagtagagacagggtttctctgtgttggtcaggctgatcttgaactcttgacctcaggtaatccacccaccttggcctcccagagtgttgggattacaggtgt

SEQ ID NO: 126007 - DNA, 601 bp, Human
gattcccactttccagatggggaaacaagatttatagccattttatttatttttttattcttttttaaaaaactattacctaaactctatacttggatttcattgatttttccattaactccctcttttctgttgtaggattaaatccagagtgccacattgcatttagttgtcacgtctccccagtctcctttcatctgtgagagtttctaagtctttccttagttttcatggtctaaaccatcttgagaaatactggccaggtatcctgtagaatgtttttgaaatctagatttgtctytttttttttttttttgagacggcgtcttgctctgttgcccaggctggagtgcaatggcacgatctcacctcactgcaacctccgcctcctgggttcaaacgattctcctgccacagcctcccgagtgactgggactacaggtgtgcaccaccatgcctggctaatttttgtatttttagtagagacagggtttctctgtgttggtcaggctgatcttgaactcttgacctcaggtaatccacccaccttggcctcccagagtgttgggattacaggtgtgtgagccaccacacctggcct

SEQ ID NO: 126008 - DNA, 601 bp, Human
aactaagtaatcatctttgaaattagtcatgttaaaagttactcttcctagtatctctccacttttaacagttttaaatttcttcagttagaaactttaaggagatagaatcatattgtactttaagcagagtttataatacagttttgtcttggattgatagtttagaatgctgaaaggaactgttgttttgctggtcagtgcttaacaaagcagtggaactacctggttttcagagttgtacaaatgagaagatgttttccaggttttctgaaaccttttatagtttttatttgtactrtttcatcaaactttgtatttatgtgtgtgtatacttcatcatgatgtaaaatgtattatataggtcatggtccaaaaagtttgaaagccgttgcttgactttggccactaattgtttttttgttgttgttgttaatgtttagcattcagtcattacctactactttccagattctttctacagtcatgctaaagtggacagtggtctataaaataactaaaataaaggtcctgacttaatgatcttcaagacctagttaggagagatatatgtataaaaataattgtaatactgtgaagg

SEQ ID NO: 126009 - DNA, 601 bp, Human
tatgttatataattgaaaataaataacagatctaaggctttggtataagctgtctaatttacgtataatgtttaaatacacgtaaacagtctcttctctagtgctactagcacttgccgaggtgacttttgtatacatttgactttgctttctttattttattttattttatttttttgagacagagtcttgccttgtcgctcgggatggagtaccatggctcaatcttggctcactgcaacctctgcctcctgggttctagtgattcccgtgcctcagcctcctgagtagctgggaacaygagcatgtgccaccacacctggctaatttttgtatttttagtagagatggggtctcaccatgttgggcaggctcgtcttgaactcctggcctcaaatgatccacctgcttcatcctcccacaaagtgctgggttataggtgtgagccaccgtgcccagtttgacatttgccttctttaatgttcatttttatcttttcggatttttttaaaaagttttgttaagttattttatttctgttggcctagtttggccaatttattgacacattatacattagataattgtattttcatttttc

SEQ ID NO: 126010 - DNA, 601 bp, Human
tcaacaaggatgctgacagtagattaaaatttataaaataagttcaaatccatgagttcataatgggacttaaaaaattattggtctactttgaaggatgctggcgatttaactcattttgaaaactggtaaataaggaaaagaaataaaaccccttttcttcatgaactatacctcagagttaacaaatatgatgagggaaagtttctctttacagaagtgtaatgaagaaaagatgttttgggtaactgatgaatgatgtcaccattttactgcctcttattaatggaggaagacataycatcatcagtggctgctaaaaatgctaggtatgaagtgatggggagctttataatggatggataaggctggcagtacctgaatccacagatttatactaaatctcacacaaaagaaaacaacaaaacattaaatgccatctggtagaagtccacaacaccacgtataaactattcttgtcaagaagaactgaatttgaatctgatcaagcctctagatataatagccagtttataagaaatacaagggatagaaaaatatgttaaatgataacacaagggtgcgcttagcaaaatctgga

SEQ ID NO: 126011 - DNA, 601 bp, Human
taaaaattagaaatggaaaaaaggatagtttatgaaatgtcaattgcttttttatgtgtgtgtatacacgttaggaaatatgagaatttgctatttcagatttattgctacagatccacaaagaacttattaataagtgattttctcagacaagcagtgttactgattttttaaaataaattatattttatcatagctcggttataataaattatgttctcctggagtgatagagatggaaacttgaaaacaagcagaaactacaaataaatttctgcctgttactgtaagaattttttttaacacatttaatcttttcttcacacatttcttactttattattgctagagctttataaaggtaggtaccatgccttcaacttcttgacttctcaaagtttctaacccaggattttgtacttagtagattttgcatattgtcttagaagaagattacaatcttattgcttatgttttagccataaaaatctataaaatatgtcataaatctatcaagtatgtaataatctatcacgtataaataaattatcaactatggcagttgttactatagattaaatcaattcctttttcttttttt

SEQ ID NO: 126012 - DNA, 601 bp, Human
aatatagtttggttgatttgatcatctttgtattagggataaaacttgccatataagtacaaataaaaatactttataaattttgtctgcagtgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaataggtatggtctcagtttggtgctgaaaattgattgtggaaagtatttgttctttttgtatrtagtttctcaaatcttgtttttttttctctttgcactttcctagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcgg

SEQ ID NO: 126013 - DNA, 601 bp, Human
aacaaataccaaaattttgaataactgtaatagtgccatgccaagctatattgccaaaaaggaaaaaaattctaagactaatttctttttctagtatcctttggtttttaggatataagattttttgtcttgattgctgagttttttcgtgcttccttaaattttaagcctggggcaaatgaggggcttgccccactctagtccctgccctgctaccattccccgaagggtagagctttttgttttttcttttcttgcaaccgtattagatcttattctgttccctcagttgagcagatgrgaaaggtctggcaaggcttccttcctgtttccacaaaggtgactgctcactttctccaaggctgtaccatggaggaaagttttctccagtcttccttctcatgagcacctggtggaagttcgtggcaaagtgcttgagagtgggtgcaggtcctccgagttttggctgttaggtcctgtgatctcacaatagcgtacactcagccattagcagattttagctgatctcctcttacctgcttgtatggtacttgatttctgtcacctgtgttcttcacaaatgagccactgttcaagtcct

SEQ ID NO: 126014 - DNA, 601 bp, Human
ttttgaataactgtaatagtgccatgccaagctatattgccaaaaaggaaaaaaattctaagactaatttctttttctagtatcctttggtttttaggatataagattttttgtcttgattgctgagttttttcgtgcttccttaaattttaagcctggggcaaatgaggggcttgccccactctagtccctgccctgctaccattccccgaagggtagagctttttgttttttcttttcttgcaaccgtattagatcttattctgttccctcagttgagcagatgagaaaggtctggcarggcttccttcctgtttccacaaaggtgactgctcactttctccaaggctgtaccatggaggaaagttttctccagtcttccttctcatgagcacctggtggaagttcgtggcaaagtgcttgagagtgggtgcaggtcctccgagttttggctgttaggtcctgtgatctcacaatagcgtacactcagccattagcagattttagctgatctcctcttacctgcttgtatggtacttgatttctgtcacctgtgttcttcacaaatgagccactgttcaagtcctctttttctcttttt

SEQ ID NO: 126015 - DNA, 601 bp, Human
aggatctcactgtgttgctcaggctgaaatgccatggtatggtcatggctcactgcagcctcagcttcctggggtcaaatgatcctcccacctcagcctctcatgtagctggaactacgggtgcatgctacaaaaatacctggctaatattttaaatttttggtagagacaaggtctcactatgttgcctaagctggtcttgaactcctgggctcaagttatcttcctgccttggcctcccagtcatgctgggattacaggcatgagctgctgcactcagccacatttttcttttatgatktaaattactttattgatcaatgtttcttcacagttctgatctcctcaggaaaaatgcctagaggttatgttgctgcgtcagtagaataacttttggaggcttttgatataatgtctgattaccttttaaatcaaaatatccaccagaggtatatatttttctctgtttgctctttaattttgtttatggaatgtttttgatacatttaataacatttttaagattccgaccatcttttataatggtttttgctcttaagatacaagctgtttttacactaaggttgggtaaatattttcc

SEQ ID NO: 126016 - DNA, 601 bp, Human
tataatggtttttgctcttaagatacaagctgtttttacactaaggttgggtaaatattttccaattccagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtaaggtgttataagacaatcgcttcaacttggttttagtagagtgtgaaactaaaatgtaaaaacgcygtaattttcaaaaattgtgatgaagttttagaagaggcaaatctgttatttgagtaggaattgggtggttctgcttttgggtatttgttataactgaacaaaacaagtttggtgtctaatctttgcatgttatttatttatcgctaaactgcttagactacacaattttttttattaatttgactcaatagtgatcctttcgaataataaaagtagttttgatgcatttgatttttaaaaattctcacggtgtttatgactcccaaagttactaattttttgtggaaattctgtattttt

SEQ ID NO: 126017 - DNA, 601 bp, Human
agaacttccttattgtttatcctgtgtgttgggaacctttagatattggtgctttgtcatttgttactgtgaagaaaaaattaagtagtctagattcccctgtaaaactttcctcccagtgtatgctttaggtcttcttctagaaggatgacatcttgtagtctaggaatttctgtgtacattatatataagtacacttttactgagaagggaaggtgtttaaggattatataacatttaatagtggatgttaagtacacttttgtatatttgaaggaaatttacaaccttatgctttctrttttcattttgaaagataatctgagggtttttgaagtttagaattcattctcagaaaaattaaatttttggctctggcatacgtataaaaaatacattttgcattgagtttattcctacaaatattaataattgaaacttgttggtgaactatatatatatttaaatggttaagcattttttagccagtacatttctcatgttatttattaagacaatctgaaaaaatttattgctttttcagattcttccagatgatcccgataaaaaaccacaagcaaaacagttgcagacccgtgca

SEQ ID NO: 126018 - DNA, 601 bp, Human
ttgcactccagcccgggccgacaacagtgagactctatctcaaaaaaaaaaaaaaaaaaaaaaacaaggaagataaaaggaggccaaggtgggcccaggtgctgggattacaggcatgagctatcgcacccagctggtgtcttaaatttagaagcaactcggaaagactttttaataaagacttttaagaagaggggtttaacaagtactttgagtgaatttgttttcctccagctcgtatttcaaatttttaaattcccaatgccattaaaaaataaatatgtacacacacacacacacatgtgtaatagtgcttcttatttatggtgaaggactagtttttttcccagttttttgcagaccaatatattttttaaaaaatacaagaagaatgaaatgtttcactagaaaagtgaaataagaaaaaattatgtacaaaatatgagcctaatgttttgttagtagatgcagtagctataaagttgcattgtcaaattatgagtttctaaacaggctcagtttttgtaccgatgttgttttggactggcaatatctcttgtcaaatatactgattctccatgttgtcatgcctttgcgttcc

SEQ ID NO: 126019 - DNA, 601 bp, Human
tgcagctcctatcttccattttatttatttgagccatattttttatctctggacttttatttttatctcctctgcaggttcacaggctggaatttcttctctctttttcaagggtaaccgtttttgtttttgttttttgtttttgtttttgttttttacctactctgtattgggtgggagtcaggggaggtggtattctttagcttttttgaagtgaaaacattaaacttttcactggagctacttccccttctctatgtggtctactaatgaattaggtgaaattgtatctcttgccacytttttttcccccacatttcttttttaatcttcggactttttcatgtaactgctggaatggaaaaattcctgctgtgcacaatgcatgaatttcctctccattaatcttaaatgatattgtgtgtatcatggaaatgaagactggaatagttcttaaacgtggactctgtagccagactttctggcctgtataggattttacctctaagtaaggaattccattgtatttgggaatagctctaagtaattatgaaattcaatggccttttctaggtcgtcactctctaaacatatttgcttc

SEQ ID NO: 126020 - DNA, 601 bp, Human
tcatgtaaatatcattgaaggaggtagaccttgttgaatttaggtttttaatacatgtgtttatattcttgttttctcattttaaagtgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaagtaagtgatacacttttcaggaagtgttaaatttrtattatataactgtctttttttttttttgttttctttcctgattctgaagtttaggtaacaagataatttttaaagaggtaacctacagatgattgttttaatttttctccctttaatgttaaatttttttatttatgagtggttacttatgtatcatggtatgtaacaagtggcatctctgcctttaaagaaatagtgaaagctgtttcattaaaattcagattgcattttatttgaaaaagtctttgcaatttaccaaattattatcagtaatatcttttgaagttggtgttcccaca

SEQ ID NO: 126021 - DNA, 601 bp, Human
atcctccgcctcctgggctcaagctatccttccacctcagtctctttggtagctgggactacaggcccacgctaccaggcctggctaattcttgtattttttgtagagatggggtttcaccatgtcagccaggctggtgttgaactcctgacctcaaggaatctgcctgccttggcctcccaaagtgctggggggaattttttttttatttttaatgcagaaacaagaaaaaaaagtaccttatattaagacctatcattggctgacccgatcccctcaagaacagtcattgtgggctggrcacaatggctcatgcctataatcccagcacgttgggaggccaaggtgggcgcatcacaaggtcaggagattgagaccatcctggctaagacggtggtctactaaaaatacaaaaaaaaaaaaaaaagtagtcgggcatggtggcatgtgcctgtagaaccagctactcaggaggctgaggcaagagaatcgcttgaacccaggaggtagaggtcgcagctattttgctttaagggatatttccctttctttcctgaatgaaagaagatagagatctaaaccacaattacagaacagttgg

SEQ ID NO: 126022 - DNA, 601 bp, Human; identical to SEQ ID NO: 32203

SEQ ID NO: 126023 - DNA, 601 bp, Human; identical to SEQ ID NO: 32204

SEQ ID NO: 126024 - DNA, 601 bp, Human
tgggtgcggtggctcacgcctgtaatcccagcactctgggaggccaaggtgggtggatcacaaggtcaggagattgagaccatcctggctaacatggtgaaaccccgtctctactaaaaatacaaaaaaattagccaggcgtggtggcaggcgcctgtagtcccagctacttgggaggctgaggcaggagaatggcgtgaacccaggaggcgctgcttgcagtaatcggagatcgcgccactgcactccagcctaggtgacaaagggagactccatctcaaaaaaaaaaaaaaaaaaaaaagggatcggggtcccctcatctgaaaagactgagtcacacaattccctcctttattcctcctgccctggcccttcctgattcaattccttggttcacattccataacaatagtcaactcatacgaaagctctgagaagcactgtgtaagcccttgaatccataaaataatttcatcctcacaacatcctatgaggtaggttctatttatatccccattttgtgaatggagaaaccaaggtgcagagattaccttattattgtcttattatctgccactccgtataggtaacagatccagga

SEQ ID NO: 126025 - DNA, 601 bp, Human
ctgtaatcccagctactcaggaggctgaggcaggagaatcacttgaacctgggaggtggaggttgcagtgagctgaaatcgtgccattgcactccagcctggggaacaagagcgaaacttcgtctcaataaaaaaaaaaaaaaaaggctgggtgcggtggctcacgcctgtaatcccagcactctgggaggccaaggtgggtggatcacaaggtcaggagattgagaccatcctggctaacatggtgaaaccccgtctctactaaaaatacaaaaaaattagccaggcgtggtggcaggckcctgtagtcccagctacttgggaggctgaggcaggagaatggcgtgaacccaggaggcgctgcttgcagtaatcggagatcgcgccactgcactccagcctaggtgacaaagggagactccatctcaaaaaaaaaaaaaaaaaaaaaagggatcggggtcccctcatctgaaaagactgagtcacacaattccctcctttattcctcctgccctggcccttcctgattcaattccttggttcacattccataacaatagtcaactcatacgaaagctctgagaagcactgtgtaagccct

SEQ ID NO: 126026 - DNA, 601 bp, Human
tgagattgcgccagtgcactccagcctgggagacagagcgagactccgtctcaaaaaaaaaaaaattagccaggcgtggtggcacatgcctgtaatcccagctactcaggaggctgaggcaggagaatcacttgaacctgggaggtggaggttgcagtgagctgaaatcgtgccattgcactccagcctggggaacaagagcgaaacttcgtctcaataaaaaaaaaaaaaaaaggctgggtgcggtggctcacgcctgtaatcccagcactctgggaggccaaggtgggtggatcacaargtcaggagattgagaccatcctggctaacatggtgaaaccccgtctctactaaaaatacaaaaaaattagccaggcgtggtggcaggcgcctgtagtcccagctacttgggaggctgaggcaggagaatggcgtgaacccaggaggcgctgcttgcagtaatcggagatcgcgccactgcactccagcctaggtgacaaagggagactccatctcaaaaaaaaaaaaaaaaaaaaaagggatcggggtcccctcatctgaaaagactgagtcacacaattccctcctttattcctcctgc

SEQ ID NO: 126027 - DNA, 601 bp, Human
atccaacaggcagggaggggagagcgctggaaacaagggtgcggagaaggggcagagatggggggagaatcacaatgctagggtaaatgactgtcactaacaggaggcagacacttgaaaacaaaccagtccgtttttatggagactccctgtggatccactcccccaccccaccccaggctttatcctcagctccagggcccacttcctgcagcctcagtgtgtgtggctctggattctgggcaaaaagagatcacggggccaggggcggtggctcatgcctgtaatcccaacactttgrgaggccaaggcaggcggatcacctgaggtcgggatcgagaccagcctgaccaacatggagaaatcccgtctctactaataatacaaaaattagccaggcgttggcagggcgtggtggcttacgcctgtaatcccagcactttgggaggctgaggcgggcggattacaaggtcaggagatcgagaccatcctggctaacacagtgaaaccccgtctctactaaaaatacaaaaaattagccaggcatggtggtgggcgcctgtagtcccggctactcgggaggctgaggcaggagaatggc

SEQ ID NO: 126028 - DNA, 601 bp, Human
aaaggtgccacccaggctgggtatggtggctcacacctgtaatcccagcactttgggaggccaaggcaggtggatcacctgaggtcaggagttcgagaccagcctgaccaacatggaaccccgtctctactaaaaatacaaaattaggccaggcgcagtggcttatgcctgtaatcccagcactttgggaggctgaggtgggcggatcacgaggtcaggagtttgagaaccagactggtcaacatggtgaaaccctgtctctactgaaaaaaaaaaaaaaaattagccaggtatggtggckcgtacctgtagtcccagctactcaggaggctgaggcagaagaatcgcttgaacccaggaggtggaagttgcagtgagccaagatcgagccactgcactccagcctgggcaacagagctagacttcgtctcaaaagaacaacaaaaaaatacaaaattagccaggcgtggtggcacatgcctgtaatcctagctactcgggaggctgaggcaggagaatcgcttgaatccaggaggtggagggtggaggttgtagtgagcaaagattgcgccattgcactccagcctgggcaacaagagca

SEQ ID NO: 126029 - DNA, 601 bp, Human
actccgtctcaaaaaaaaagaagtaaaggattagggaatagccctggtccctacccctagcctagactggtgcccaagtcagggtcctggccagagctaccatgtctgactccccatccttgcctggtgaaaggtgccacccaggctgggtatggtggctcacacctgtaatcccagcactttgggaggccaaggcaggtggatcacctgaggtcaggagttcgagaccagcctgaccaacatggaaccccgtctctactaaaaatacaaaattaggccaggcgcagtggcttatgcctgyaatcccagcactttgggaggctgaggtgggcggatcacgaggtcaggagtttgagaaccagactggtcaacatggtgaaaccctgtctctactgaaaaaaaaaaaaaaaattagccaggtatggtggcgcgtacctgtagtcccagctactcaggaggctgaggcagaagaatcgcttgaacccaggaggtggaagttgcagtgagccaagatcgagccactgcactccagcctgggcaacagagctagacttcgtctcaaaagaacaacaaaaaaatacaaaattagccaggcgtggtg

SEQ ID NO: 126030 - DNA, 601 bp, Human
tcaggcctggcatggatgtggggcagagcagggggaacagctgggggccaggaataggaaatgctggaggggagactggaggggccacttctgctcccaggggctgggggacaggaagcaggtgtaccccagcctgagtctccagctgcctgagtccgtctcctcttggccaagggggtatggctgctgggccacagaccagccctacctgcccagggaagtgatttagtcccccacccccacctcaggggcctggggcccattcctgagagttagtgaagccagatggaaaagtgggggrgctggcactgagcagtcaagcctggcctgttggggatagggggctggccagggctgagggcgcttggctgggctaatggcccctggaagctaggtgtgagggcaacttcctcctcgcccccgcccttctcccaggctgggccaagggccagcaccccgtctggggtcgggaggagctgcaaccccttccctttctgcaaccccttccctttcggcaggccaggcttgggcgccacctgctggccgctcccggcaccaccgcctgcgcccatgcgagcagcgccactggggaggtccaggg

SEQ ID NO: 126031 - DNA, 601 bp, Human
cacctgatgtcaggagttcgagaccaactcctggcctggccaacatggtgaaaccccatctctactaaaaatacaaaaatcagctgggcatggtggtgggcacctgtaatcccagctacttgggaggctgaggcaggagtatcgcttgaacctgggaggcagaggttgcagtgagccgagattgcaccactgcactccagcctgggtgacaagagtgagactctgtctcaaaaaaaaaaaaaagaaagggaagggatgccggagatagggtccggctggagcactcaccagatcctccacygtggcggggccccgggatcggagccgcagggtccctcggccagtgcccagttgtgggccagagccagggcggccacccgctgaacgctggctgatcatgtctgtgggaggcaggagaggagtgagtgtgggggaagcttggttttagcacgttctgggcaggaacttgtccttcctggctttcaccaccaccccaaacttctccaggcttctgcaagtttctgggggctggggccggggtgatcccaggagggcaggaatcctgactcaggcctggcatggatgtggggcagagcagggg

SEQ ID NO: 126032 - DNA, 601 bp, Human
tgggcgcggtggctcatgcctataatcccagcactttgggaggccaaggaggctggatcacctgatgtcaggagttcgagaccaactcctggcctggccaacatggtgaaaccccatctctactaaaaatacaaaaatcagctgggcatggtggtgggcacctgtaatcccagctacttgggaggctgaggcaggagtatcgcttgaacctgggaggcagaggttgcagtgagccgagattgcaccactgcactccagcctgggtgacaagagtgagactctgtctcaaaaaaaaaaaaaagaaagggaagggatgccggagatagggtccggctggagcactcaccagatcctccaccgtggcggggccccgggatcggagccgcagggtccctcggccagtgcccagttgtgggccagagccagggcggccacccgctgaacgctggctgatcatgtctgtgggaggcaggagaggagtgagtgtgggggaagcttggttttagcacgttctgggcaggaacttgtccttcctggctttcaccaccaccccaaacttctccaggcttctgcaagtttctgggggctggggccggggtga

SEQ ID NO: 126033 - DNA, 601 bp, Human
gattataggcatgagctaccacacccagcctgctatggtttggataaggtttgccccattgaaactcatgctcgaacaatcgattggctaacgaggtcgatgacgccaggcacaagatgctgggcctaccgcggtagcgtgagggaagccgtgcgttctgttccaaggcatctgtgagcccatggagtatacaccatgagcaaagctcaccctcctgagttgaaaaaatttacggacaagaagttttcattgaaattaaatggtggcagacatgtccaaggaatattgcggggatttgatycctttatgaaccttgtgatagatgaatgtgtggagatggcgactagtggacaacagaaaaatattggaatggtggaaatacgaggaaatagtatcatcatgttagaagccttggaatgagtataaataatggctgttcagcagagaaacccatgtcctctctccatagggcctgttttactatgatgtaaaaattaggtcatgtacattttcatattagactttttgttaaataaacttttgtaatagtcaaaaatgctttttcagatgttctgaatatacaatattagctctcattcca

SEQ ID NO: 126034 - DNA, 601 bp, Human
aagcagagcagcagaatgacagagtgacaggatgagagaggcagagggacccagaaagatcctgtcccccatgccaagtgacacagaagaaaaaaacaatgctggaggtggctctgggaaatgttcagggggcaggatgggtttggaagggggggctgtgctaaggtgaagagggaaagggcaggagaaagatggcgggggctggaggggggaggggtgtggtcagcaagtggccaaggtccctgcgcggtggaggcagacagacctcatcgcattcccaaactggtagaaacctgggtckgggtcaggcagaggatcccataggtgagagaggtgagtgaggaagtggggggattagaatctgggaagaggggccaggaaaggagggggtaggctggtgacaggggcccatgtggggccccagcggtcatacgtgccatggttggcagtgacagctgggggggagcacggtctttgcagcatggggcggccctaggggaaggggacccctacagggggtactctgcgggcccgcgggccccagccttggacaggccggggcaaggggcgctggggggtaggcagagaggatgaggggccc

SEQ ID NO: 126035 - DNA, 601 bp, Human
ccgaatgaacctcgctaaacccagacacttttcatcccaagccaggagtggtggaagaagccccagggactgggtgaatgacggagcctcagttgtgaaacgaccatttattgaggggccctccatggagcctagagctcactgcaagacaggaaatgagagggggctctgccaccacccccttaccccaacgcaggaaagaggatgcaatgaatcccaacaagaccagctcaaacttggctttggaagcactgaagcaattctctacgttcataaacagtctgctaccccagccagggamagacgcttgcttggaggacggagcacaagcagagcagcagaatgacagagtgacaggatgagagaggcagagggacccagaaagatcctgtcccccatgccaagtgacacagaagaaaaaaacaatgctggaggtggctctgggaaatgttcagggggcaggatgggtttggaagggggggctgtgctaaggtgaagagggaaagggcaggagaaagatggcgggggctggaggggggaggggtgtggtcagcaagtggccaaggtccctgcgcggtggaggcagacagacctcatcgca

SEQ ID NO: 126036 - DNA, 601 bp, Human
gaaagcagaaatctagaaactcgccctgggaatggggaattgcaacagcagaatatcaatttgggcaaggggcttggggtctctctcggaaggagcccagccacagaacccccttcctccggacaacaatctcagaccttctgcccttttgaaatctggctgtcctgggaattctggggcaggaatgcccagcctgggctgggccccctactcgaggctggctgattcctccagtggagcctggattccctgctctgggcttacctaaatgacacaactctgagctggaccccaacactggctggaacgacccccattctgagctggaccccaacactgggatggctcatcctacagtctgagctgaaccccaacactgggatggaccactccaccacccctctctgagctggccccctgccgggtggaccatcctcccttgtctgaactgggccaccgatcccctctctcttccccaggccgcacagcccggggctgtacaggaggcgtttccagggccagccaggggttcacatccttcttctcttcgcctgtgccccagaccccgctgcagcccctccctgacttaaggggcagagtg

SEQ ID NO: 126037 - DNA, 601 bp, Human
ccattacactgcaggctgggtgacagagtgaggccctgtctcaaaaaaaaaagtaataataaaaaaaccccaaaaacaaatataggagatacactgagtgctcaaatcttaaatgcgcagcctgacagattcttgcattatggacttgtccttttaaccaccacctagggctacaagggaccagccccttgctgagtattttctatgcttcgttctcaccctgtggggtgggagctgctgttattcccactgtacagaggagaagactgatcaggtctgaggtcacttgcctgcccccacrtcccatgagattaactacttcactgccaactcagccattggtttcagtgctgagtccagtgcaccagggtggccaatgtggacagagctgccttcaaccccctgatgttcctgggtttgctgccaccgaggggccctgtacacttgccctttggcattgctggttatctgcctgccagtaatcccacatggccttgtggggagccacccccactacctgtctccagagctttccctcagcattcagagagaagagccctcatggagctagaaagtggtagatggtggctgggtgcagtgg

SEQ ID NO: 126038 - DNA, 601 bp, Human
agcaggaggctgaggcaggaagattgcttaaagcccaggagattgaggttgcagtgagctatgatcacaccactacactccagcctgagcaagagtgagactctttctcaaaaaaataataatactctgggaggccgagttggggggattgcttgaatacaggaattcgagaccagcctggacaacatcaaaaccctctacaaaaaataaaaacattagccaggtgtggtggtatgcacctgtagtcccagctactcaggaggcagaggtgggaggattgttcaagcccgggacatagagsctgcagtgagccgtgactgagccattacactgcaggctgggtgacagagtgaggccctgtctcaaaaaaaaaagtaataataaaaaaaccccaaaaacaaatataggagatacactgagtgctcaaatcttaaatgcgcagcctgacagattcttgcattatggacttgtccttttaaccaccacctagggctacaagggaccagccccttgctgagtattttctatgcttcgttctcaccctgtggggtgggagctgctgttattcccactgtacagaggagaagactgatcaggtctg

SEQ ID NO: 126039 - DNA, 601 bp, Human
tggggtgcagttccaacccagagcctgacctttttctggtgcctctggggccttggctgggccgtggcctgggcctcccttgctacagagaggtgggatccagctgccactccatccaaagtggggtacagagagtctcaggggtcactcgcaggggaacggagggaggtgcccaggcagaccagcccacccccactcgccccagttctgaccgacattccatggccagggccgacgccagccgaggtatttatagccttgggatttggctgttcctctggccccttctctggggaggccrggcctgggatggaggcctcgggggctcgggtagcaggtgcccttggggggctcagctgtcaccttggcccccagctggccctgttcctctccgtggcaatcgcaagggcattgctccagagctggttcaagggaagtctcgcccgatgcccactcctcggccccatggtatcccaaggtgaacatcaccgcctggctaatgttgaaacttccccggcagaccctgtgccggctgctgtctacactgtctcatctgactcactcggcaacctgccttgtatccattgtctccacttaacaa

SEQ ID NO: 126040 - DNA, 601 bp, Human
cttctttggctttggctaagaattctttcactgaaagggagagaggggagagttatacagagacgcccgtctcaccggggtgggttcaggtgatttctggggagatacttggtggaaagtggggtgcagttccaacccagagcctgacctttttctggtgcctctggggccttggctgggccgtggcctgggcctcccttgctacagagaggtgggatccagctgccactccatccaaagtggggtacagagagtctcaggggtcactcgcaggggaacggagggaggtgcccaggcagascagcccacccccactcgccccagttctgaccgacattccatggccagggccgacgccagccgaggtatttatagccttgggatttggctgttcctctggccccttctctggggaggccgggcctgggatggaggcctcgggggctcgggtagcaggtgcccttggggggctcagctgtcaccttggcccccagctggccctgttcctctccgtggcaatcgcaagggcattgctccagagctggttcaagggaagtctcgcccgatgcccactcctcggccccatggtatcccaaggtga

SEQ ID NO: 126041 - DNA, 601 bp, Human
tcttctttggctttggctaagaattctttcactgaaagggagagaggggagagttatacagagacgcccgtctcaccggggtgggttcaggtgatttctggggagatacttggtggaaagtggggtgcagttccaacccagagcctgacctttttctggtgcctctggggccttggctgggccgtggcctgggcctcccttgctacagagaggtgggatccagctgccactccatccaaagtggggtacagagagtctcaggggtcactcgcaggggaacggagggaggtgcccaggcagrccagcccacccccactcgccccagttctgaccgacattccatggccagggccgacgccagccgaggtatttatagccttgggatttggctgttcctctggccccttctctggggaggccgggcctgggatggaggcctcgggggctcgggtagcaggtgcccttggggggctcagctgtcaccttggcccccagctggccctgttcctctccgtggcaatcgcaagggcattgctccagagctggttcaagggaagtctcgcccgatgcccactcctcggccccatggtatcccaaggtg

SEQ ID NO: 126042 - DNA, 601 bp, Human
ctgacccctggggctggcacattatgggggctcggggaatagtgggtgagcctggcatggtggctcatgcctgtaatccctgtgctttgggaggctgaagtaggagatcacttgaggccaggagttcaagaccagcctgggcaacacagcaagaccccctgtctaaaacaaaaaacaaacaaacaacaaaaaaaaattagccaggcatggtagtgtgcgcttgtagtcccagctactcaggaggatctcttgagctcaggagtttgaggctacagtgagctatgatcacgtcactgcactytcctgcttgggcaacagagcaggatcctgtcccccacaaaaaaaccaagcggccaggcgcggtggctcacgcctgtaatcccagcactttgggaggctgaggcaggtgtatcacctgaggtcaggaattcgaaaccatcctggccaacatggcgaaaacccatctctactaaaaatacaaaaattagctgggtgtggtggcaggcgcctgtaatcccagctactcgggaggctgaggcaggagaatcgcttgaactagggaggtggaggttgcagtgagccgagatcacgccactgtact

SEQ ID NO: 126043 - DNA, 601 bp, Human
taagcatacaatagacactggattttaaagatacttcagtacagaaaaaaaggaaatatttccgaagtcatggaggactgggaaaaaaacaaaaggaatgtaaaatgtttcattaatgatattttcacattgataatatatggaaagggtaatactgtagatatactggcttaattaaaacatatcattaggccaggtgtggtggctcacatctgtaatcccagcactttggaaggctgaggcgggcggattacctgaggtcaggagttcgagaccaacctgaccaacatggtgaaaccccaagtctactaaaaatacaaaagttagctgggcgtggtggtggcacccataatcccagctacttgggaagctgaggcaggagaatcacttgaacctgggaggtggaggttgcagtgagctgagatcacgccactgcagtccagcctgggcgacaagagtgagactctgtctcaaaaaaaaaaaaacataaaaaaaagccccaaacatgtcattaaaatgaatttcatgaatgacacctgtttctttcattttctcttttaattacaaactttgggtgtttttttagagatggggtctggct

SEQ ID NO: 126044 - DNA, 601 bp, Human
attattacggatctcaagacagcagcagcagcaaagcgttaaaccaggtgtggggtccctcggagaacaggcccttgtgcttctctgggtcaaacgtccatgaagctggccctgagtggcctttcctgtttctcatgaccacagctttggatggcacccaaaacggctcccaaagggcgctcaagacgtgcctggaactgtcatgacaaccccaccaggctggaactggtatgatccccattttaccatgagaaagctgaggcttggggagataagtctcttgcccggggccacacatcargaagtactgaactgggaaatgaaccccggctgcctggggcagagtttgtgctcctgggtcaggctcttaccataaaccaggtgctgcttttgagggatgttactgaggttgggtgactcaccaagggtatcgaactacaaactggctggaccaggaactgaacttgggtctaccagagtcccagcctgactcctgtcccctgatctccctcctccagggatcttgttcttccacaaaagagagcagccactgattgtcctcagctccgaccccagccctgggggccagaaggctgggacc

SEQ ID NO: 126045 - DNA, 601 bp, Human
agtggtcatgccccaaaatggtccagcaggtggccctgcagagcctacctcagaggaagacacctccagtccagccgtcagaaacgcaaggcacctgattcttagatagcccgacatgggaaacagcctgtgggtccatccacaggaaaatggaatcacagactgagctatagtcatacaatggaattccactcaccaccaccaccgccaacaggacagcccatgcatccactcaacaatgtggctgcatttcaaactgattatgttaagcaaaagaagacacaaaagaacatgaatgatyccatttatatcatgtccacgcccagacaaaacaaaggcacggtgtttgaagtcagaaaggacaactgcctttggtggggaggtgacgtgtcaagagagggattcggcccggtgcggtggctcacccctgtaatcccagcattttggggggtcgaggtgggaagatcgcttgagcccaggagttcgagaccagcctgggcaatataggcaagacctcacctctgtatgtatgtagatatgtgtgtgtgtgtgtatatatatatatatatttttttttgattaatttattttttttaagaca

SEQ ID NO: 126046 - DNA, 601 bp, Human
gtcacctgtgggcacaagaacaggcagttggcagggaggaagggtccaggccacggcttccccagggctgcccctcgcccggcctggtgggcacctgaatgtagccctgctggtcaatgagcagattctccggcttcaggtccctgtagatgagatccagcgagtgcagatactcaaaggtcaggacgatctgggccgcgtagaaacgggcatggggctcactgatggggacaaatggggaggtgaacgtcagtggtcatgccccaaaatggtccagcaggtggccctgcagagcctaccycagaggaagacacctccagtccagccgtcagaaacgcaaggcacctgattcttagatagcccgacatgggaaacagcctgtgggtccatccacaggaaaatggaatcacagactgagctatagtcatacaatggaattccactcaccaccaccaccgccaacaggacagcccatgcatccactcaacaatgtggctgcatttcaaactgattatgttaagcaaaagaagacacaaaagaacatgaatgattccatttatatcatgtccacgcccagacaaaacaaaggcacggtgtttga

SEQ ID NO: 126047 - DNA, 601 bp, Human
ttttttgagacagagtcctgccctgttgcccaggctggagtacaatggtgtgatcttggctcactgcaacctccgcctcctgggttcaagtgattctcctgcctcagcctcccaagtagctgggattacaggcgcccaccactatacccagctaattttttttgtgtgtgtttttagtagagacggagtttcaccatgttagtcaggctggtctcgaactcccgacctcaggtgatctgcccgccttggcttcccacagtgctgggattacaggtgtaagccaccgcgcccggccagtttktttttttttttttttttttagagatggggtctggctatgttgcccaggctggtctggaactcctggcctcaagcctccacttcccaaggtgctggcattacaggtgtgagccattgtacccagccccaaagtttcaaagccagtcggtggcagagctgggactggggcccaggctgagcctgagggtgctcccaccacagtgtcatgactccgggccaaccaaaagctcctgtgtaggagatgctggaccaagtcgggggatggtcgggtcttcccagcaaggtggttgagctgagggca

SEQ ID NO: 126048 - DNA, 601 bp, Human
aaaaaaaaaaaaagagaccggcactatggctcacgcctgtaatcccagcactttggaaggctgaggcgggaggatcacctgaggtcaggcgtttgagaccagcctggccaacatggtgaaaccccagtctctactagaactataaaaaatgtgccaggcgtagtggcgggcgcctgtagtcccagctactcgggaggctgaggcaggagaatcacttgaacccgggaggcagaggttacagtgagctgagatcgcaccattgcactccagcatgggtgacaagaccgaaactctgtgtccaaaaaaaaaacacggcaaatgggctgggcgcagtggctcatgcctataatcccaacactttgggaggccaaggcaggaggaccacttgaggccagagttcaggatcagcctgggcaacactgcaagaccgtctttacaaagataaaaattagccgggcatggtggcacacctgtaatctcagctacttggaaggctgagctgggaggatcccttgagctcaagagttcaagtttgcagtaagctatgatcacaccactacactccagcttgggcaacagaatgagaccctgcctcttaaaa

SEQ ID NO: 126049 - DNA, 601 bp, Human
gtccagcctgggcaacttagcagaacccatctctttaaaaaataaaaaagatggccaggcacagtggttcatgcctgtcatcccagtactttgggaggctgaggtgggcagatcaccaggtcaggagttcacgaccagcccgaccaacatggtaaaacctcatctctactaaaaatacaaaaattagccaggtgtggtggcacatgcctctaatcctagctactcaggaggctgaggcaggagaatcacttgaacctgggaggcagaggttgcagtgagccgagatcgtgccactgcactscagcctgggtgacagagcaagactctgtctcaaataaataaataaataaataataaaaaagataaataaaaaaagttaatcacagtgtgaggtgtatcagaaaatagttaagtaaatgacagagcacctgaatgctaaaatattgtggagctttaaagagccacacggaggccaggtgcagtggctcacacatgtaatcctagcacattgggaggctgaggcgggcagatcacgagatcaggagttcgagaccagcctggccaacatgaaaccccgtctctactaaaaatataaaaattg

SEQ ID NO: 126050 - DNA, 601 bp, Human
tcacacctgtaatcccagcactttgggaagctgaggcaggcagattgcctgaggtcaggagctcgagaccagcctggccaacatggcgaaaccccgtctctactaaaaatacaaaagttagccgggcatcgtggcaggcgcctgtaatcccagctactcaggaggctgaggcaggagaattgcttgaacctgggaggcggaggttgcagtgagtggagatcatgccactgcacttcagcctgggtgacagagtgaggctccctctcaaaaaaaaaaagaaagaaagaaagaaagaaatgartggaaatgagacagtgggtggtgttttaggagggaagaaaactgagcatgtcttggaggctgagggaaggagccaggcagccaggcaggggatggaaggagagggattgcgcttctagggcaggactctggaggaggcagggtgagctgctcctatgcagaaggagacctggaggaggggcaaggacaggctggggtggggaggagggaccaacttgttccagtgtgaaaaccttggccaagggcatctgcacagagcaggcagggcaggtctgagcactgctctggagaacgtgacaca

SEQ ID NO: 126051 - DNA, 601 bp, Human
agcggggcgcccagagggcctcacctgagtgagcggtggctctccaccatgaggcggccaaaggctctgtagtcgccacgtctcagggcggccgctgcctgggccgtgcgccgaatctcccccaccacgtgccgggcccgccggaagccctctttgctcaccaggtccctggcagctggggaggaaagaggagtcagcagccgccttctcactgcctggggccccgacgcctgtgaggaccagcaggcggtgatggcagtggccctggctggacggtgaagggtggaaggccgcgggggcrgggcagcctggctctctcagacgtgggtctgaagagcccctttatcacagtgcctcctcccccgactgtaaaatgggacaccttggtccttcagggagcagtgagggttgaaacactccatgctttccaaggtgagtgctgccctcaagaggccaccacagagcaggaggagaagaagttctgctgagccacatggagcctccagggctggggctccagaagagggggcagaagcagccagggaccagcaggctgtcccatctgactggagctgaggctggaggggtacctgggtcagta

SEQ ID NO: 126052 - DNA, 601 bp, Human
tatctgctaaggaaaacagctgttgaactatcctggcttgaagaaaggagaattatctaactaaagctctgttttgcaagctcctctttattttttaacttgtgggagctcaagaattctatcctaaggaattctctcacttgcacactccacccactcccatgtctatgcgattcttctgcgggattttagattttaaaatacccgtaagcccatcctctacgctgctctcctgcacatgccaccatgcccagctaatttttgtatttttagtacagacagggttttgccatgttggccrggctggtctctaactcctgacctcacgtgatccacctgccttggcctcccaaagtgctgggattacgggtatgagccactgcgcccatcctctgcatatgattttgttcagaactcaggccatgttgggtctagaaaaggcaggtgcacttgttccaatacatacgaggtgcttcaagaacatgatgggaggcatcctgtgtcctggggactacaggtgaatgagggaaaacaagtgtgtgtttctcaggtgggggaagtgaaggacaatgataaaggcaaagaaggaggcctgtcaagg

SEQ ID NO: 126053 - DNA, 601 bp, Human
tctgaataggattttagagctgggtgagaccttaggattaaattagtccaacactttgggcggccgaagagggtggatcacgaggtcaggagatcacgaccatcctggctaacacagtgaaaccccgtctctactaaaaaaatacaaaaaaattagctgggcatggtggcgggcgcctgtagtcccagctactcaggaggctgaggcaggagaatggcgtgaacccaggagatggagcttgcagtgagcggagatcgagccactgcgctccaggctgggcgactgagcgagactctgtctaaaaaaaaaaaaaaaaaaaattagtccaactgctcgttgtaaggatgagggaaccaagctggcttggaaagttccccaggtggtgcgtggtagagctgactctggagcccgagtctcctgaccctgggtccagtcctcctccctctttgtcctgttgctttcttcccctttaactgtagaaaaaatacacataacaaaaaatttatcatcttaaacagtttttagtgtacagatcagtggcaccatcaccattatccatctttaggagtttttcatcctcacaaactgaaactctgaaccc

SEQ ID NO: 126054 - DNA, 601 bp, Human
tagttagaaatattttctcctgttctctaagttgcatattcattctgttcatagtgtcatttgttacacaaaaggttttaattttgatcaagtccagtttatctatttttttcttttgttgcctgtgcttttagtgttaagaaatcattgcccaatccaatgtcatgaaggttttcccctttgttttcttctaagaattttatagttttagctcttttgctttttgatccattttgagttaatttttgtatatggtgttaggtaagggtcctgcttcattcttttgcatgtggatatccaktttctccagtactatttgctgaaaagactgtcctttccccattgaatggtcttgacatgtcctactccttcttgatggatgaagttttaggcctagtgttggtgatcttaaaaagtttcttggcttcgttcttctgaactaggacaaccctcagcttgattgggaactagtgttttggcctctctcttcagctgcttcatctgttcctccaataaaaacttccttggctttgttcttctgaactaagacaacctttggcttgattgggaactagtgttttggcctctctcttcagctgct

SEQ ID NO: 126055 - DNA, 601 bp, Human
gatatccattttctccagtactatttgctgaaaagactgtcctttccccattgaatggtcttgacatgtcctactccttcttgatggatgaagttttaggcctagtgttggtgatcttaaaaagtttcttggcttcgttcttctgaactaggacaaccctcagcttgattgggaactagtgttttggcctctctcttcagctgcttcatctgttcctccaataaaaacttccttggctttgttcttctgaactaagacaacctttggcttgattgggaactagtgttttggcctctctctycagctgcttcttctgttcctccaaaggcactgcttgctccttccaccagctggcttcagagtctccagatttcataaactcatttgacttaagaaggactgtacccaggaatatgtacatttagaaaaagaaccggagaagtgagattcttagcacagtggaagtactggtgaatggaaaaatttcagaccacgtcatccccagtcctaggctgggtgtgtgtgtggcagggtatgtggggggtgggaggagatatgaggtagagggtgccctctgtgtgtgtgtgtgtgtgtgcatgtg

SEQ ID NO: 126056 - DNA, 601 bp, Human
tggctttgttcttctgaactaagacaacctttggcttgattgggaactagtgttttggcctctctcttcagctgcttcttctgttcctccaaaggcactgcttgctccttccaccagctggcttcagagtctccagatttcataaactcatttgacttaagaaggactgtacccaggaatatgtacatttagaaaaagaaccggagaagtgagattcttagcacagtggaagtactggtgaatggaaaaatttcagaccacgtcatccccagtcctaggctgggtgtgtgtgtggcagggkatgtggggggtgggaggagatatgaggtagagggtgccctctgtgtgtgtgtgtgtgtgtgcatgtgcgtgcatgtgtgaaattaagaatcttttcaaattaaacccagcttgacactaccatccatatgtctagccccaactataagcaatttagggacaggtttaatcctgtcaatgaaccttgcctaagaagcaggcaaaccatcttctattcttatgctaggaaaatgtggatgcctggttttacaatagctataaatgcatatttcttctttcttttccacagtaaaaattctaa

SEQ ID NO: 126057 - DNA, 601 bp, Human
ggaactagtgttttggcctctctcttcagctgcttcttctgttcctccaaaggcactgcttgctccttccaccagctggcttcagagtctccagatttcataaactcatttgacttaagaaggactgtacccaggaatatgtacatttagaaaaagaaccggagaagtgagattcttagcacagtggaagtactggtgaatggaaaaatttcagaccacgtcatccccagtcctaggctgggtgtgtgtgtggcagggtatgtggggggtgggaggagatatgaggtagagggtgccctcggtgtgtgtgtgtgtgtgtgcatgtgcgtgcatgtgtgaaattaagaatcttttcaaattaaacccagcttgacactaccatccatatgtctagccccaactataagcaatttagggacaggtttaatcctgtcaatgaaccttgcctaagaagcaggcaaaccatcttctattcttatgctaggaaaatgtggatgcctggttttacaatagctataaatgcatatttcttctttcttttccacagtaaaaattctaattttctctaaggagtactactaggaaaacttcatagcatagt

SEQ ID NO: 126058 - DNA, 601 bp, Human
ttcttctgttcctccaaaggcactgcttgctccttccaccagctggcttcagagtctccagatttcataaactcatttgacttaagaaggactgtacccaggaatatgtacatttagaaaaagaaccggagaagtgagattcttagcacagtggaagtactggtgaatggaaaaatttcagaccacgtcatccccagtcctaggctgggtgtgtgtgtggcagggtatgtggggggtgggaggagatatgaggtagagggtgccctctgtgtgtgtgtgtgtgtgtgcatgtgcgtgcatrtgtgaaattaagaatcttttcaaattaaacccagcttgacactaccatccatatgtctagccccaactataagcaatttagggacaggtttaatcctgtcaatgaaccttgcctaagaagcaggcaaaccatcttctattcttatgctaggaaaatgtggatgcctggttttacaatagctataaatgcatatttcttctttcttttccacagtaaaaattctaattttctctaaggagtactactaggaaaacttcatagcatagtaagaaaacatgaaacctgaagtcagaaagaaag

SEQ ID NO: 126059 - DNA, 601 bp, Human
ctttctatcactgcaaaaaaaaaaaaaaaaaaaaaaaaaaaaggaaagaaagaaaagaaaagaaggaaaagaaaaagaaaaaaaaaaaaaaagagaaagagtaggcagtcaaggttatgctgctgtaacaaatagctcctaaatctcagtggcttaaaataacaagggcttatttcttacacatgcaacaggtccattgtgggtttgcagacagttagggacttaggctgaaggagcagtcacagtcactatttcaaatgttattggttggttgctagagcaggaagcctgctttggaggrtctctcatggctgttacaactttcatgtagaagggccacacatataactcatgagctaggaagagtccccacagtggggacgaggacatgtgatacaccatgtgctcagaatagggagaactgggcctatttggtgagcagcactacgaatgactatcacgcctttgccatgggggtgccacactacatggggagtgcaagtggtgatcaaattgcccctcacccttctctttcttttgagttatttttatgaagtttcttgctcaaggggaattaccagatcaataatgtgaacagcct

SEQ ID NO: 126060 - DNA, 601 bp, Human
tttgtcctcagttgcctttattcaacatgtagtgacattacgcatttttcaaggtgagagttaacattctgtatttctttatgcacaaaatataatatttgttcatctattttccctttttaagctaaatataaacagatattggcttcatatatttaaattaattcttcttactttcaagtggtaagcttttatcacatttctttcaccttttttttacattttgttacttgtttggatatggatggtttagattttgctgtgcaagtaatttttacccctatatgtaaaactcgtcctyattgtctctgtcaaagtctcatgtgttttaggtagccagaaatttagctgagataattatatttttatatttttctacttaaaagagtagttttaattactgttttctgtcctccatccatttcccacaagtttccagcaaggttttcctcttccctttttccagctctaaggtcttgatagaattatggcagtgaaataatgattaggctagtaaaataataataataataataataataataatcatataataataaagcaaacttaccaagttaatttccccatgcagtattacaaa

SEQ ID NO: 126061 - DNA, 601 bp, Human
cagttgcctttattcaacatgtagtgacattacgcatttttcaaggtgagagttaacattctgtatttctttatgcacaaaatataatatttgttcatctattttccctttttaagctaaatataaacagatattggcttcatatatttaaattaattcttcttactttcaagtggtaagcttttatcacatttctttcaccttttttttacattttgttacttgtttggatatggatggtttagattttgctgtgcaagtaatttttacccctatatgtaaaactcgtccttattgtctmtgtcaaagtctcatgtgttttaggtagccagaaatttagctgagataattatatttttatatttttctacttaaaagagtagttttaattactgttttctgtcctccatccatttcccacaagtttccagcaaggttttcctcttccctttttccagctctaaggtcttgatagaattatggcagtgaaataatgattaggctagtaaaataataataataataataataataataatcatataataataaagcaaacttaccaagttaatttccccatgcagtattacaaaaatctttt

SEQ ID NO: 126062 - DNA, 601 bp, Human
tacattttgttacttgtttggatatggatggtttagattttgctgtgcaagtaatttttacccctatatgtaaaactcgtccttattgtctctgtcaaagtctcatgtgttttaggtagccagaaatttagctgagataattatatttttatatttttctacttaaaagagtagttttaattactgttttctgtcctccatccatttcccacaagtttccagcaaggttttcctcttccctttttccagctctaaggtcttgatagaattatggcagtgaaataatgattaggctagtaatataataataataataataataataataatcatataataataaagcaaacttaccaagttaatttccccatgcagtattacaaaaatcttttatgggtcttacactaagtttccagcagttttctaaaactagacttcagttggtaaatcattccccaaaggagcaaagggaatattcctttttacggaaacaatggctcttgggaaacaatctctgcatgtggatatggtttcctggatcatgaagttggagtatgcgggggctgggctcaaggagctccagaacctggaaggcataagc

SEQ ID NO: 126063 - DNA, 601 bp, Human
gtttagattttgctgtgcaagtaatttttacccctatatgtaaaactcgtccttattgtctctgtcaaagtctcatgtgttttaggtagccagaaatttagctgagataattatatttttatatttttctacttaaaagagtagttttaattactgttttctgtcctccatccatttcccacaagtttccagcaaggttttcctcttccctttttccagctctaaggtcttgatagaattatggcagtgaaataatgattaggctagtaaaataataataataataataataataataatmatataataataaagcaaacttaccaagttaatttccccatgcagtattacaaaaatcttttatgggtcttacactaagtttccagcagttttctaaaactagacttcagttggtaaatcattccccaaaggagcaaagggaatattcctttttacggaaacaatggctcttgggaaacaatctctgcatgtggatatggtttcctggatcatgaagttggagtatgcgggggctgggctcaaggagctccagaacctggaaggcataagcccttttgaagaggacttggggatttcttaa

SEQ ID NO: 126064 - DNA, 601 bp, Human
tttacttttattttgccttgccatttatcttttttttcccttttaaatcagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggtacggctttaaaaaatgccattttactaaaatgtgttttctttttttactagccataaaagaaagacwtaaaatatcgattttctgaagacagtgcacacacacacacgcacaaacacacacatggtttgcctttcatatctgtgagttccacatcctgggattcaaccaacctgggattgaaaatataaacaaataaacaaataaaataacagtacaatacaaataatacaaataagaaaccaacacagtgcatcatctactgtcacatgctgcatgacaaagtttcagtcaacagtaggctgcatgtacaatggtggtcttgtaagattataatggagctgagaaatttctattgcctagtgacat

SEQ ID NO: 126065 - DNA, 601 bp, Human
acagtattcaggacagtaacatgctgtacaggtttgtcgcctaggagcagcaggctgtatcatgtcacttaggtgtgtaggaggctctaccatctaggcctgtgcgagtactctctatgacgttcacacaacaaagaaatcacttaaactgtttctcagaattatcccattgttaagtgacacatgactgtatttacacagggcatttacattgtattagtaatctacaagtaatctagagatgatttaaagtatatgggaggatatccgtaggttatatgcaaagatgacacccctttawataaaccacttacgcatctgtgttttggcacctgtggggaatgtttgctgaaaccaatcccccaaagaaactgagggatgactgtattttaaagaatttaaaagggccgtaattaatatgttctattagtccttatgtgggttgagtaaaggtacttgaaatagtgatttgtgaagacagagtacataacagctgaaggaaataactttttactgtaatttgtctacaaaaatgtagaaaaaagcttacataacaattttatagacatattaaaggagtttttttaaaaagtacatgaca

SEQ ID NO: 126066 - DNA, 601 bp, Human
taggtgtgtaggaggctctaccatctaggcctgtgcgagtactctctatgacgttcacacaacaaagaaatcacttaaactgtttctcagaattatcccattgttaagtgacacatgactgtatttacacagggcatttacattgtattagtaatctacaagtaatctagagatgatttaaagtatatgggaggatatccgtaggttatatgcaaagatgacacccctttatataaaccacttacgcatctgtgttttggcacctgtggggaatgtttgctgaaaccaatcccccaaagaractgagggatgactgtattttaaagaatttaaaagggccgtaattaatatgttctattagtccttatgtgggttgagtaaaggtacttgaaatagtgatttgtgaagacagagtacataacagctgaaggaaataactttttactgtaatttgtctacaaaaatgtagaaaaaagcttacataacaattttatagacatattaaaggagtttttttaaaaagtacatgacagctgggcgtggtggctcacacctataatcccagcactctggcaggccaaggcaggtagatcacctgagg

SEQ ID NO: 126067 - DNA, 601 bp, Human
ggaggttgcagtgagccaagatcacgccattgcactccagcctgggaaacacagtgagactccatctcagaaaaaaaaaaaaaaaagcacatgatagcaaacttttgggttaagggagcaaatatgaacacaatttattcccttgtctggttgaatagatgttatttgatgtgctcattgctcctagtgagaacatcagatattgtcattagatattgcttatgtagaccggggttggaaaaccatggttgggccctggaatcaagttgtctcctggatttgaatggctcacaagccaacratagttgtcacttttttaaatgttggaaaaaaagtaaaagaaggatattttatgatgtgaaaatcacataaaattaaaatttcagggtcggtaaattaagtttcactggacacagccacatcctcttgttgtagtactgtctgtagccgctttcacatggcctagttgtgatggagaccctgcagactccaagatccaaaatacttcctatttggccctttcctgaaaacattggtcaactcctgatagagaccctagattgatactgaaaagtacagttattggcttaatcattaatga

SEQ ID NO: 126068 - DNA, 601 bp, Human
cctagattgatactgaaaagtacagttattggcttaatcattaatgagaattaaccctttaattgataataggttaagtagttggctggtttgtaactacagcatctctatataggatattgatttaatattagaaactttgaaatgattttctgaaagtagaggaaagtagccagctcctatgaataagctggctgagctctagaatgcattctctctctctctctctttttaatagagatagggtctcaccatgttggccaggctggcctcgaactcctgggttcaagtgatccttccrcctcagcttcccacagtgctgagattataggtgcaagcccccaagcccagcctagaatgcattctcttttggtttgggaaaagcataaagaggacaaatgaaagtttttacctggagaggaaagagcacaggctctggcgtcaatgggtctgggtttgaaactctgttccttctctgatctgttgtgcagccgtggccgagtgactccacctctcgaacctgtttcctctgtaaagtggcaattaataactttcaccacctgggattgtttcaaagattaaatggaatcatgtgtatgaa

SEQ ID NO: 126069 - DNA, 601 bp, Human
cttaatcattaatgagaattaaccctttaattgataataggttaagtagttggctggtttgtaactacagcatctctatataggatattgatttaatattagaaactttgaaatgattttctgaaagtagaggaaagtagccagctcctatgaataagctggctgagctctagaatgcattctctctctctctctctttttaatagagatagggtctcaccatgttggccaggctggcctcgaactcctgggttcaagtgatccttccacctcagcttcccacagtgctgagattataggygcaagcccccaagcccagcctagaatgcattctcttttggtttgggaaaagcataaagaggacaaatgaaagtttttacctggagaggaaagagcacaggctctggcgtcaatgggtctgggtttgaaactctgttccttctctgatctgttgtgcagccgtggccgagtgactccacctctcgaacctgtttcctctgtaaagtggcaattaataactttcaccacctgggattgtttcaaagattaaatggaatcatgtgtatgaagcacccggtgcagtgcttgacatataaatggt

SEQ ID NO: 126070 - DNA, 601 bp, Human
ccccaagcccagcctagaatgcattctcttttggtttgggaaaagcataaagaggacaaatgaaagtttttacctggagaggaaagagcacaggctctggcgtcaatgggtctgggtttgaaactctgttccttctctgatctgttgtgcagccgtggccgagtgactccacctctcgaacctgtttcctctgtaaagtggcaattaataactttcaccacctgggattgtttcaaagattaaatggaatcatgtgtatgaagcacccggtgcagtgcttgacatataaatggtgctcaayaaatgtgcatggacaaagatgtcatggtgatgcttagtaatatttattcccttcataataatgatacctattactgcgcatgtactatatccaagcctgttctaaactccctgacatgcaacccgatgaagtaggaactgtaaatatcccccctttttacagttaaggacccataaggatgttcccaagatcacacagccagtagatggtgaagtcaaaactcaaacccaggaggccagttcccatacaccactggaatgactgtggtgctgggctctatttggcatttttcatatttga

SEQ ID NO: 126071 - DNA, 601 bp, Human
agtttttacctggagaggaaagagcacaggctctggcgtcaatgggtctgggtttgaaactctgttccttctctgatctgttgtgcagccgtggccgagtgactccacctctcgaacctgtttcctctgtaaagtggcaattaataactttcaccacctgggattgtttcaaagattaaatggaatcatgtgtatgaagcacccggtgcagtgcttgacatataaatggtgctcaataaatgtgcatggacaaagatgtcatggtgatgcttagtaatatttattcccttcataataatgmtacctattactgcgcatgtactatatccaagcctgttctaaactccctgacatgcaacccgatgaagtaggaactgtaaatatcccccctttttacagttaaggacccataaggatgttcccaagatcacacagccagtagatggtgaagtcaaaactcaaacccaggaggccagttcccatacaccactggaatgactgtggtgctgggctctatttggcatttttcatatttgactactcatgcttagaacaatgaaatatctcctttcaattaaatatgttctaaagtggtacttca

SEQ ID NO: 126072 - DNA, 601 bp, Human
tctttctcagaaaaaaaagaagagaccattcctgtgatcatttcccccctcaagaccatatcagcttctctgggtaaggcccacaaggaccatgcattccacgcacctgtgggggtgcctggtatcccaatgcagggggcttgggacccttgcgtctgctgatcatacctgctccttgggtgcaatgtgcctgggtggagaccttagaactccagtgtgtgaggctggaataacaagtgtgaggaaatatttccctttggccagtttggttagaaatggcataatctgaaaacaggtataytttgcttcatgcaaagcctacctataaaaatctgaatgtgaaaatctgaacgttctggcagcagttatcaactgcatgagaagatgaacagcatgaaccccaggcagagccagcaccctcagtgtatttaaaataattcacatcaccaaaacttggctggcgctctgcctctctctaagactccatttgtaaagtgggctcagctgtggtcagtttcttgttgccagaagagctggtaagctggttgaatggtgccatgaaaatgaccaatggggctttctgcttttcactccatgtggt

SEQ ID NO: 126073 - DNA, 601 bp, Human
cacgaggaaaaaacaagtgagaaggttttcttcttcttttccttctactcttctttgtgaatgaaaaaaaaaataatttcctatgattgaggcagggggacccagtacatcacactgcacaactgcagagggcaccatctatagaaaacacagagtttttggctgggcgtggtggctcatggctgtaatcccagcactttgggaggccgaggcaggtggatcacgaggttaggagatcgagaccatcctggctaacacggtgaaaccccatctctactaaaaaatacaaaaaaaattagcygggcgtggtggcgggtgcccgggtcccagctcctcggggcgccgaggcaggagaatggcgtgaaccggggaggcggagcttgcagtgagccgagatcgccccaccgcactccagcctgggcgacagagcgagactccatctcaaaaacaaaacaaaacaaaacaaaaaaaacacgagtttttaaagaagggttgatccccagtcagagtcatctgggaatggagagttcccaggagaaacattagagccaagaccagcctcaggcaaagagaaagaatccacacattgatctggattttc

SEQ ID NO: 126074 - DNA, 601 bp, Human
actgcagagggcaccatctatagaaaacacagagtttttggctgggcgtggtggctcatggctgtaatcccagcactttgggaggccgaggcaggtggatcacgaggttaggagatcgagaccatcctggctaacacggtgaaaccccatctctactaaaaaatacaaaaaaaattagccgggcgtggtggcgggtgcccgggtcccagctcctcggggcgccgaggcaggagaatggcgtgaaccggggaggcggagcttgcagtgagccgagatcgccccaccgcactccagcctgggygacagagcgagactccatctcaaaaacaaaacaaaacaaaacaaaaaaaacacgagtttttaaagaagggttgatccccagtcagagtcatctgggaatggagagttcccaggagaaacattagagccaagaccagcctcaggcaaagagaaagaatccacacattgatctggattttctgaggtaactgaagtgaggggcagaggaagtcggcttgaatttagcatgtcccgtgggagcgcaggggccctggtgaagccatttaacttcaggtgcctcttggtttttgcctgccatgaa

SEQ ID NO: 126075 - DNA, 601 bp, Human
gggcaccatctatagaaaacacagagtttttggctgggcgtggtggctcatggctgtaatcccagcactttgggaggccgaggcaggtggatcacgaggttaggagatcgagaccatcctggctaacacggtgaaaccccatctctactaaaaaatacaaaaaaaattagccgggcgtggtggcgggtgcccgggtcccagctcctcggggcgccgaggcaggagaatggcgtgaaccggggaggcggagcttgcagtgagccgagatcgccccaccgcactccagcctgggcgacagagmgagactccatctcaaaaacaaaacaaaacaaaacaaaaaaaacacgagtttttaaagaagggttgatccccagtcagagtcatctgggaatggagagttcccaggagaaacattagagccaagaccagcctcaggcaaagagaaagaatccacacattgatctggattttctgaggtaactgaagtgaggggcagaggaagtcggcttgaatttagcatgtcccgtgggagcgcaggggccctggtgaagccatttaacttcaggtgcctcttggtttttgcctgccatgaagaccagtt

SEQ ID NO: 126076 - DNA, 601 bp, Human
cacagagtttttggctgggcgtggtggctcatggctgtaatcccagcactttgggaggccgaggcaggtggatcacgaggttaggagatcgagaccatcctggctaacacggtgaaaccccatctctactaaaaaatacaaaaaaaattagccgggcgtggtggcgggtgcccgggtcccagctcctcggggcgccgaggcaggagaatggcgtgaaccggggaggcggagcttgcagtgagccgagatcgccccaccgcactccagcctgggcgacagagcgagactccatctcaaaaamaaaacaaaacaaaacaaaaaaaacacgagtttttaaagaagggttgatccccagtcagagtcatctgggaatggagagttcccaggagaaacattagagccaagaccagcctcaggcaaagagaaagaatccacacattgatctggattttctgaggtaactgaagtgaggggcagaggaagtcggcttgaatttagcatgtcccgtgggagcgcaggggccctggtgaagccatttaacttcaggtgcctcttggtttttgcctgccatgaagaccagttgtaggaaccagaggtactt

SEQ ID NO: 126077 - DNA, 601 bp, Human
agtttttggctgggcgtggtggctcatggctgtaatcccagcactttgggaggccgaggcaggtggatcacgaggttaggagatcgagaccatcctggctaacacggtgaaaccccatctctactaaaaaatacaaaaaaaattagccgggcgtggtggcgggtgcccgggtcccagctcctcggggcgccgaggcaggagaatggcgtgaaccggggaggcggagcttgcagtgagccgagatcgccccaccgcactccagcctgggcgacagagcgagactccatctcaaaaacaaaamaaaacaaaacaaaaaaaacacgagtttttaaagaagggttgatccccagtcagagtcatctgggaatggagagttcccaggagaaacattagagccaagaccagcctcaggcaaagagaaagaatccacacattgatctggattttctgaggtaactgaagtgaggggcagaggaagtcggcttgaatttagcatgtcccgtgggagcgcaggggccctggtgaagccatttaacttcaggtgcctcttggtttttgcctgccatgaagaccagttgtaggaaccagaggtacttcgtaa

SEQ ID NO: 126078 - DNA, 601 bp, Human
tcagagtcatctgggaatggagagttcccaggagaaacattagagccaagaccagcctcaggcaaagagaaagaatccacacattgatctggattttctgaggtaactgaagtgaggggcagaggaagtcggcttgaatttagcatgtcccgtgggagcgcaggggccctggtgaagccatttaacttcaggtgcctcttggtttttgcctgccatgaagaccagttgtaggaaccagaggtacttcgtaaacagtaaagctctgtgtgaacagaatcatttgagaaaactaaattttctrccaaggaaagaattgggtggtgaggggtgtttgagaagccgaggagggactcagggctcaggtttgctggtgggtgggaggtgctggttctgcagttgacgtgctgtgccttgccatccacagggtcaagactgacaatcccgtgtaaggtgtttctgggaaccggcacacccttaaccaccatgctgtggtggacggccaatgacacccacatagagagcgcctacccgggaggccgcgtgaccgaggggccacgccagtaagtgggccagggtcttctgttgagaactctgtgggttt

SEQ ID NO: 126079 - DNA, 601 bp, Human
gtgcttgcaagttctcattgcaaaagacctggccacaactaaatgcccatctcagcttactcatatgatccacttacttaaaggaacctatattccccctacaaatagaacaaaaatattcctagtggatccactcatctgtgtttttattcacactaacagttagtagtgaggtgtctacagattcctctaacactataaatggcagctatcctggccacagccattcccctgggctgtctgcaggtttccagagtgagagtcagcagtagagatgagaagagacggcaccactgagggytggagtcctggaaactccctgcccttcaatatacaagtgatttaatggtgagggactcaagtttcctcaaactagacgtttctgttcccatgactgtttttttttgttgttgttgttcattaagagacttaaaagatgaacttccccattatctaaccctgtagtgtaacaactgtttgatgccagtgaccgccaacttcagtgacactaaggccttcagggacaggcttagaaactgtcccaaatgaatcacaagtatggtggcaagagctcctaactttatgaaacttgaaaacaata

SEQ ID NO: 126080 - DNA, 601 bp, Human
atatacaagtgatttaatggtgagggactcaagtttcctcaaactagacgtttctgttcccatgactgtttttttttgttgttgttgttcattaagagacttaaaagatgaacttccccattatctaaccctgtagtgtaacaactgtttgatgccagtgaccgccaacttcagtgacactaaggccttcagggacaggcttagaaactgtcccaaatgaatcacaagtatggtggcaagagctcctaactttatgaaacttgaaaacaataaaagcgcaatgggtacttctaaaggagartgtttagatgtctacattgtgaaagacaagcttgcattcgatacaatcataattaagtgaatgtttttttaactcagggaatattcagaaaataatgagaactacattgaagtgccattgatttttgatcctgtcacaagagaggatttgcacatggattttaaatgtgttgtccataataccctgagttttcagacactacgcaccacagtcaaggaaggtatgtatgtattttggggagcactataggagaatataacatgttgaatgttccatggatactagacaaatctacttgtt

SEQ ID NO: 126081 - DNA, 601 bp, Human
actcagggaatattcagaaaataatgagaactacattgaagtgccattgatttttgatcctgtcacaagagaggatttgcacatggattttaaatgtgttgtccataataccctgagttttcagacactacgcaccacagtcaaggaaggtatgtatgtattttggggagcactataggagaatataacatgttgaatgttccatggatactagacaaatctacttgttctccaaatgattccatagaaattcccttgcattgtctgctagtggagagctgaaaagaaacctcccattttwaaagagttttggtagggtggaggctggactttgggagattatactcaaatgaaaaatttaaatagcaagctgatttttggaaaatggatgaaatggttctacagtaaacttcgaaatactctgtctgcatgtggctctgccttgggtcactaatcagctgtcttcgcatggcctctagaagagggtggattgttctttatcctgaagatgagaaacttcatcctctaagagctggggattgggagctacccagggttcagggcagctttagggtcaaagtcattatatgaccggaaatag

SEQ ID NO: 126082 - DNA, 601 bp, Human
agaggaaaacccacattatcatttttgattaaattgatttcatatcaatgtttaattgttgagcaggagggagagctgccttgaatgtagtctctgttgacagcctgtagctaatggcaggcaagccaaagtgattcccagcatctcagtgatggctcgtggacaatcttacagcaataacataaatacaaattgctccaggtctccatgttttgctggggaggcagccacaaacacagtgtaaactggaaagccaatgatgtgttccagcctcaggacagggaatggcacccaactttcytccaactgtgcgctgtgcaccaccagcctcacactcacctgagccactggtcacaaacacagatctcaggacttactccagatccaccctgtcaaatattcctagggagaggctgcagcctgtgacacaaaaagctcctttcacagtgaagtttgagaatgagggcacacatgtgaagggtggcgtttcagatcatttccagatgagcaggctgggagagatggtggttgtacacatttacccacaaaaatcagaatgttccctctcggggtcagattagtgagcccaaggaacctgtgg

SEQ ID NO: 126083 - DNA, 601 bp, Human
gccatgctagattgcaggtgtgaaacctcatggaaaagcagtttcagtggtaaaaatgtggagcttggattgggaggacctcgggccccatcagagtcccacttctccactgagctgaaactggcaacaaatgactgaccctcactgaaggtccatttcctttatgtaaaatgggaaataaataatttgctggggtctatgaggggaaaaaatgagatgaggattttgtaattcacgtgctttaggggagtacaatattattattattaaggaagagctctggagttattaaaactagccttttttttttttttgagacagagtttcgctcttgttgcccaggctggagtgcaatggcgctatctaggctcactgcaacctccacctcctgggttcaagcgattctcttgcctcggcctcccgagtcactgggattacaggcgcccgccatcacacccagctaatttttgttgtttttagtagagacggggtttccccatgttggccaggctgctctcgaactcctgacctcagatgatccacccgcctcagcttcccaaagtgctgggattacaggcgtgagccactgtgtccagcccaa

SEQ ID NO: 126084 - DNA, 601 bp, Human
aataatttgctggggtctatgaggggaaaaaatgagatgaggattttgtaattcacgtgctttaggggagtacaatattattattattaaggaagagctctggagttattaaaactagccttttttttttttttgagacagagtttcgctcttgttgcccaggctggagtgcaatggcgctatctaggctcactgcaacctccacctcctgggttcaagcgattctcttgcctcggcctcccgagtcactgggattacaggcgcccgccatcacacccagctaatttttgttgtttttagtagagacggggtttccccatgttggccaggctgctctcgaactcctgacctcagatgatccacccgcctcagcttcccaaagtgctgggattacaggcgtgagccactgtgtccagcccaaactggccactttaataataaaactgccttgggtctgaaatgtgacagattttatcttgggaacaccgaaggggaaacttctacacggagcttgagatgggctggattgtccccaccgtccttggcagatcttaaagctctgtgactcctgaggggagtctcttttgtgctagagagccat

SEQ ID NO: 126085 - DNA, 601 bp, Human
gcatatacttaagaaaagagatgatgtgagcaccagtcaacagtatcaatctttgtttcagacaatcagggtttaaaaaatcctgagtgctggactttctagggggagtgaggaagacttaccctaggttttctgctacaggaagagacttcttgtcctttagcccagtggttctcaaagggagaggagaagaggattcccccacccctctcccaggggaaaaatggaaacatttttggttaccacaactgaggggaggatgttagtgggtggagcccacaacaaagaattattcgcccaraatggcagcagggccacgggtgagaaaccctgctgtagtctaatgattctgtagcagaattcacaagtggcagccacaatgctgtgggtttattcagcagaacttttccctgcagggtttctctgcccagtgagctccctgagcgtcacagcttgagtgagggaagctgcttttccctgccagagcccacacagcgaaggaggaggagttgtgccagcccaggaagcggttctagtgtggttttgccatcagccccagccaatcccagggttcaggcctgagggaagcctccagctcact

SEQ ID NO: 126086 - DNA, 601 bp, Human
ttcgctgggcagctgcctggcacaggggttctttctctcctgtcccccacactcctcgatcccctcccatcctcagggctgctactcccagcttccatggctggtcaaagcttggggcttgagtcttttggaattatctaattcactctgttcttcctttcatggacttcaggatgaccacaaactcagcaatagggaattggaagagaaatatggcacagacatcattatggtgagtcgtgggaaccagggatttggaagagaagcctcccaactctacagagggaaggctgtgtgtggyggggggctgtgtggaagagtagcggcacctttaggaggaggggcccctgcagcgcctttgagactgcagttatttgcatctggacacagttcaagtcaacagaaaaacctactgtggggctcacactggcctggcagtgagagggaccaagagggacagatgacccctggcctcaaggagaaagtggccgggtaggggaggcaaatgtgtatggaagtgtcctgagattcactctatccccctgggatggctacaagaagtagaaacgctatgctgggacaaaggtggattctgatggaa

SEQ ID NO: 126087 - DNA, 601 bp, Human
atcattatggtgagtcgtgggaaccagggatttggaagagaagcctcccaactctacagagggaaggctgtgtgtggcggggggctgtgtggaagagtagcggcacctttaggaggaggggcccctgcagcgcctttgagactgcagttatttgcatctggacacagttcaagtcaacagaaaaacctactgtggggctcacactggcctggcagtgagagggaccaagagggacagatgacccctggcctcaaggagaaagtggccgggtaggggaggcaaatgtgtatggaagtgtccygagattcactctatccccctgggatggctacaagaagtagaaacgctatgctgggacaaaggtggattctgatggaaggggccagagccagctctcgggctgctgccatgtttgcgctgggactcaaaatgcttcggatttaagctggtgggggaccccagggccagtaagcacagagcctgcttggagagaatctgggcttgccggaagctagtatgtgtggagaggggacaggtgcagcaggaatgaagccaggaaggtcatctgggtgaagctgtcaaagtattcacattaaactaa

SEQ ID NO: 126088 - DNA, 601 bp, Human
gagactgaggtgggcagatcacctgaggtcgggagtttgagaccagcctgaccaacatagtgaaaccccgtttctactaaaaatacaaacaattggcagggcgtggtggcacatgcctgtaatctcagctactcaggaggctgaggcaggagaatctctgaaacccaggaggcagaggttgcggtgagccaagatcatgccattgcactccagcctgggcaacaagagcaaaactccatctcaaaaaaaaaaaaaaaaagggccgggcgtggtggctcacgcctgtaatcccagcactttrggaggccaagacgggcggatcacgaggtcaggagatcgagaccatcctggctaacacggtgaaaccccgtctctactaaaaatacaaaaattagtcgggcacggtggcgggcgcctgtagtcccagctactcgggaggctgaggcaggagaatggcgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcag

SEQ ID NO: 126089 - DNA, 601 bp, Human
atctctgaaacccaggaggcagaggttgcggtgagccaagatcatgccattgcactccagcctgggcaacaagagcaaaactccatctcaaaaaaaaaaaaaaaaagggccgggcgtggtggctcacgcctgtaatcccagcactttaggaggccaagacgggcggatcacgaggtcaggagatcgagaccatcctggctaacacggtgaaaccccgtctctactaaaaatacaaaaattagtcgggcacggtggcgggcgcctgtagtcccagctactcgggaggctgaggcaggagaawggcgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcagagagacacaaccagcaggacttgaggggatttttattgagcccctcatctcgctagtcatgtcacagcagcaggaggaggagagccggtcgggtgatgggctggggtgggggcagggaggtgagagcagggaaggcaggagggtggaggcgat

SEQ ID NO: 126090 - DNA, 601 bp, Human
tctgaaacccaggaggcagaggttgcggtgagccaagatcatgccattgcactccagcctgggcaacaagagcaaaactccatctcaaaaaaaaaaaaaaaaagggccgggcgtggtggctcacgcctgtaatcccagcactttaggaggccaagacgggcggatcacgaggtcaggagatcgagaccatcctggctaacacggtgaaaccccgtctctactaaaaatacaaaaattagtcgggcacggtggcgggcgcctgtagtcccagctactcgggaggctgaggcaggagaatggsgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcagagagacacaaccagcaggacttgaggggatttttattgagcccctcatctcgctagtcatgtcacagcagcaggaggaggagagccggtcgggtgatgggctggggtgggggcagggaggtgagagcagggaaggcaggagggtggaggcgatgat

SEQ ID NO: 126091 - DNA, 601 bp, Human
aagacgggcggatcacgaggtcaggagatcgagaccatcctggctaacacggtgaaaccccgtctctactaaaaatacaaaaattagtcgggcacggtggcgggcgcctgtagtcccagctactcgggaggctgaggcaggagaatggcgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcagagagacamaaccagcaggacttgaggggatttttattgagcccctcatctcgctagtcatgtcacagcagcaggaggaggagagccggtcgggtgatgggctggggtgggggcagggaggtgagagcagggaaggcaggagggtggaggcgatgatgaacttattgtgagttataccaggagaagtctctccggaacacccctgaggaaatgttccacagttattcagaaagatgagtctggggttctggaaaaggaattggagtggagggagatgggatcgaggtggtgagcctgaatctagccatt

SEQ ID NO: 126092 - DNA, 601 bp, Human
gaggtcaggagatcgagaccatcctggctaacacggtgaaaccccgtctctactaaaaatacaaaaattagtcgggcacggtggcgggcgcctgtagtcccagctactcgggaggctgaggcaggagaatggcgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcagagagacacaaccagcaggacttgmggggatttttattgagcccctcatctcgctagtcatgtcacagcagcaggaggaggagagccggtcgggtgatgggctggggtgggggcagggaggtgagagcagggaaggcaggagggtggaggcgatgatgaacttattgtgagttataccaggagaagtctctccggaacacccctgaggaaatgttccacagttattcagaaagatgagtctggggttctggaaaaggaattggagtggagggagatgggatcgaggtggtgagcctgaatctagccattcaacagatatttgaat

SEQ ID NO: 126093 - DNA, 601 bp, Human
aaaatgaccaagactggcctgtcatggtggcttaggtctgtaatcatagcactttgggaggccaaggtgggcagatcacttgaggtcaggagttcgaaaccagcctggccaacgtggtgaaaccctgtctctactaaaaatattttaaaaattagccaagtgtggtggccgctgcctgtaatcccagctatttgggaggctgaggcaggagaatcgcttgaacccaggaggaggaggttgcagtgagacgagatcgcaccagtgcactccagcttgggcaacagagcgagactctgtctcaaaaaaaaaagaccaagacagagtcctgccctttaagtagcttacaacataattagggagaagaggtatctacagacttgtccaccaaagatcgtctgtgggggaaattcctgtgaacatgtagggtttcaaaggtgagggtgcctcacggatggcaggccccccagggcaggggctgctcacatgggctcagggcttgggtaggatttatgcctgtcaagatgaatgagaacttaggctggatgtgtagaaaggtggaaaaggagcaggcgtaaggatggaaactaaagccacatgctct

SEQ ID NO: 126094 - DNA, 601 bp, Human
gtgaacatgtagggtttcaaaggtgagggtgcctcacggatggcaggccccccagggcaggggctgctcacatgggctcagggcttgggtaggatttatgcctgtcaagatgaatgagaacttaggctggatgtgtagaaaggtggaaaaggagcaggcgtaaggatggaaactaaagccacatgctctctgtgcaggattccagaagcttccctatttcctggggagttactgcattgcccttagccctggtgagcagcttcttcattccaagtcctccttcatcaaattagtcctctcrccggataaacctctaagaaactaaaaccccttagcagagcagagtgcagtggctctggacccagtcaccacgttgaacctggtcgctaccattgacaggccaggtcccttcgacaggttacgtaatttctctgtgcctcaaattccacctctgcgaatgacgagagggaggaataatggcccctgcctcaagggttattttaaagactaaatgagtgaatatacagagcacagtgcctggctggtattaagcattacatagtctttcaaaaaagctgggcagctggagaagtgaggcacg

SEQ ID NO: 126095 - DNA, 601 bp, Human
aggcgtaaggatggaaactaaagccacatgctctctgtgcaggattccagaagcttccctatttcctggggagttactgcattgcccttagccctggtgagcagcttcttcattccaagtcctccttcatcaaattagtcctctcgccggataaacctctaagaaactaaaaccccttagcagagcagagtgcagtggctctggacccagtcaccacgttgaacctggtcgctaccattgacaggccaggtcccttcgacaggttacgtaatttctctgtgcctcaaattccacctctgcraatgacgagagggaggaataatggcccctgcctcaagggttattttaaagactaaatgagtgaatatacagagcacagtgcctggctggtattaagcattacatagtctttcaaaaaagctgggcagctggagaagtgaggcacggtctgcttttctcgggaccttctttggccacgttaatgcctcaccccaagctgcaaaaatatgcagcccaacccctgagggaggaggaatgtctaattcgtatttgttttggttgtgcatgtgctttgtttggctttcccagggtctctccagca

SEQ ID NO: 126096 - DNA, 601 bp, Human
cccttagcagagcagagtgcagtggctctggacccagtcaccacgttgaacctggtcgctaccattgacaggccaggtcccttcgacaggttacgtaatttctctgtgcctcaaattccacctctgcgaatgacgagagggaggaataatggcccctgcctcaagggttattttaaagactaaatgagtgaatatacagagcacagtgcctggctggtattaagcattacatagtctttcaaaaaagctgggcagctggagaagtgaggcacggtctgcttttctcgggaccttctttggscacgttaatgcctcaccccaagctgcaaaaatatgcagcccaacccctgagggaggaggaatgtctaattcgtatttgttttggttgtgcatgtgctttgtttggctttcccagggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaag

SEQ ID NO: 126097 - DNA, 601 bp, Human
gtctgcatccctgaacaacgtaaggctctggggtgtcccctcctggttttgctggcagagccatccagtgaggccttgggggcacagctgggggctgaatgccactgcctaggtgtgggaaagtcaggcattttcccagctgtaaaacagaaattctatctggctttctgatcttctagaggcagtgtgggcatgaagagggatacacaaaacaccttgaatttttaagggggagaaaatctgcatccatgtgaagtagtttggggttctgtctcccccaagctaacctcttcctttaacrcggagagcagctgtgcctgccgagacatgagtaccaaatccacaaaactgaattggccaacgtgatgccaagagacagaagccagaggcaacaagctacatgtcataggattggattgacatgaaatgtgcagaacaggcacatccttggaagcaggaaccagatcggtgatgccagggcatgggacaggagcagggagtgacggcagaggggccggagggatctccaggcaggatggagatgctctgaggctgcggtggagggtggtgtcatggctctgtaaacttaaaaaaaaaaatc

SEQ ID NO: 126098 - DNA, 601 bp, Human
ccaacgtgatgccaagagacagaagccagaggcaacaagctacatgtcataggattggattgacatgaaatgtgcagaacaggcacatccttggaagcaggaaccagatcggtgatgccagggcatgggacaggagcagggagtgacggcagaggggccggagggatctccaggcaggatggagatgctctgaggctgcggtggagggtggtgtcatggctctgtaaacttaaaaaaaaaaatcaataagttgcgcacttaacatgggcgaattccatggcctgtaaattataccagggcrtaactgccagcattgcatcctcccgtggagagctctagccccagggcccggctgcttcccactgctggtttctctgactgacgccctccttctcacccaggtgtacttgggctgtgtgcttggtctggtggtcattttaacggggatctttgcttattaccaagaggcaaaaagcaccaacatcatgtccagcttcaataagatgatccctcaggtgagtggcagccacctatcctctggcctctggtgactcccaggtgaggaagcctcagctgggaggggcacagggccctgagggct

SEQ ID NO: 126099 - DNA, 601 bp, Human
ctggtggtcattttaacggggatctttgcttattaccaagaggcaaaaagcaccaacatcatgtccagcttcaataagatgatccctcaggtgagtggcagccacctatcctctggcctctggtgactcccaggtgaggaagcctcagctgggaggggcacagggccctgagggctacgggtttccacttccttccctgtcggagcaatcgtgggcgaattaacccatctgtcagaaccccagttcctcacaggattttgatggtcaaatgaggcaccacccagggcagtgctggttagcscaaggcatcttctgttcctgctcctcagtgtttgtggatagtccttctgggttctggaagggacctgtggaaggtcagggagtgttctttcactggcagccaaggagaccagcctgcaattgtttatctgtgaccatttttgctcctgagccccagaatgcatttggtggggaagcccagtgctcccttcttccccaaaaacccctgtcaggtgtccacactgtctctggcccagagaactgtgggctggagagattctgggtggaaaagacgcctcctgccaagcttgaagcaggagat

SEQ ID NO: 126100 - DNA, 601 bp, Human
caatcgtgggcgaattaacccatctgtcagaaccccagttcctcacaggattttgatggtcaaatgaggcaccacccagggcagtgctggttagcccaaggcatcttctgttcctgctcctcagtgtttgtggatagtccttctgggttctggaagggacctgtggaaggtcagggagtgttctttcactggcagccaaggagaccagcctgcaattgtttatctgtgaccatttttgctcctgagccccagaatgcatttggtggggaagcccagtgctcccttcttccccaaaaacccstgtcaggtgtccacactgtctctggcccagagaactgtgggctggagagattctgggtggaaaagacgcctcctgccaagcttgaagcaggagatcacctcgttaaaatttccctgacactcgcaagattatcagcctccccagccccaccttcagtgttctgcccagacgcccagccaggattgctcacccttagtggtctccttttctaggaggcccagggctctggcttggccagatctggccaacagcgactcttctgttccaagaactctccataagctcaagaaaaagtagttc

SEQ ID NO: 126101 - DNA, 601 bp, Human
gtccttctgggttctggaagggacctgtggaaggtcagggagtgttctttcactggcagccaaggagaccagcctgcaattgtttatctgtgaccatttttgctcctgagccccagaatgcatttggtggggaagcccagtgctcccttcttccccaaaaacccctgtcaggtgtccacactgtctctggcccagagaactgtgggctggagagattctgggtggaaaagacgcctcctgccaagcttgaagcaggagatcacctcgttaaaatttccctgacactcgcaagattatcagyctccccagccccaccttcagtgttctgcccagacgcccagccaggattgctcacccttagtggtctccttttctaggaggcccagggctctggcttggccagatctggccaacagcgactcttctgttccaagaactctccataagctcaagaaaaagtagttcttagagtcttcaggcctcgggtgaagcagtcttctgtttcattcttgctgttctgacagcctcatgctccagcagcaatgctgtgtccacagggccaggtgcaggctgcataacagcatggactcaacagtgagag

SEQ ID NO: 126102 - DNA, 601 bp, Human
tgatcaggaagttccaaggcctctgtcctggggttcggtgcggcacagacttgggggagggccggtgtccttccagggtctgaggcatctgtcatggtttttttctgcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtaagcggcaaggggtatccaccccaaggaccatgttccaaacctgctggctctgkggtctttcccagcatcagtataagaggcagggaatgaggtacccagctgtgaaccaccttcaacatttcttctaggtggataactcatctctcacgggggagtctgagccccagccccgctcctctgagtttacccatgaaaaccccctggaaacaaagaacatctgcttctattccacaacgtgtctggaaggtaaaaggcctctggctctcagcccacatgtccacctgtgtcctttctccctcctgggctctcaggtctgtcctttgccacaccccgttacaaagctcatcccagag

SEQ ID NO: 126103 - DNA, 601 bp, Human
cttgggggagggccggtgtccttccagggtctgaggcatctgtcatggtttttttctgcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtaagcggcaaggggtatccaccccaaggaccatgttccaaacctgctggctctggggtctttcccagcatcagtataagaggcagggaatgaggtacccagctrtgaaccaccttcaacatttcttctaggtggataactcatctctcacgggggagtctgagccccagccccgctcctctgagtttacccatgaaaaccccctggaaacaaagaacatctgcttctattccacaacgtgtctggaaggtaaaaggcctctggctctcagcccacatgtccacctgtgtcctttctccctcctgggctctcaggtctgtcctttgccacaccccgttacaaagctcatcccagaggaagcatggaactgaagggcctagaggacgatgcttggccttgggaatg

SEQ ID NO: 126104 - DNA, 601 bp, Human
agggccggtgtccttccagggtctgaggcatctgtcatggtttttttctgcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtaagcggcaaggggtatccaccccaaggaccatgttccaaacctgctggctctggggtctttcccagcatcagtataagaggcagggaatgaggtacccagctgtgaaccaycttcaacatttcttctaggtggataactcatctctcacgggggagtctgagccccagccccgctcctctgagtttacccatgaaaaccccctggaaacaaagaacatctgcttctattccacaacgtgtctggaaggtaaaaggcctctggctctcagcccacatgtccacctgtgtcctttctccctcctgggctctcaggtctgtcctttgccacaccccgttacaaagctcatcccagaggaagcatggaactgaagggcctagaggacgatgcttggccttgggaatgtggtgtgc

SEQ ID NO: 126105 - DNA, 601 bp, Human
tctaggggtttaaaagaatctttaaaatatggagcttttaaaatgaaacaacataaaggctgctgaattccccaaagcaacaagtgtgtcctttgggacaactctttggcatgcactggtcagtctctcttacacactcctgcttagggatcacaggaggcgtcgtgattgtacgtgaacacgagccacagcagcgtgtccgtgtttgctgcccgtgggtcccttgttttcttcaagtcatgaaggaacaagaaaagcatctcatatttaatctttaaaaaaggattgtggcatagagggytcttggcggcgtataagccaccaggtcagcttagctgcgctgacaaccacacctctcccctaaaactagtccagctctctcctaaaattcaatcacagctcacattggctatttctgtattattggacctgagttcaaatgaggatttttcccaaagcgtccttccctctcctgctaggtgaccctgtcgctgacagcaaaacggatggccaagaagaactgcctggtgaagaacctggaggctgtggagaccctcggctccacctccatcatctgctcggacaagactgggacactgac

SEQ ID NO: 126106 - DNA, 601 bp, Human
caaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaagtaagtcttatggagagctcggtctggccaaagctgtggactccatcctggggctgagctgagcacacagcagggtctgcagccagaggattgctggacagtgactcatggacggccagcycaacccacagcagccactgttctttctctgtcttccagaccaagtctttgaccaaagctctaggacttgggcctccttatccaagataataacattgtgtaaccgagcagagttcaagccaggacaggaaaatgtccccatcatgaaggtaatgcttctgcagcacttggtcttaaatcacagccagtttgtagtcacttgctgaggtctgattgggtgcttgatttcatctctccagttgcttaaagtttgttcagtgcttgcaagagcaagtcagactcacaagacatccagaaattt

SEQ ID NO: 126107 - DNA, 601 bp, Human
tgtggagaccctcggctccacctccatcatctgctcggacaagactgggacactgacccagaacaggatgacagtggcccatctgtggttcgacaatcagatctttgtggctgacaccagtgaggaccattcaagtaagtcttatggagagctcggtctggccaaagctgtggactccatcctggggctgagctgagcacacagcagggtctgcagccagaggattgctggacagtgactcatggacggccagcccaacccacagcagccactgttctttctctgtcttccagaccaagtmtttgaccaaagctctaggacttgggcctccttatccaagataataacattgtgtaaccgagcagagttcaagccaggacaggaaaatgtccccatcatgaaggtaatgcttctgcagcacttggtcttaaatcacagccagtttgtagtcacttgctgaggtctgattgggtgcttgatttcatctctccagttgcttaaagtttgttcagtgcttgcaagagcaagtcagactcacaagacatccagaaatttttctttatgcacactagctttgagaatacaaagatgcttaaaaggt

SEQ ID NO: 126108 - DNA, 601 bp, Human
gcaattttctaattgtctatgatataaccattctatttgtcattggaacagaatatttggaagtcatctttgactttatcctttccttatatccagtaagccaccaagttctatcattcttgcttcaaaatatacataactttagtatttgtcagcagtaccttgcatctaaatagccgattaccggctgattggaattaaacctctttgattccggtttatccctcctggggtctttctcgaatgccactaatttcccttaatggtgcttttatagtcacttaactttgctcaaaatctytccgtacttccctgttttctgcttctcaagtctagacctcaggctacctttcagggccctccaggtcttgccacaccctccacatccgcttgtaccttgaacactcacggacgagcctgcccctcatgcccctgcacccgcatcctggtttctggaaggctttcttctctgtgtatcggtaacccacctatctatcaagatctagttcgtagctgcttttttccacgaaatcttcagtcctcgcagaggtccagcttctccaaacatccctaatgccagtaggtggcactgttgtttaca

SEQ ID NO: 126109 - DNA, 601 bp, Human
cagctaggtggtaatgggatcaggagggtgtgttttgggtcctatgctgagggcatgttggttcattaaatatgtgctgcaaatatttttcttctttgattcccagaaagctgtgattggagatgcctcagaaactgctcttttaaaattctcagaggtcattttgggtgatgtgatggaaattagaaaaagaaaccgcaaagtagctgaaatcccttttaactctactaataaatttcaggtgagtttttcctcacaaccggtaatctctgtcatcggcagcatgacctttctacttgcrtgcatcctttgcttacctcatattttgaaggatacctggcttcaaagacagtcgtcagggatacagcacccgggcatctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctcacacacacacacacacacactcacaccaccactatcaggtaccttctgccgtgaggagcagcagccatactccaaagc

SEQ ID NO: 126110 - DNA, 601 bp, Human
tcattttgggtgatgtgatggaaattagaaaaagaaaccgcaaagtagctgaaatcccttttaactctactaataaatttcaggtgagtttttcctcacaaccggtaatctctgtcatcggcagcatgacctttctacttgcatgcatcctttgcttacctcatattttgaaggatacctggcttcaaagacagtcgtcagggatacagcacccgggcatctggtcccctaggtcaagctcccttgctggcctccttcctaaccctgaagcagggcagagaaagaaagaaaggcaaggacytcatcagggcctggctgctcctatgaatgagccatctctgtcacaggcacacactctctctctcacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacgtggcctcgttccatgttcgcatcccgcctgtgaggtaggactgacgaatcctgactcagaggaggaagcaggcccttagaaa

SEQ ID NO: 126111 - DNA, 601 bp, Human
atgcatcctttgcttacctcatattttgaaggatacctggcttcaaagacagtcgtcagggatacagcacccgggcatctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctcacacacacacacacacacactcacaccaccactatcaggtaccttctgccgtgaggagcagcagccatactccaaagyataaatgccaggtgggcagcagggaggccgaacacctgctcctctcacctctagtgcatcaggccctcgacctacgtggcctcgttccatgttcgcatcccgcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtacggcacagttcaggccatgggagcaagccctgccctttggggagaccggtgagc

SEQ ID NO: 126112 - DNA, 601 bp, Human
atctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctcacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacrtggcctcgttccatgttcgcatcccgcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtacggcacagttcaggccatgggagcaagccctgccctttggggagaccggtgagcagcccctggggtgacagccccgtcgttttctggggccagcccctgtgctgtgggtgggggtctcctttccatcccc

SEQ ID NO: 126113 - DNA, 601 bp, Human
ttgctggcctccttcctaaccctgaagcagggcagagaaagaaagaaaggcaaggacttcatcagggcctggctgctcctatgaatgagccatctctgtcacaggcacacactctctctctcacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacgtggcctcgttccatgttcgcatccsgcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtacggcacagttcaggccatgggagcaagccctgccctttggggagaccggtgagcagcccctggggtgacagccccgtcgttttctggggccagcccctgtgctgtgggtgggggtctcctttccatcccctgctcaggtagaagacggccttcct

SEQ ID NO: 126114 - DNA, 601 bp, Human
tagtagagacagggtttcaccttgttggctgggctggcctcgaactcctgacctccggtgatctatccgccttggcctcccaaagtgctgggattacaggcgtgagccaccaagcccagcctagagaagaactcttgtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactrttttaggatgagtattattatactaataatactagtgataataggagctattctgtgctaatttccacaagtattaaattattcattcgcacgacaacactgtggggtggctagaggatgaggaggttgaggtgctgcgcatcagtgcacagtgtgaagatggggttagatgatgcctccatcagcagcaggacttggagccctgctgaagctccatctcccatggtaaaggcatgcccagttgcaaaagggagaaaaagcaggttccatgaggcctcatgtacaagttggaggagaaag

SEQ ID NO: 126115 - DNA, 601 bp, Human
gatctatccgccttggcctcccaaagtgctgggattacaggcgtgagccaccaagcccagcctagagaagaactcttgtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactattttaggatgagtattattatactaataatactagtgataataggagctattctgtgcgaatttccacaagtattaaattattcattcgcacgacaacactgtggggtggctagaggatgaggaggttgaggtgctgcgcatcagtgcacagtgtgaagatggggttagatgatgcctccatcagcagcaggacttggagccctgctgaagctccatctcccatggtaaaggcatgcccagttgcaaaagggagaaaaagcaggttccatgaggcctcatgtacaagttggaggagaaagtggctacacagagtgggactagaaaggggagaggggcctgtgtgagttcctgctgaaga

SEQ ID NO: 126116 - DNA, 601 bp, Human
gtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactattttaggatgagtattattatactaataatactagtgataataggagctattctgtgctaatttccacaagtattaaattattcattcgcacgacaacactgtggggtggctagaggatgaggaggttgaggtgcygcgcatcagtgcacagtgtgaagatggggttagatgatgcctccatcagcagcaggacttggagccctgctgaagctccatctcccatggtaaaggcatgcccagttgcaaaagggagaaaaagcaggttccatgaggcctcatgtacaagttggaggagaaagtggctacacagagtgggactagaaaggggagaggggcctgtgtgagttcctgctgaagaggtcggaggtgctgtctggatgctgttagggtcattttatatctacacatgagcggtgctcagcctcaccagggctt

SEQ ID NO: 126117 - DNA, 601 bp, Human
agtgcgcaacagtcctaaaagactattttaggatgagtattattatactaataatactagtgataataggagctattctgtgctaatttccacaagtattaaattattcattcgcacgacaacactgtggggtggctagaggatgaggaggttgaggtgctgcgcatcagtgcacagtgtgaagatggggttagatgatgcctccatcagcagcaggacttggagccctgctgaagctccatctcccatggtaaaggcatgcccagttgcaaaagggagaaaaagcaggttccatgaggcytcatgtacaagttggaggagaaagtggctacacagagtgggactagaaaggggagaggggcctgtgtgagttcctgctgaagaggtcggaggtgctgtctggatgctgttagggtcattttatatctacacatgagcggtgctcagcctcaccagggctttagatgtcatggccttggaaggagacgtctctgcgggaaggaaataaaatggaaagcctgtgtcttattgattagaatggtgatgccccaaacacactggtctgttaagacatttgaaacagtttacggcaaattggaaa

SEQ ID NO: 126118 - DNA, 601 bp, Human
ggaaaatgttttataaagttttatataaagatgaatgtatttaatttaaaagattatcctttgtagccaccatgattaagggcagggactctggagcctgctagcctgggctcaaatcccagctcagccaccagatagccacctattgctcagtgaccctgagtgaagcattgaacctctgtgcctcagtttcctcctttgtaaaagggaataataatagtacccatggccttaaagttgttttgagaataaataagtcgatgtggacagcacttagaacagtgcctggcacgtggtacayaccataaaagtgtttcatattatccctatgttttaaatgtaaaaagccttatcttggccaggtacagtggctcacacctgtaatcacagcactttgggagatcgaagaaggcagattgcttgagcccaggagttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgt

SEQ ID NO: 126119 - DNA, 601 bp, Human
cttatcttggccaggtacagtggctcacacctgtaatcacagcactttgggagatcgaagaaggcagattgcttgagcccaggagttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgtgccactgcactccagcctggggcacagagtgggaccccgtctcaaaaaaaaaaaaaaaaaaatttaagagagaaagagagaaagaaaaagaaaaggcctatattttagaaagtgatagagctgggaggttttctgtttggtttggtttttgttggttggttggttttctcaatgtctttacttgatcattaaaaaaagcagcagcagcagctggtaaccctatttgccctatacttctttttgtactcatctttgatacccagaagtctaagaaatactgatttgtaaagaactgttttacccaaaattgtagcacttttctttgcaacttattttctcccaaacact

SEQ ID NO: 126120 - DNA, 601 bp, Human
ttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgtgccactgcactccagcctggggcacagagtgggaccccgtctcaaaaaaaaaaaaaaaaaaatttaagagagaaagagagaaagaaaaagaaaaggcctatattttagaaagtgatagagctgggaggttttytgtttggtttggtttttgttggttggttggttttctcaatgtctttacttgatcattaaaaaaagcagcagcagcagctggtaaccctatttgccctatacttctttttgtactcatctttgatacccagaagtctaagaaatactgatttgtaaagaactgttttacccaaaattgtagcacttttctttgcaacttattttctcccaaacactccagcttcctgagattcctcttgagtgcttagaagagtacctggcttatcagaagggctagataagagttagtccttttattctt

SEQ ID NO: 126121 - DNA, 601 bp, Human
cacaccccgccattttctatgacatccaagcaggaaaactgggtggacaatgaggtgaggaggtgcagaaattcctgtcgcctcctcccctcctgagctcagaatagtttgggtctgaaagatggctgctccccacagggaggtagaggaggtgagatgcagaggctcgcagccccctaactctcacgggcaccctgggagatcttgttcaaggcacaagatttcacacgctgacggccacaactagcctgcctaaagcagccagttttgcttgaaagatgagctccacttatccagagtsggtgccccactctgggctggggccaagtctagagctcttcgtcttacttggccacagaaagaaaaagggcggaacatgctgaggatgccattgtgcctcttcctcctttacatttaatggaccagtagagaagaaggaatgcgtttcacctttctgtaagtaacacgctcagttcattccttcccagctctccatccacgagatggatgacccccacggcaagcgcttcctcatggtgatgaagggggcccctgagcgcatcctagagaaatgcagcaccatcatgatcaacggcgagga

SEQ ID NO: 126122 - DNA, 601 bp, Human
gatcacacaatcttggaggtcccaccagacacaagagtcccttccacctcagcctatgagaggctgatgccttctgagaaaaggatggctcggccccattcctgctggcctttctcttgggcttatcttgatctagcactgaactttgtgcccctccgctgaacccccttgttccttcacatgctgttttctctgctgaaaatggccttcccacctccaccctcccttttttccctagaaatcatctttgcccctctcaagcttcacctcacatgtgacctccttggggaagtctctcctratcctccaggcagctgaaatgtgtctctgccctgagatgtaccctatgcttgatccctttaactctgtgccccgctaaacttcagaagtcgagactgtgtattgccctagaacttggcaatatagcaagatatatttctagaacacagagcctaatgagctcacagtgaattatatttggatgaaatatgtctttcctaaaaaaatgcattatggagttgaagaaattaaacaattctggcttattctaatgtattggtaaaacagcagaggaccaaggtgtatgagcatgttctcctct

SEQ ID NO: 126123 - DNA, 601 bp, Human
caacctctgttttgtgggactcttgtcaatgatcgatccccctcggtccaccgtgccagatgcagtcaccaaatgccggagtgcagggatcaaggtgggagttattttcctgactcaagaagttctttctttatgtcgtgttcctttctaataatggttttcatagcagatggtcagtatttaggtgtcttcaagtaaatatcataattcctattttatttctagtttcactgtgctaaggttactgaaactgtcccacaaaaagaaaatgattgtgtctatgtggaatgaaccacataamcagtaaatgcaatgagaagaatctcctagtgccttgaagtgaccatatctcgccctagtccatggtagatactaaaaggctttattggctgggcgcagtggctcatgcctgaaatcccagcactttgggaagctgaggcaggcggatcatctgaggtcaggagttccagaccagccatggccaacatggtgaaaccccgtttctactaaaaatacaaaaaaattagccagatgtggtggcacacacctgtaatcccagctactcgggaggctgaggcaggagaatctcttgaatccagga

SEQ ID NO: 126124 - DNA, 601 bp, Human
gcacacacctgtaatcccagctactcgggaggctgaggcaggagaatctcttgaatccaggaggcagaggttgcagtgagccgagatcacaccattgcactccagcttgggcaacaagactgaaactctgtctcaaaaaaaaaaaaaagaaagaaagaaagaaaagaaaagaaaaaaagaaagaaaaaaggctttattactcagtcttgaggctcagcccccataatccatgttcatcattactaggttaatattaagactgttgaagtaacatggggctacccccaagtagacactcacyagccctttcacaaataaagtggcatcaaaggggaagggcttcctttcatgtcagaggaggaagcgtatgaagcttaggagcaagggtagacccaatgggattagtgtttcctccaaagacagttgtctcgtagatccagagctgccactgtaatcaccaaccacgttctcccagggcactacagagtaggtattactgaaccatccccactttggccaaccgagttcttcattacccgtgggccttctcgttgtctttgctctaggttattatggttactggtgatcatcccatcacagc

SEQ ID NO: 126125 - DNA, 601 bp, Human
aaaaaaagaaagaaaaaaggctttattactcagtcttgaggctcagcccccataatccatgttcatcattactaggttaatattaagactgttgaagtaacatggggctacccccaagtagacactcaccagccctttcacaaataaagtggcatcaaaggggaagggcttcctttcatgtcagaggaggaagcgtatgaagcttaggagcaagggtagacccaatgggattagtgtttcctccaaagacagttgtctcgtagatccagagctgccactgtaatcaccaaccacgttctcycagggcactacagagtaggtattactgaaccatccccactttggccaaccgagttcttcattacccgtgggccttctcgttgtctttgctctaggttattatggttactggtgatcatcccatcacagccaaagctattgccaagagtgtggggatcatttcagccaacagtgaaacagtggaagacattgcacatcgcctcaacattgctgtggagcaagttaacaaacggtaagcacaggagcagcatagtaaaaattccagtttatacccatggggccccactggctctaaagagct

SEQ ID NO: 126126 - DNA, 601 bp, Human
ctcagcctcctgaatagctgggattacaggcgcccgccaccatgcctggctaattttgtatttttagtagagacggggctttgccatgttggccaggctggtctcaaactcctgacctcaagtgatccacccaccttagcctcccaaagtgctgggcttacaggcgtgagccaccacacctggactaaaagaaatttttttaagagtagtcaagtgcagtagtgagaagaggggaaagagtagaagtttgatctgtaactgactgtgaacaatcagttgagctaattcactactaccttcrgaccagccgagtcttctttttttagatacaaggtgtcctgtcagatcacccaggctggagtgcaatggtgtgatcatagctcactgcagcctcgacctcctgggttcaagggatcctcccctctcagcctcccaagtagctgggactacaggcttgtgtcactgcacccagcttcattttagcagatttttttttttttgagatggagtctttctctgttgcctaggctggagtgtggagtgcagtggtgaaatctcattgcagcctccacctcctgggttcaagggatcctcccctctc

SEQ ID NO: 126127 - DNA, 601 bp, Human
actgctttgccaatttgctggcccgtatagtgtctttgtgcaacctcaacttcctcatcctttcagatgggcatggatggaactgtgcttgtagcagactccagaatgtgcttctgtctcagctctttggaacgagagaaagacataatcttcctacgaatgtgggaaggtgcattgaaatgacttttatgattcttgcctcagtcaaaagtcacaaagggactgcacttcctcttggtcactgccactctgctcatggccacaaaagggaagagtggattacacatttgtatacaaatcrccacactgagtgaagtggatgcttttgtgaatgttttcagttattcacttcatcagctctagtttcatgaccatataaaaattgcatcttagcaggtgtaaggggaaaggaaacaccccttctttcttctcttactttcttttgttttgttttgttttgtttttttgccagcggttaaggagacctgtagtttgagtcaagtgctagaattccagtatttagcaccaagaggtaaaacagacctagaaagctcaaaacttgcaaattgtaaagaaaaagacctgcagcagtttgtaccta

SEQ ID NO: 126128 - DNA, 601 bp, Human
tttgcccggacatccccccagcagaagctgatcattgtggagggctgtcagaggcaggtgggtggacagcagtgtccagaggactgacaggcccatcactgtccatgggcaagtgcagaggtctggatctcacatcaggctgtggtgcctttgaaacttcaagagagagttcttggctcatccccatcacctgacctctccaacctctcaggtgggctggcccctgtcctcctttgagacccccaccacatgttccccgaaaggctcaccccagctctctgcattttgtcatgagagcccrgtgaagcatttgccactgtggtagttgtgagtaaagagagatttaaaatgcaaagatttaaaacaaaaaatgtgaagacataagatacaagacacctgcgcattaggttttcctcatttgcacgtatcttgtttggagacccttgttcctgcttctaagatttctcatctttatcttttcccctaaatgggcctttccgttcagctataatcatcctcgcaacctcaagagaaagggaagtcttgttgctcttgccaggcctgcaacccactgggcctgctcactcccactttctccctg

SEQ ID NO: 126129 - DNA, 601 bp, Human
attgacttggggacagacattgtaagtgacactgaagggaacaggctgtgatgcctgccccaggggaggtcaagttcagggtcgctaccttcaagggccggggatggactaactcaaggcttctcagcttccatgtgatggggcctgtagctctgcatttctcacaggttctcaggtggtgcccattctaccagtccacatgccacacctcaaagcaagggaccagaggcatctgccaaatgtttggaaattaaaaacactctatagtgagcttttttttcttgagacagagtttcactcycatcacctaggctagagtgcagtggtgctatcttgcctcactgcaacctccgcctcccaggctcaagtgattcttccacctcagcctcccaagtagttgggactacaggcttgtgccaccacacctggctaatttttgtatttttagtagagatggggtttcctggcctcaagtgatccacctgcctcggcctcccaaagtgctgggattacaggcatgagtcactgcacctgagctatagcaagcttttcaagacatgagtcttcatcctcaaaaaaaaaaaagaaatgccattggtca

SEQ ID NO: 126130 - DNA, 601 bp, Human
gggaacttgttagacatgcacactctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagc

SEQ ID NO: 126131 - DNA, 601 bp, Human
acactctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcac

SEQ ID NO: 126132 - DNA, 601 bp, Human
actctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcacta

SEQ ID NO: 126133 - DNA, 601 bp, Human
ggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattctta

SEQ ID NO: 126134 - DNA, 601 bp, Human
atgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagraagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcct

SEQ ID NO: 126135 - DNA, 601 bp, Human
aggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagraagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggat

SEQ ID NO: 126136 - DNA, 601 bp, Human
ggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagraagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggatgggc

SEQ ID NO: 126137 - DNA, 601 bp, Human
agtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaagaargaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggatgggccagctccatgccccccac

SEQ ID NO: 126138 - DNA, 601 bp, Human
catagaacctccatgtccctgaacagcctgggaaagcttcaattaatagggctcagggcccccttgctgacacgtgtttggcctttgccaggtctcatggcacagcctcctgtcttgggctagatgacaagaggtccctttttttaccttagctttgccattggtatagaagagtgaccagcccagccacacccacagtgcggccaaataaatttacatctttcaggccgggtgcagtggctaatgcctataatcccagcactttgggaggctgaggagggagaatcacttgagcccaggrgtttgagaccagcctggccaacacagtgagaccctgcctgtgttagaaataatagtaatgataattttttaaaaaattaacatttttctctactcagctggttcaagaaagaaaaatgtttctttccaaacactagaaggtggtccattctcagtccgggtgaggtgtggaaagaacatgaagctttagagaactgcattggaatttcctagaagttttcctttaggcctcaaggtctcttccttctctgcccattaacagacaaggtaccagagggaatacctagaatggacgggctac

SEQ ID NO: 126139 - DNA, 601 bp, Human
acgtgtttggcctttgccaggtctcatggcacagcctcctgtcttgggctagatgacaagaggtccctttttttaccttagctttgccattggtatagaagagtgaccagcccagccacacccacagtgcggccaaataaatttacatctttcaggccgggtgcagtggctaatgcctataatcccagcactttgggaggctgaggagggagaatcacttgagcccaggagtttgagaccagcctggccaacacagtgagaccctgcctgtgttagaaataatagtaatgataattttttwaaaaattaacatttttctctactcagctggttcaagaaagaaaaatgtttctttccaaacactagaaggtggtccattctcagtccgggtgaggtgtggaaagaacatgaagctttagagaactgcattggaatttcctagaagttttcctttaggcctcaaggtctcttccttctctgcccattaacagacaaggtaccagagggaatacctagaatggacgggctacacggctttctttgttggcatcctagtccagcaaatagcagatctgatcatcaggaaaacccggaggaattc

SEQ ID NO: 126140 - DNA, 601 bp, Human
agagccagcctctgctttgagctgtcgcagcctaaataaacctgaggattcccagggttcttccccaagtctttcaaaagacgtcaaactgatcccatgctctgtgagcccaaagctttgatctgcattttccagaagtggaaatgggttttctagacctcaccaaccggccttcatcctcatccaacaggttgcttcaaaggcagacattgcttctagcagtcacagtgcaggttaaacaaggagctttccacctttattttgtgggacctcgtggatttgtcgttctttgcagtaaagmaagacaaatgaacgagaagccccattcccattgggcagggttgggctatccctgtggatgagtcagggttcactttccatccctttgcttccagggctcagtactggtttgtggctgtgccgcacgccatcctgatctgggtgtatgatgaggtgcggaagctcttcatcaggctctaccctggaagtgagtagcctatgattttagaggctctgtttacccacttcaacagactctccatttctgatgtacttttttctacctctacaggctggtgggataagaacatgtattattaag

SEQ ID NO: 126141 - DNA, 601 bp, Human
acaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacaggaggagcctcagagcagaaggactgagctcagatggctctaagcagagtggaccccaaagggacttgcacagcactctaagaatggtatccattggtgtccccaagcagcttatggtgacaggagtgaaacttcagccgccgaktgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcctggaggagcagctggggctgaaactgaggcttaagaagggagttcatggccaaggcagcctagatccatgtcctgagactggagcactcacctgaatggcagaagacagccaggacgagcagcagcccgaacaggacagaccctcc

SEQ ID NO: 126142 - DNA, 601 bp, Human
tggcccagtgacagatggcctggagcaggagggaagagcagggactctgttgccagactgtgtgttcacattcccgtgtaccacttctgtgtgttatttgacaagttattaattttggggaggcctcaatcttgttgcttgtaaaacaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacrggaggagcctcagagcagaaggactgagctcagatggctctaagcagagtggaccccaaagggacttgcacagcactctaagaatggtatccattggtgtccccaagcagcttatggtgacaggagtgaaacttcagccgccgattgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcct

SEQ ID NO: 126143 - DNA, 601 bp, Human
tacagtgcaccctggctagaatcacggaaggtggggaagaaggggtgccatgacttctctttctgctcagaaagggagaacatattaaagtgtgtcctggcgccaagttactactttgccttcatttcctcagctgtaatatgggaggtaacagtaccgacctcccggaatggctggacggatttaaatgagacaggctctggcacagtccccagtaaacaataaacagtgaatatatggttgctgttaatattctaagacatgctacagtggtgtggaaatctttttttaaattgctcaytgtattgccactttcttttctgctccccccaccaaccatatttataaaaaacaaaaaaccagcagtggccaagatattataccaacatgacacaggcagacaaccacacttgatctttacaatgaagcatgtgtgtttccactgttatagaagttgactcagaagcacacaatttcctccagcaaccaggggaggggtggctgaggagagggggtggcccagtgacagatggcctggagcaggagggaagagcagggactctgttgccagactgtgtgttcacattcccgtgtaccactt

SEQ ID NO: 126144 - DNA, 601 bp, Human
ctgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtggtggctagatcccgggctcatttggcctcttaagaaagctttagaaggaaaggctaaaacccatggttggaacgtctgtgggcaaaaatattsatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatccaagcttggttaaccatgatgttcttctaattgacctgagtgggaagagaaggaaactctagattatggtggaaactgaggtcaaaaacaagc

SEQ ID NO: 126145 - DNA, 601 bp, Human
aaggacacctggctacaaagcagcagagctggcggcagccctggggcctgtgggcagggccccatccaccaggctttgtttgttctcccccactgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtgstggctagatcccgggctcatttggcctcttaagaaagctttagaaggaaaggctaaaacccatggttggaacgtctgtgggcaaaaatattcatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatcc

SEQ ID NO: 126146 - DNA, 601 bp, Human
ttgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactayatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtctaagagtacaaataaccttgtggagtgtttttattattaatctcttagaaatctaagcctgaggg

SEQ ID NO: 126147 - DNA, 601 bp, Human
ttcataaatgaaaaacagaggtggagagagctagctggtggcaggacagaagtcagagctctaattgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtsccctacagaatcaagagctctgaatggaaggtttggagttttagctgcaatccagctaaactatatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtct

SEQ ID NO: 126148 - DNA, 601 bp, Human
accagaaaaacaaagttcccattgttccacatcctcaccagcatctggagttgtcagagttttggagtttggccattttaataggtgtgtctcatttttgtttacattaaccatttataagaaattttgggatttaagagctggaaaaagatcttggctttgacctcctttcctctcctccctacctctgctgtccaacacatacatttcataaatgaaaaacagaggtggagagagctagctggtggcaggacagaagtcagagctctaattgctgctgtaatattcattcaacacatastaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactatatcaaatttatcaaatccagctaaatata

SEQ ID NO: 126149 - DNA, 601 bp, Human
cactccagcctgggccacaagagcaaaactctgtctcaaaaaaacaaaacaaaacacaaatatacttctttggctcccgtgactctttaggtcacctgatcataaccagttttattatgttctatccacatatatgctatgggtaatgctattttggtcttgcttcttgggggaagttaaagaagaaaataatgcccatgtaagtattgataaagtgctacaatgtaacactagcctgaagtgcaatagatagtatgagaggctaactaatgattaccaagattcagaatactgaaaactyattctggagtgtaaaatggctttgaattcatagtttgataactttgagcttaaattattttcatataagcctgagtgaatttatgttcttggtatttgctaagccctacgaggtccaacatgatggacctgccatcaaatacagacaaatacaggatctgccaatattggtcattcatgcagtttattgttagaaatggttagaacatgggggatataaatttagacccaccaaggagtatattctgatactgcatttgcctttcactgtacctgattacccttcttgcaagtatatgct

SEQ ID NO: 126150 - DNA, 601 bp, Human
tttttccactagagttaaaaaaaaaagtcttttttttttttaatacttgagaatgtctgtcggtttactaaatctttcaagggaatgaaggaaatcctttaaaaagcaatctaaaatgctgaatattttatgatactggtttctagcattaggcctttgcacaaatactagcctttgtattaggaatgaacaaatctatgaataattgctaaatacagttagtagtttctaatttgtgtttatatataaatttcaggtaaataatttacccgacgttcagaagctatacaattgctatgcyaaattacaggctctgggtttagagtgaaaaataagaggctcttatttgtaaacaaagactagtgcaggcattttggttgatgttgcctcgataaaaaactaaaaatagattttatgtcatttagatccaagagttagaagagttagtaagtattcaggtatatcagtgaaaatatattgtagtccttaatcaggtactgttttaatatctagtgtaattttgcatgaaaatggcagataccactactctgtttaagtatttgtttgtactttatttgggaccctgccaattctggcctag

SEQ ID NO: 126151 - DNA, 601 bp, Human
tctatgaataattgctaaatacagttagtagtttctaatttgtgtttatatataaatttcaggtaaataatttacccgacgttcagaagctatacaattgctatgctaaattacaggctctgggtttagagtgaaaaataagaggctcttatttgtaaacaaagactagtgcaggcattttggttgatgttgcctcgataaaaaactaaaaatagattttatgtcatttagatccaagagttagaagagttagtaagtattcaggtatatcagtgaaaatatattgtagtccttaatcagrtactgttttaatatctagtgtaattttgcatgaaaatggcagataccactactctgtttaagtatttgtttgtactttatttgggaccctgccaattctggcctagtttatgactaggttacttataaatctgataaggcagtaagctaaagtgtcttatacttgatttttcaatttttgttaaaatattttttatttcataaatgaaagcaggaagtggaaactaaccaaattaaatatttttgagcaaagcacagtaggaatgcacatatcctgatttctgaggtaaacgatttgtgt

SEQ ID NO: 126152 - DNA, 601 bp, Human
cgcctggctaatttgttttgtatttttggtagagacgggatttcaccgtgttagccaggatggtctcgatctcctgaccttgtgatccacccgcctcagcttcccaaagtgctgggattacaggcgtgagccaccgctcccggccaaatgaaatggttttcagcgccatacctgtggctgcaaatgtgtagtactttactacataaaggactttacatagacacagatagtcgactacatatatcgggccttctattaaaaattctagcagagctcttaagtttttttgttttgtttttgkttttaaaaacagctttattgagatataatctacataccttgaaattcattcatttaagtgtacaatttaatggcttttagtatatttatagttgtgccatcatcagcacaatcaattaaaattttaagtttaaaatttttttggccaaattatttctcacctgacacaatttttgaatatttacattaccctcaaaagaagcccgtgtgccttttagccattgttccccagtctgcccatcacccccagccctaagcaaccactaatctacttgctgcctgtgtagatcatctattctgg

SEQ ID NO: 126153 - DNA, 601 bp, Human
tggtctcgatctcctgaccttgtgatccacccgcctcagcttcccaaagtgctgggattacaggcgtgagccaccgctcccggccaaatgaaatggttttcagcgccatacctgtggctgcaaatgtgtagtactttactacataaaggactttacatagacacagatagtcgactacatatatcgggccttctattaaaaattctagcagagctcttaagtttttttgttttgtttttgtttttaaaaacagctttattgagatataatctacataccttgaaattcattcatttaagtrtacaatttaatggcttttagtatatttatagttgtgccatcatcagcacaatcaattaaaattttaagtttaaaatttttttggccaaattatttctcacctgacacaatttttgaatatttacattaccctcaaaagaagcccgtgtgccttttagccattgttccccagtctgcccatcacccccagccctaagcaaccactaatctacttgctgcctgtgtagatcatctattctggacatgtcatatacatgtaaccatacaatatatggtccttttcgactgagtttttttttca

SEQ ID NO: 126154 - DNA, 601 bp, Human
atgtattaaaattgtgtcaatgaaaagatatgtgaatagaaactgtaatatggtccaagattaaatatcaaaatactttagtgcctctaaaatgtaaagtgtggtgcttggtgctgcttgtacaggaggagaacaaaatgagtctctgcttttatggtgtttgcaatctaatgggtagacaaagaacaaaaaaaagtagttggagaggctgagtgccgtggctcacacctgtaatcccagcactttgggaggccgaggcaggtggatcgcctgaggtcaggagttcgagtccagcctggcsagcatggtcaaaccccgtctctactaaaaatgcaaaaattggccgggcatggtggcaggcacgtgtcaggaagctgaggcaggagaatcgtttgaacccgggaggcggaggttgcaccaagccaagatcgcgccattgcactccagcctgggcaacagagcgagactccatctgaaaaagaaaaaaaaaaaaacgtagttggagcaaggagagagaacaagagaagtttaaacttttttagttccttttttttctttaacttttacattgaaattatcttcaacatacaaaataagtaaa

SEQ ID NO: 126155 - DNA, 601 bp, Human
gtagacaaagaacaaaaaaaagtagttggagaggctgagtgccgtggctcacacctgtaatcccagcactttgggaggccgaggcaggtggatcgcctgaggtcaggagttcgagtccagcctggccagcatggtcaaaccccgtctctactaaaaatgcaaaaattggccgggcatggtggcaggcacgtgtcaggaagctgaggcaggagaatcgtttgaacccgggaggcggaggttgcaccaagccaagatcgcgccattgcactccagcctgggcaacagagcgagactccatctsaaaaagaaaaaaaaaaaaacgtagttggagcaaggagagagaacaagagaagtttaaacttttttagttccttttttttctttaacttttacattgaaattatcttcaacatacaaaataagtaaatttaggcatacgaaaaagttgtaaaaatagtacaaaggattcctgttatccttcatgcagattccccagtgtttcacgttagtgtttgaccaccctagttttatcaatcattctctctttacacacccacacacccaccctcacctacccacccacctaccttttcctacaggg

SEQ ID NO: 126156 - DNA, 601 bp, Human
ttattgatttgatgaactgtttaaactatttttttttcttttcttaaagacaaggtcttgctttgtggcccaggctggagtgcaatggtgcagtcatagctcactgcagtgtcagactcctgggcacaagcaatccttctgcctcacacctcctgagtagctgggactgcagtcatcagccacccagctcatgaatgcaatttggttttgaggaaattaaaatcaactcaatactgttagctaatttactgactttatttagattttgccaactgtcccactaatggacctttttttctcrtgcagaattcagtccttcatcacatgtttacattatttgccctgtctcattagtgtcctctaatctggtgatatatcataatgatgtcattctcatgtctcaaaatggagtcactcatgtcaagtagcattgagctcacagcaaagtcgccccttcccccccagcgataaacatatgtaatggactgctgtgacaacatctgccctcaccgggtaccacctgagacttgaaacgaacccgtagaaagtgaaaggtggctgagataatgagaatagacccatttgggaggatcataaaatg

SEQ ID NO: 126157 - DNA, 601 bp, Human
gtccttcatcacatgtttacattatttgccctgtctcattagtgtcctctaatctggtgatatatcataatgatgtcattctcatgtctcaaaatggagtcactcatgtcaagtagcattgagctcacagcaaagtcgccccttcccccccagcgataaacatatgtaatggactgctgtgacaacatctgccctcaccgggtaccacctgagacttgaaacgaacccgtagaaagtgaaaggtggctgagataatgagaatagacccatttgggaggatcataaaatgtgccaggacgasacgcttttagaggctgtgcccaggagacctctgaagcttcctcccgatttggcatctgctgccacctggagagaagcagccaccaccgcccccccccacaactccaccccatccccgcccatggcatccgaaggacttcgggactgttcggctcatctgtttgcctgttggtctccctagccagggttgtgctttgttccccacaacccccttttcttctgcctctgtgttgaatattggttgtgtgattggttggctgtggaggcctcgcaataaaacgtgaattcaagcttatgttgc

SEQ ID NO: 126158 - DNA, 601 bp, Human
tgttggtctccctagccagggttgtgctttgttccccacaacccccttttcttctgcctctgtgttgaatattggttgtgtgattggttggctgtggaggcctcgcaataaaacgtgaattcaagcttatgttgcgtcgttatgaaaccttcgggcgtaggctccgcctgtggtcggagtcagcgcacctgcgcagaacctcgttcacatagtacccaggttaaggcccgacagctgcagcagctccttacatctttctttgccttcatgcctctgacacttttgaagcgtactggccagytattttgtagactgttcctcagtttgcttatggctgatgttttctcacgattagattcaggttttgcacttttggcaggaacttcacagaactgatgttgtgtccacacatattgagaggcgcatgatgtcaatttgtcccattattggtaaggcgaactttgatcacttggttgaggtggtgtaactgccaggtttttatcactataaagttaccatttttttctttgtaattaataagtacaatatcttgtggagagatactttgagactattcacacgtactatttcttatcttgta

SEQ ID NO: 126159 - DNA, 601 bp, Human
tagtatttttttgttttgtttttttgagagtctcactcagtcacccagactggagtacagtgacatgatcttggcttactgcaacctccaccccgccgggctcatatgaccctctcacctcagcctcctgagtagctgggacttcaggtgcattctaccatgcctgtctaatttttgtattgttttgtagagacagggttttgccatgttgccaagggtgagctgaagcaatctgccagtgttggtctcccaaagtgctacaattaccacacccggttttatgtgtatatttctatgtctrtctgtttgtatattaaaatcataaattcatgctgatatgtccaattttgatacctgagagtttgttctttcttatgtgtaatccctcatttgacaccaagaaactgactctcattagccacaatatgttacttatttgctcaattttggaatacatttaaaggagttttagaattgttcacccctgccactcctaatttagtaaccagagtacaacatgtatttgcagctcttttattctttagcctgagacttggagtatgtagtcaaaatactgtgttccaaagttacttaggttagt

SEQ ID NO: 126160 - DNA, 601 bp, Human
cacaaagtgagtttatttaattctgtacactgtagctgtaaaatatgtagtaaatgtaataccatgcaaaccagtctgatctgtcatttcatatcaggttttaatgactgtatttaagaattgtttatacccattagatgtggttgtcccttgatatctgagggattggttccaggaccccccacggacatcaaaatccacagacactcaagtcccttatataaaatggcatagtatttccacgtaacctatgcactgcctcctgtatactttaatctctagattacttattataatgcckaatacaatgtaaatactttgtaaacagttattatactgtattgtttagggaatatttacaaggaaaaaaagtctgtacgtgttctgtacagatatgatcgtctgttttttaatctgtggttggttaagaccatgagtgtagaaactgcaggtacagaaggctgactgtagttactcgtaggttaaaagaagactttagtggtggttttaaaatttttggaataaaagcctttaatgtcaaaggttattagttttttttccttgtgctatatatgtagctttgttttaaaagtgcatatag

SEQ ID NO: 126161 - DNA, 601 bp, Human
tttaattctgtacactgtagctgtaaaatatgtagtaaatgtaataccatgcaaaccagtctgatctgtcatttcatatcaggttttaatgactgtatttaagaattgtttatacccattagatgtggttgtcccttgatatctgagggattggttccaggaccccccacggacatcaaaatccacagacactcaagtcccttatataaaatggcatagtatttccacgtaacctatgcactgcctcctgtatactttaatctctagattacttattataatgcctaatacaatgtaaatrctttgtaaacagttattatactgtattgtttagggaatatttacaaggaaaaaaagtctgtacgtgttctgtacagatatgatcgtctgttttttaatctgtggttggttaagaccatgagtgtagaaactgcaggtacagaaggctgactgtagttactcgtaggttaaaagaagactttagtggtggttttaaaatttttggaataaaagcctttaatgtcaaaggttattagttttttttccttgtgctatatatgtagctttgttttaaaagtgcatatagcttcatgaatgtact

SEQ ID NO: 126162 - DNA, 601 bp, Human
taagttttaggtctgttttctctttcatatgttattaaggtagatgctcttatatgaggaataagaatctaaaagtaaacagttcatgaaataatgatatttactgactgcttaggttcagccgctgtgctagaaactttgcataattaccctttactctgacaccaaccataatagatgataatactatcttcattttacaaatagggacattgagattcagatatgctaagcaggttgtccagtggtgcacagctaataaactgcagagctatgatttgagctcagttgtggatctctrtttcccacaatccttctccaaggattttctctcatcttcctgaaaatctctcgaagacactgatgagttatttgttaatcaccaaatctggtggattttttgtttgtttgttttttaagtcctcatctggttggacctttatcattcagcacagttagtgtatattttattgaaactttctttcctggcttcctaaacaatttttttattttttttttggagacagagtctcactgtgtcatccaggctggagtgtagtggtgtgatcatggctcactgcagctatatgttgcccaggct

SEQ ID NO: 126163 - DNA, 601 bp, Human
tagaaactttgcataattaccctttactctgacaccaaccataatagatgataatactatcttcattttacaaatagggacattgagattcagatatgctaagcaggttgtccagtggtgcacagctaataaactgcagagctatgatttgagctcagttgtggatctctatttcccacaatccttctccaaggattttctctcatcttcctgaaaatctctcgaagacactgatgagttatttgttaatcaccaaatctggtggattttttgtttgtttgttttttaagtcctcatctgkttggacctttatcattcagcacagttagtgtatattttattgaaactttctttcctggcttcctaaacaatttttttattttttttttggagacagagtctcactgtgtcatccaggctggagtgtagtggtgtgatcatggctcactgcagctatatgttgcccaggctgctgttggactcctgggctcaagcgttcctcttgcctcagcctcctgagtagttgggactacaggtgggcatgctactgtacccggctggaagcacataactttaaagctgaagatattttagaaaacat

SEQ ID NO: 126164 - DNA, 601 bp, Human
acattgagattcagatatgctaagcaggttgtccagtggtgcacagctaataaactgcagagctatgatttgagctcagttgtggatctctatttcccacaatccttctccaaggattttctctcatcttcctgaaaatctctcgaagacactgatgagttatttgttaatcaccaaatctggtggattttttgtttgtttgttttttaagtcctcatctggttggacctttatcattcagcacagttagtgtatattttattgaaactttctttcctggcttcctaaacaatttttttattttttttttggagacagagtctcactgtgtcatccaggctggagtgtagtggtgtgatcatggctcactgcagctatatgttgcccaggctgctgttggactcctgggctcaagcgttcctcttgcctcagcctcctgagtagttgggactacaggtgggcatgctactgtacccggctggaagcacataactttaaagctgaagatattttagaaaacatttacatagacatttcgtctaacttaatttatagaagaggcaactgaaatctaatatacttaaatgagaattggtatatc

SEQ ID NO: 126165 - DNA, 601 bp, Human
ctttgaaagaagtggctttgtatgaataatgatagatgcatccacttttttttttttttttttgagatggaatctcactctgtcgcccaggctggagtccagcggtgcgaactcagctcgctgcaaccttggcctttccagttcaagcacttctcccttcctcacatccccagtggctgggattataggcatccgccaccatgcctggctaatttttgtattttcagtagaaatggggttttgccatgttggccaggctggtgttgaactcctgacctcaggtgatctgcccgcctcagcytcccaaagtgctggcattacaggtgtgagccaccatgcccggccagatgcatccatttttaaataaactatcttattgaattgtaagatagtttaatgtgtacgaatagtatgtaaacagcatggtaaacttttataatatgaacacacttatataaccactacccaagtcaagtgtattgactaaatttgtgtatttatgaagtgttttttttttttttttgagacagagtcttgctctgtcgcccaggctggagtgcagtggcgtgatctcggtttattgcaagctccgcctcccagg

SEQ ID NO: 126166 - DNA, 601 bp, Human
gaagttctctgccattccatccattttcttgcacatttctattgttattttaaagtccctgttttaaaatttcaatagctggataactgtggtgatgcttctaccaatatcttttcccccattggtttttggcatttgattatatttcttgttagaatgacaactttgttttttagcattggtccttgggtatgaaaaattcttgacacgtgctgttcaatatggtagccactaatcactgtggctggctggctggctatctttgtctgtctgtctgtctgtctgtctgtctgtctgtctrtcttatctatctatctatctatctatctatctatctatctaatctatctatctattctattgagggtcttgctgtgtcacccaggctggagtacagtggcaccatcttggctcactgtaacttccacatcccaggttcaagtgattctcctgcctctcagcctcctgagtagctgggattacaggtgtgcaccaccatgacccagctaatttttgtatttttagtagagatggggttttgctatgttgggcaggctggtctcaaactcctggcctcaagtgattcgcccagcttggcctc

SEQ ID NO: 126167 - DNA, 601 bp, Human
tctctgccattccatccattttcttgcacatttctattgttattttaaagtccctgttttaaaatttcaatagctggataactgtggtgatgcttctaccaatatcttttcccccattggtttttggcatttgattatatttcttgttagaatgacaactttgttttttagcattggtccttgggtatgaaaaattcttgacacgtgctgttcaatatggtagccactaatcactgtggctggctggctggctatctttgtctgtctgtctgtctgtctgtctgtctgtctgtctatcttrtctatctatctatctatctatctatctatctatctaatctatctatctattctattgagggtcttgctgtgtcacccaggctggagtacagtggcaccatcttggctcactgtaacttccacatcccaggttcaagtgattctcctgcctctcagcctcctgagtagctgggattacaggtgtgcaccaccatgacccagctaatttttgtatttttagtagagatggggttttgctatgttgggcaggctggtctcaaactcctggcctcaagtgattcgcccagcttggcctcccaga

SEQ ID NO: 126168 - DNA, 601 bp, Human
tgccattccatccattttcttgcacatttctattgttattttaaagtccctgttttaaaatttcaatagctggataactgtggtgatgcttctaccaatatcttttcccccattggtttttggcatttgattatatttcttgttagaatgacaactttgttttttagcattggtccttgggtatgaaaaattcttgacacgtgctgttcaatatggtagccactaatcactgtggctggctggctggctatctttgtctgtctgtctgtctgtctgtctgtctgtctgtctatcttatctrtctatctatctatctatctatctatctatctaatctatctatctattctattgagggtcttgctgtgtcacccaggctggagtacagtggcaccatcttggctcactgtaacttccacatcccaggttcaagtgattctcctgcctctcagcctcctgagtagctgggattacaggtgtgcaccaccatgacccagctaatttttgtatttttagtagagatggggttttgctatgttgggcaggctggtctcaaactcctggcctcaagtgattcgcccagcttggcctcccagagtgc

SEQ ID NO: 126169 - DNA, 601 bp, Human
ccatccattttcttgcacatttctattgttattttaaagtccctgttttaaaatttcaatagctggataactgtggtgatgcttctaccaatatcttttcccccattggtttttggcatttgattatatttcttgttagaatgacaactttgttttttagcattggtccttgggtatgaaaaattcttgacacgtgctgttcaatatggtagccactaatcactgtggctggctggctggctatctttgtctgtctgtctgtctgtctgtctgtctgtctgtctatcttatctatctatctatctatctatctatctatctatctaatctatctatctattctattgagggtcttgctgtgtcacccaggctggagtacagtggcaccatcttggctcactgtaacttccacatcccaggttcaagtgattctcctgcctctcagcctcctgagtagctgggattacaggtgtgcaccaccatgacccagctaatttttgtatttttagtagagatggggttttgctatgttgggcaggctggtctcaaactcctggcctcaagtgattcgcccagcttggcctcccagagtgcttggatt

SEQ ID NO: 126170 - DNA, 601 bp, Human
ggtgatgcttctaccaatatcttttcccccattggtttttggcatttgattatatttcttgttagaatgacaactttgttttttagcattggtccttgggtatgaaaaattcttgacacgtgctgttcaatatggtagccactaatcactgtggctggctggctggctatctttgtctgtctgtctgtctgtctgtctgtctgtctgtctatcttatctatctatctatctatctatctatctatctatctaatctatctatctattctattgagggtcttgctgtgtcacccaggctggmgtacagtggcaccatcttggctcactgtaacttccacatcccaggttcaagtgattctcctgcctctcagcctcctgagtagctgggattacaggtgtgcaccaccatgacccagctaatttttgtatttttagtagagatggggttttgctatgttgggcaggctggtctcaaactcctggcctcaagtgattcgcccagcttggcctcccagagtgcttggattacaggcatgagccaccgtgcccagcctatttaagtttaaattaattaaaattaaataaaatttgcaattaaatt

SEQ ID NO: 126171 - DNA, 601 bp, Human
tatctatctatctatctatctatctatctatctaatctatctatctattctattgagggtcttgctgtgtcacccaggctggagtacagtggcaccatcttggctcactgtaacttccacatcccaggttcaagtgattctcctgcctctcagcctcctgagtagctgggattacaggtgtgcaccaccatgacccagctaatttttgtatttttagtagagatggggttttgctatgttgggcaggctggtctcaaactcctggcctcaagtgattcgcccagcttggcctcccagagtrcttggattacaggcatgagccaccgtgcccagcctatttaagtttaaattaattaaaattaaataaaatttgcaattaaattcctcagttacattagccacatctcaggtgcccaatagctacatgtgcagatagagatagtacaaatagtacagataggaacatttccgttgttgcgaaaatacggtaggacagcggtatgctagtgagtctacatgaaatcttcctccagagaaaatgcagttttatgctggaaggcagatcaagtaggtagatcatgttattctaagggagaccggt

SEQ ID NO: 126172 - DNA, 601 bp, Human
tttttgtatttttagtagagatggggttttgctatgttgggcaggctggtctcaaactcctggcctcaagtgattcgcccagcttggcctcccagagtgcttggattacaggcatgagccaccgtgcccagcctatttaagtttaaattaattaaaattaaataaaatttgcaattaaattcctcagttacattagccacatctcaggtgcccaatagctacatgtgcagatagagatagtacaaatagtacagataggaacatttccgttgttgcgaaaatacggtaggacagcggtatgctagtgagtctacatgaaatcttcctccagagaaaatgcagttttatgctggaaggcagatcaagtaggtagatcatgttattctaagggagaccggtctgtttcagtttgtctttgttctagtagttcagccctttgtggttttgcttgaaaagcctgaggcatctgccaaggcccctcttccttggtaggttctgaattccaggttttgttttgccggcccagtgggatggctgcaggctcttgactactactttctgttcagcctctatgccttactttgaattgttgactacctta

SEQ ID NO: 126173 - DNA, 601 bp, Human
ctattgacatcctgtaccacagtgtacatttgttaggattgataaacctccattgatgcattgctatcacgcaaagtcagaaaacacacccttttttgtttttgtttttaaagagttgaagtcttggccatatgcagtggcatatacctgtaatcccagcactttgggaggctgaggcaggaggatcgctccaggagttcatgagcagcttgggcaacatagcaggaccctgtttctacacacacacacacacacacacacacacacacactacacacacacacttgggcaacatagcaaraccctgtttctacacacacacacacacacacacacactacacacacacacgggcaacatagcaagaccctgtttctacacacacacacacacacacacacacacaccacgaaaaaatacagcttttaattttttgtatgtgtgtgttttgtagagacagggtcttgctatgttgcccaggatggtcttgaactcctggcctcaagctatccttctgcctcagcatctggagaagctccaactacagatgtgcaccactgtctggctacacacagctatttttatgtgtatattttttcta

SEQ ID NO: 126174 - DNA, 601 bp, Human
aacatgaatctgggatttatttatttttttaaagtattgttgtgacattattgggacagttggcaacattgaattgtaatatcatattaatttcctgattttgacaaatatactgtagctatgcaagagcttgttttggggaagtatacactgaatgaagcatttagaagtaaaggggtacagtgtctgccacttaactctcaaacagttcagaaaaattatatttgtgtgtgtatataaaagaaagagagttaaggcaaatggagtaaagtgttaacatttggggaatctagttgagggktattatcagaattgtgctattttttgcaacttttctgtaagtctaaaattatgtcaacatgatcagttataaggaaaaaaaagtataggaaaaatactaatgatttttctagctgttaagtgataatttaagaaatggtgtgctccagagcaccatgagattacgtgagatcacctgatgaaccagagtgtcattttctatgtgctcatttatgcacaagtacccggtcttatggttaaataatgtgtttattttatttttatttatttatttttttaaatttttttgagagatagggtc

SEQ ID NO: 126175 - DNA, 601 bp, Human
gttctcacagtcttctcttacatattgtgagatttttgatagaatcttgctctgttacccaggctggagtgcagtggcgtgatcttgactcactgcaaccttggcctccggggctcaagcaattctcatgcctcagcctcccaagtagctgggattacaggcacgcgccaccacacctgcctaatttttgtatttttagtagagatggggcttcaccatgttggccaggatggtcttgatctcctgacctcgtgatccacctgcctcggcctcccaaggtgctgggattacaggcgtgagccactgcgcctggccctagctaagttatttatttgtagagacaaggtcttgctgtgttgcccagccttgtctcgaacttctgcactcaagctgtctgcctgccttggcctcccaaagtgatgggattacagatgtgagccactgtgcctggccctgactcctatttttataaaatattagctattgatcagtcatagaaatgcaaattattgctgtattcatctcttttggtattgggctgtgaactatatttgtggcatattggtaacaaatattaaatctttgctgtcttctatcctcc

SEQ ID NO: 126176 - DNA, 601 bp, Human
tcttacatattgtgagatttttgatagaatcttgctctgttacccaggctggagtgcagtggcgtgatcttgactcactgcaaccttggcctccggggctcaagcaattctcatgcctcagcctcccaagtagctgggattacaggcacgcgccaccacacctgcctaatttttgtatttttagtagagatggggcttcaccatgttggccaggatggtcttgatctcctgacctcgtgatccacctgcctcggcctcccaaggtgctgggattacaggcgtgagccactgcgcctggccytagctaagttatttatttgtagagacaaggtcttgctgtgttgcccagccttgtctcgaacttctgcactcaagctgtctgcctgccttggcctcccaaagtgatgggattacagatgtgagccactgtgcctggccctgactcctatttttataaaatattagctattgatcagtcatagaaatgcaaattattgctgtattcatctcttttggtattgggctgtgaactatatttgtggcatattggtaacaaatattaaatctttgctgtcttctatcctccatctcttgagtttaa

SEQ ID NO: 126177 - DNA, 601 bp, Human
ctgactcctatttttataaaatattagctattgatcagtcatagaaatgcaaattattgctgtattcatctcttttggtattgggctgtgaactatatttgtggcatattggtaacaaatattaaatctttgctgtcttctatcctccatctcttgagtttaaaatttaataggctttgaaaatatttgttattgttgttattctttgtacttggtgctttgatctggatcattgtcctgcatacttaaaagattaagtggcctttcaataaggatatttttaactgtgatatttttagtmtaagacacaaactacatttgaatgagtatctattctgagcctgtactttgattacatttcaacatgtaatcacaacatggatagttgcggttatagagtcataaaaacaatctgcatgaaggtccagtattctgtagtgatgttatttcttattatatcgaaaacattcataacaaaaaatatttgtagaagcggttgatcatctgttttgaaatctgtctacctttctaagaatgttgagggtttgttgcttgttttaaaaaagcaccattctgtgggatattgaaaaagctgctttaa

SEQ ID NO: 126178 - DNA, 601 bp, Human
gaggctgaggtaaggggatcacttgaggccaggagttcgagaccagcctgggcatgtagcaagaccatgtctctacaaaaaataaaaaccattagctgggcatggtggtgcacgcctgtagtcccagctacttgggatgctggagggaggaggattgccagaccctggaggttgagactgcagtgagctatgattgcatcactgctctccagcctgggctatagacaagaccccatcacaaaacaacaacaaaaaacccagaaaattgttccttataataaataaaaataaataagattcacttaagatctaatttgatacttatagtaagaaaactagtaaattcctttgcagtctcaaagactgacaattttaaacattaatctttttttattatgtgtttaattaattttttttgagacagagccttgctctgttgcccaggctggtgccatcttgcttgctgcaacctccgcctcctaggttcaaggaattctcatgcctcagcctccctaatagctggaattacaggtgtgcgccaccatgcctgactaatttttgtatttttagtagagatggggttttgccgtattggccaagg

SEQ ID NO: 126179 - DNA, 601 bp, Human
tgtgggcctgagaaactgaaaggacagaattgtcgtttactgacatgggtaggactgtgagagaagtgagtttgggggaatcaggagtttttctgaacacattcagtttgagatgcctaataaacattcaaaaagaagtgctgagcagacaattggattcacaagtctggagttaaaagagagaggtctgagttggagatgtacgtttgggagtcttaagaatagaggtgcttatgtaaaaacatgtgacaggatgagatcatgtaagggaggttagtgcacatagagaggatagattccyaaagactgagccttcagataccccaaagtttaaacgttgggaaaatgaaacggaactagtgaagcaatctgaaaagggtgtgctagtgagataaggaggagaacgaagagttctggtgccctggaattcaagtgcaggtagattaataatcagctgtgttaaatactgcaagtcaagtagattgaggacgtagcgaatgcagtggtttagtgaccttgataagagctatctgggtggaatgatagggtaatgaaagcctttttgaatgagttcaagatgggggtggagttggaggcagct

SEQ ID NO: 126180 - DNA, 601 bp, Human
aaagtggaagaactttctgtaggagtaggacagaagatttctgtgagtggtccattagtcagaattcttgctatggtcttttccatacataagtatatttagcccatgggaggaatttgagagccaattaagatgaaaccagtaaactaagctttattcactactgacagacggatgtattctttcaatgcatggtttattttttaaagtgtattgtgttgtaaactggctggtagaactgtcatgtctctggcagtttcatctagattttaagtgctttcaggcattgcttcccaacttkcctcatgctatggtatgatatacatagaaaatgcatggcatgctacggttaactggggaggatttggtcttgtttgtaggggacttagtgaagaaatttactgcattttctctatgatagataacgtattgtgaaatgaaatgcggaagcttttgggaagctagttgtggcagctgtgaaagtgtgccactcagaatccccttcaagagagtcccctgtgtagagcagctggctgagagcctccagctgctgcaccttcagatgtgctgcagtgctcaggctgaggccatacttcctttg

SEQ ID NO: 126181 - DNA, 601 bp, Human
tgaatttcctttgccagaagagttgtagggaagaaatggggtggtcctcccattggtctaacttcttgagtgtaaggctttggttctcaactttggctatatgttgaagccactcttgattcctaagtctaatccccagggtttctgatttaattggtgtagggtgtggccaggaccaaataattgtaatgtgtagccaagattgagaaccactgccttaggagatgacaacccccagtctcagttaagaaattagcaggcttattttgcttaactctaggtaatatacgtactgagaagrtctgggaaccatcccaatagtaatgaggatccatagctccctgatctttgtttcaaaggtctattctatacgaaaagataccagagatcctcagagaaatagctgtttttaggactggagcagggaaagaacaagatgtgcctggaatatcttgctgtgtcagaaagcaaagaaataatcagagattattgtcagaagaacataaaagtctgagggagttatgactggtcaaatctgggatttttttttttttcccccgagacagagcctggctctgtccctcaggctggagtgcagtgg

SEQ ID NO: 126182 - DNA, 601 bp, Human
ctcctgatctcaaatgatccacccaccttggcctcccaaagtgttgggaatacaggcaagagccactgcgcctggccacatatgtttctcagaacagctttagtctgtttattaatgtgtttgactttcatagattttccccatctcgctagattgtgatcacctaatgttaggatgtgaaagggccaccagtagggtatgtctctctctattatctgttccttattccagtaatcagctgcctagatatacttggacaccccaactggggagttggtattttttttagacagggtctcastctgtcatctaggctggaatgcagtggcatgatcatagctcactgcagtcttgaactactgggctcgaggaatcctcctacctcaggctgtgcccagtagctggggatacaggtgtgcaccagcatgcctgactcatttttaattttttgtagagatggggtctctttctctatgttgcccaagctggtctcaaagtcctgggcttaagccatcctcccgcctggacctccagacatgctgggattacaggtgtgagccactgcacctggcctggcagtttttttctaattattattttt

SEQ ID NO: 126183 - DNA, 601 bp, Human
aatgttatccagaacaactaagagtctgactttatattcaaattatatttggtaatttcaagtcttatgtaagaaaaataaagttcactatttcaactgcagagaaaataaatctttcaagatttctatttttgtcaggctatttagcaaagagacccacacaagctggcccaaataaggggacatttatttatatgtgtggatgtattaggccatttgcattgctataaaggaatacctgagtaatttataaagaaaagagatttaattggctcacagttctgcaggctgtacaagcagsgctccagcatgtgcttctggtgagggtcttaggtagcttacaatcatggcagaagggaaggggagcaggcgtttcacatggtgagaataggagcaagagatgggggagatgggtactacacaccttgaaacaaccagatcttgagagaactcactgttggggggacagcaccaagccattcatgaggtatcggcccctattacccaaacacctcccaccaggccctacctccaacactggggattatatttcaacatgagatttggaggggacaaacattcaaactatatcagtggacta

SEQ ID NO: 126184 - DNA, 601 bp, Human
agacatttagctaccaatactaaacataaaagtgactgagagctcagttatttaaaattttggtcaaaagagttttgtcccaaaatattatagtctttattgatagcttaggtaataaataatggattgatttcaattacattaatgtcccttcattaaataaaaatagccaattaaatcctcaagcggaatgggtgacagaatacctttgaagaggctatacattcttttttttttttttttttgagacagagtttcactcttgttgcccaggcaggagtgcaatggcactatctcggckcactgcaacctgcagcctccgcctcccgggttcaagcaattctgccttagcctcccgagtagctgggaagctgggattacaggcatgcgccaccacgcctggctaattttgtatttttagtagagacggggtttttccatgttggtcttgaactcctgacctcaggtgatccacctgcctcggcctcccaaaatgttgggattacaggggtgagccaccatacctggctggctatacattcttaaactaggaaatctcttagtggtttctagggaatcatagcagcaaacctcactactg

SEQ ID NO: 126185 - DNA, 601 bp, Human
atataggagaattcttctcatcttaaggcattgcttgtggagagaatttacagacaatgagatttttgttcagatttggaaatttgctctctctgttcatccttgtcaaagtgaagagatttttttttttcttgaagagattgtctatatattgcaatatatctacactgcctgggtgtgcttatattccatgtcttggagaattggatgatcaagacaggctttttagcaggagtaagaagatttttattaaacttgactcatacctggctctttaggtggagcacagagagtagaataccctggtatggtagtaaggtaacagtctcagtgaagaaaataaacaggctgaaatggacattctctttaggattaacacttacatctgtgaaatagaaaatttgaggttgttttacaatagagaaagaaaacaattgtagtatttttctcttatgcctgaagagaaacactcaacatcacatttatccccaaattgattatattatatttaaataatttgcaagcccatgttgaaagtaactgctgcaataaactggaattatgaagtgctgaaatgattttcattaatgtactttctgat

SEQ ID NO: 126186 - DNA, 601 bp, Human
caaacagcggcaaaccatcattattgccgactccccgagtcctgcagtgagtgtcatcactatcagcagtgacactgatgaggaagagacttcccagagacattcactcagagagtaagtgccaaacgctgcatcctcaaaggatatagatggcatcctttggtgtgccgaaaaacaactttctgtgacttatttcttgtttgtcaatgtactctggagtaaaacctttaaattagataacccagttctagacagggaactttctaaataacatttagcacgattattatagcattttccytgtatctgtaagctttaactttttgtccatgtaggtcattcttaacagtttcatatccttaattaaagaatataaattttggctatttggagagtatcttcttgtatttgactcatgtttttcccttttctcttccactagatgtaaaggtagtctagattgtgaagcttgccagagcactttgaatattgatcggatgtgttcattaagtagtcctgatagtactctgagtaccagctcctcagggcagtccagcccatccccctgcaagagaccgaataggtaaaagaatctcaatag

SEQ ID NO: 126187 - DNA, 601 bp, Human
aggtcattcttaacagtttcatatccttaattaaagaatataaattttggctatttggagagtatcttcttgtatttgactcatgtttttcccttttctcttccactagatgtaaaggtagtctagattgtgaagcttgccagagcactttgaatattgatcggatgtgttcattaagtagtcctgatagtactctgagtaccagctcctcagggcagtccagcccatccccctgcaagagaccgaataggtaaaagaatctcaatagtagtgtgtaataaatagtaagtctactaaaaarcctacgatttctttctgttgtttaataagtacctgccagtttaccacagtgacttctatcttgaacacaatttttgaactagatcagtttttataaacacaggtttgtttgtttgtttgtttgtttttgagacagggtcttgctttgttgcccaggctggaatgcagtggcatgatctcggctcacagcaacctctgcctcccaggctcaagcaatcctcttgccttagcctcttgagtagctgggaccacaggtgcgcacagcgatgctcggctaatttttaagttttttttgtagaga

SEQ ID NO: 126188 - DNA, 601 bp, Human
gccttagcctcttgagtagctgggaccacaggtgcgcacagcgatgctcggctaatttttaagttttttttgtagagatgggatcttgccctgttgcacaggctggtcttgaactcctgggctcaaccagtgctcccaccttggcctcccaaagtgctgggattacaggcatgagccaccatacctaactaaataatctttttttgctgaggggcgggtgggaggagatgaagtgtggctctgtcacctaggctggagtgcaatggtgtgatcttggctcaccgcagcctccgcctccccrggttcaagtgagtctcctgcctcagcctcccatgtagctgggactacaggaacctgccaccacacctggctaattttttgtatttttagtagagatggggtttcaccaggacatgctggtcttgaactccttacctcaggtgatctgcctgcctcagcctcccaaaatgctaggattacaggcgtgagccaccacatccagccaaataatctatttttgaaaggataaaaaagccacattcttaatttcagccccacagactactattgtaacttaaatttggaataaaaacatatactt

SEQ ID NO: 126189 - DNA, 601 bp, Human
gggctcaaccagtgctcccaccttggcctcccaaagtgctgggattacaggcatgagccaccatacctaactaaataatctttttttgctgaggggcgggtgggaggagatgaagtgtggctctgtcacctaggctggagtgcaatggtgtgatcttggctcaccgcagcctccgcctccccaggttcaagtgagtctcctgcctcagcctcccatgtagctgggactacaggaacctgccaccacacctggctaattttttgtatttttagtagagatggggtttcaccaggacatgctkgtcttgaactccttacctcaggtgatctgcctgcctcagcctcccaaaatgctaggattacaggcgtgagccaccacatccagccaaataatctatttttgaaaggataaaaaagccacattcttaatttcagccccacagactactattgtaacttaaatttggaataaaaacatatactttagcaaaattaaaaaggaatgttttgcataatgaagtactcactggcccactgtctacaggacatccactatgatttttttctcccattggtgactgatttgcatggttttatccata
